(12) United States Patent
Gallo et al.

(10) Patent No.: US 8,012,714 B2
(45) Date of Patent: Sep. 6, 2011

(54) SEQUENCE DIVERSITY GENERATION IN IMMUNOGLOBULINS

(75) Inventors: Michael Gallo, North Vancouver (CA); Jaspal Singh Kang, Surrey (CA); Craig Robin Pigott, Vancouver (CA)

(73) Assignee: Innovative Targeting Solutions, Inc., Burnaby (CA)

(*) Notice: Subject to any disclaimer, the term of this patent is extended or adjusted under 35 U.S.C. 154(b) by 0 days.

(21) Appl. No.: 12/423,594

(22) Filed: Apr. 14, 2009

(65) Prior Publication Data

US 2009/0258392 A1  Oct. 15, 2009

Related U.S. Application Data

(60) Provisional application No. 61/044,795, filed on Apr. 14, 2008.

(51) Int. Cl.
*C12N 15/00* (2006.01)
*C12N 15/11* (2006.01)
*C12N 5/06* (2006.01)
*C12P 21/08* (2006.01)

(52) U.S. Cl. .............. 435/69.6; 435/320.1; 435/326; 536/23.53

(58) Field of Classification Search ............. 435/69.6, 435/320.1, 326; 536/25.53
See application file for complete search history.

(56) References Cited

U.S. PATENT DOCUMENTS

| | | | |
|---|---|---|---|
| 5,159,066 A | 10/1992 | Schatz et al. ............ 536/27 |
| 5,569,825 A | 10/1996 | Lonberg et al. | |
| 5,756,323 A | 5/1998 | Kallenbach et al. | |
| 2004/0156832 A1 | 8/2004 | Jolly | |
| 2006/0263787 A1 | 11/2006 | Evans et al. | |
| 2009/0111126 A1 | 4/2009 | Akamatsu et al. | |

OTHER PUBLICATIONS

Ferrier et al. (International Immunology 1989, 1:66-74).*
Oltz et al. (Mol. Cell Biol. 1993 13:6223-6230).*
Akamatsu et al., "Essential Residues in V(D)J Recombination Signals," The Journal of Immunology, 153:4520-4528, 1994.
Akamatsu et al., "Whole IgG surface display on mammalian cells: Application to isolation of neutralizing chicken monoclonal anti-IL-12 antibodies," Journal of Immunological Methods, 327:40-52, 2007.
Jung et al., "Mechanism and Control of V(D)J Recombination at the Immunoglobulin Heavy Chain Locus," Annu. Rev. Immunol., 24:541-570, 2006.
Kallenbach et al., "Three lymphoid-specific factors account for all junctional diversity characteristic of somatic assembly of T-cell receptor and immunoglobulin genes," Proc. Natl. Acad. Sci. USA, 89:2799-2803, Apr. 1992.
Landau et al., "Increased Frequency of N-Region Insertion in a Murine Pre-B-Cell Line Infected with a Terminal Deoxynucleotidyl Transferase Retroviral Expression Vector," Molecular and Cellular Biology, 7(9):3237-3243, Sep. 1987.
Nicholson et al., "Antibody Repertoires of Four- and Five-Feature Translocus Mice Carrying Human Immunoglobulin Heavy Chain and κ and λ Light Chain Yeast Artificial Chromosomes," The Journal of Immunology, 163:6898-6906, 1999.
Oltz et al., "A V(D)J Recombinase-Inducible B-Cell Line: Role of Transcriptional Enhancer Elements in Directing V(D)J Recombination," Molecular and Cellular Biology, 13(10):6223-6230, Oct. 1993.
Ramsden et al., "Conservation of sequence in recombination signal sequence spacers," Nucleic Acids Research, 22 (10):1785-1796, 1994.
Schatz, David G., "V(D)J recombination," Immunological Reviews, 200:5-11, 2004.
Alt et al., "Function and Control of Recombination-Activating Gene Activity," Annals New York Academy of Sciences 651(1):277-294, 1992.
Ferrier et al., "T cell receptor DJ but not VDJ rearrangement within a recombination substrate introduced into a pre-B cell line," International Immunology 1(1):66-74, 1989.
Hassanin et al., "Evolution of the recombination signal sequences in Ig heavy-chain variable region locus of mammals," PNAS 97(21):11415-11420, Oct. 10, 2000.
Parham, Peter, "The Immune System," 2nd ed., Garland Science, New York, N.Y., 2005, Chapter 3, p. 68.
Yu et al., "Differential Usage of VH Gene Segments Is Mediated by cis Elements," The Journal of Immunology 161:3444-3454, 1998.
International Search Report and Written Opinion, mailed Feb. 1, 2010, for PCT/US2009/040540, 16 pages.
Blackwell et al., "Recombination between immunoglobulin variable region gene segments is enhanced by transcription," Nature 324:585-589, 1986.
Chakraborty et al., "Repeat Organization and Epigenetic Regulation of the $D_H$-$C_\mu$ Domain of the Immunoglobulin Heavy-Chain Gene Locus," Molecular Cell 27:842-850, 2007.
Cortes et al., "In vitro V(D)J recombination: Signal joint formation," Proc. Natl. Acad. Sci. USA 93:14008-14013, 1996.
Cowell et al., "Computational tools for understanding sequence variability in recombination signals," Immunological Reviews 200:57-69, 2004.
Cuomo et al., "Analysis of regions of RAG-2 important to V(D)J recombination," Nucleic Acids Research 22(10):1810-1814, 1994.
Ferrier et al., "Separate elements control DJ and VDJ rearrangement in a transgenic recombination substrate," The EMBO Journal 9(1):117-125, 1990.
Hesse et al., "V(D)J recombination: a functional definition of the joining signals," Genes & Dev. 3:1053-1061, 1989.

(Continued)

*Primary Examiner* — Lynn Bristol
(74) *Attorney, Agent, or Firm* — Quarles & Brady LLP; Sara D. Vinarov

(57) ABSTRACT

Compositions and methods are disclosed for generating immunoglobulin structural diversity in vitro, and in particular, for reducing biases in V region and J segment gene utilization, and for generating immunoglobulin V-D-J recombination events in a manner that does not require D-J recombination to precede V-DJ recombination. Selection of advantageous combinations of immunoglobulin gene elements, including introduction of artificial diversity (D) segment genes and optimization of recombination signal sequence (RSS) efficiency, are disclosed.

44 Claims, 12 Drawing Sheets

OTHER PUBLICATIONS

Huse et al., "Generation of a Large Combinatorial Library of the Immunoglobulin Repertoire in Phage Lambda," *Science* 246:1275-1281, 1989.

Inlay et al., Critical roles of the immunoglobulin intronic enhancers in maintaining the sequential rearrangement of *IgH* and *Igk* lodi, *JEM* 203(7):1721-1732, 2006.

Kallenbach et al., "A rapid test for V(D)J recombinase activity," *Nucleic Acids Research* 18(22):6730, 1990.

Lee et al., "A Functional Analysis of the Spacer of V(D)J Recombination Signal Sequences," *PLoS Biology* 1(1):056-069, 2003.

Lieber et al., "Developmental stage specificity of the lymphoid V(D)J recombination activity," *Genes & Development* 1:751-761, 1987.

Maës et al., "Activation of V(D)J Recombination at the IgH Chain JH Locus Occurs within a 6-Kilobase Chromatin Domain and Is Associated with Nucleosomal Remodeling," *J Immunol* 176:5409-5417, 2006.

Nadel et al., "Sequence of the Spacer in the Recombination Signal Sequence Affects V(D)J Rearrangement Frequency and Correlates with Nonrandom Vκ Usage In Vivo," *J. Exp. Med.* 187(9):1495-1503, 1998.

Repasky et al., "Mutational Analysis of Terminal Deoxynucleotidyltransferase-Mediated N-Nucleotide Addition in V(D)J Recombination," *J. Immunol.* 172:5478-5488, 2004.

Roch et al., "V(D)J recombination frequency is affected by the sequence interposed between a pair of recombination signals: sequence comparison reveals a putative recombinational enhancer element," *Nucleic Acids Research* 25(12):2303-2310, 1997.

Sadofsky et al., "Expression and V(D)J recombination activity of mutated RAG-1 proteins," *Nucleic Acids Research* 21(24):5644-5650, 1993.

Silver et al., "Dispensable sequence motifs in the RAG-1 and RAG-2 genes for plasmid V(D)J recombination," *Proc. Natl. Acad. Sci. USA* 90:6100-6104, 1993.

Spicuglia et al., "Regulation of V(D)J recombination," *Current Opinion in Immunology* 18:158-163, 2006.

Williams et al., "Unequal $V_H$ Gene Rearrangement Frequency Within the Large $V_H$7183 Gene Family Is Not Due to Recombination Signal Sequence Variation, and Mapping of the Genes Shows a Bias of Rearrangement Based on Chromosomal Location," *J Immunol* 167:257-263, 2001.

* cited by examiner

SEQUENCE DIVERSITY GENERATION IN IMMUNOGLOBULINS

CROSS-REFERENCE TO RELATED APPLICATION

This application claims the benefit under 35 U.S.C. §119 (e) of U.S. Provisional Patent Application No. 61/044,795 filed Apr. 14, 2008. This provisional application is incorporated herein by reference in its entirety.

STATEMENT REGARDING SEQUENCE LISTING

The Sequence Listing associated with this application is provided in text format in lieu of a paper copy, and is hereby incorporated by reference into the specification. The name of the text file containing the Sequence Listing is 520056_403_SEQUENCE_LISTING.txt. The text file is 3838 KB, was created on Apr. 14, 2009, and is being submitted electronically via EFS-Web.

BACKGROUND

1. Technical Field

The present invention relates generally to compositions and methods for use in generating antibodies. In particular, according to the invention embodiments described herein there is provided an in vitro molecular biological approach to generating immunoglobulins and modified immunoglobulins having structurally diverse variable regions and other advantageous properties.

2. Description of the Related Art

Adaptive immunity in higher organisms is intimately linked to the expression of antigen-specific immunoglobulin (antibodies) and T cell receptor (TCR) genes. Antibody molecules contain two chains (heavy and light), each of which comprises a variable region and a constant region. The variable region is responsible for antigen binding while the constant region imparts effector functions such as complement dependent cytotoxicity (CDC) and antibody-dependent cell-mediated cellular cytotoxicity (ADCC). In addition, the constant region of the IgG molecule contains a FcRn binding domain that is responsible for the extended half-life of antibodies relative to other serum proteins. In order to combat a large array of pathogens, the immune system has evolved the ability to generate vast repertoires of antibody and TCR binding specificities for various antigens. These large repertoires of antibody variable regions are not encoded in the genome, but instead result from the assembly of recombined germlne V (variable), D (diversity) and J (joining) gene segments.

The recombination of different immunoglobulin heavy chain (IgH) V, D, and J gene segments creates a wide repertoire of antibody variable regions having distinct binding specificities for different antigens. Antibody light chains (Kappa and Lambda) are also generated via the same type of recombination process except that the light chain does not have any D gene segments. These recombination events involve the breaking and joining of DNA segments in the genome. In response to antigen, somatic hypermutation (SHM) and class switch recombination (CSR) induce further modifications of immunoglobulin genes in B cells. CSR changes the IgH constant region from IgM to IgG concomitant with the initiation of SHM within the germinal center of secondary immune organs. CSR also provides alternate sets of constant regions with distinct effector functions (e.g., IgG1, IgG2, IgG3, IgG4, IgE and IgA). SHM introduces mutations, at a high rate, into variable region exons, ultimately allowing affinity maturation.

All of these genomic alteration processes require tight regulatory control mechanisms, both to ensure development of a normal immune system and to prevent potentially oncogenic processes, such as translocations, caused by errors in the recombination/mutation processes. The possible negative outcomes of a reaction that initiates double stranded chromosomal breaks include loss of important genetic information, unstable chromosomes, chromosomal translocations, tumorigenesis, or cell death, and it is therefore appreciated that the natural recombination mechanisms that underlie the generation of antibody diversity must be tightly regulated. Such antibody variable region (antigen receptor) gene rearrangement is regulated essentially at four different levels: expression of the RAG1/2 recombinase enzymes that mediate recombination, intrinsic biochemical properties of these recombinases and of the chromosomal cleavage reaction, the post-cleavage/DNA repair stage of the process, and the accessibility of the substrate to the recombinases.

In vitro assays studying the V(D)J recombination reaction were developed using transient substrates as well as integrated substrates in the late 1980s. Using these substrates, the genes for RAG-1 and RAG-2 were identified in 1989 (reviewed in Schatz, 2004 *Immunol Rev* 200:5-11). Since that time a large amount of literature has accumulated on these proteins and the biochemistry of the recombination reaction that gives rise to antibody structural diversity in vivo.

V(D)J Biochemistry

V(D)J recombination occurs at two steps. First, two lymphoid-specific recombinase proteins that are expressed in cells which are capable of immunoglobulin gene rearrangement (e.g., pre-B lymphocytes), RAG-1 and RAG-2, recognize signal sequences and form a synaptic complex with the assistance of HMG1, one of the non-histone chromatin proteins. Then, the RAG proteins cut DNA at the border between the signal sequence and the immunoglobulin polypeptide-coding sequence. At this cleavage step, DNA is nicked first by RAG proteins at the top strand, and then the 3'-hydroxyl group attacks the phosphodiester bond of the bottom strand by a direct nucleophilic reaction, resulting in formation of a hairpin intermediate at the coding end.

The recombination signal sequence (RSS) consists of two conserved sequences (heptamer, 5'-CACAGTG-3', and nonamer, 5'-ACAAAAACC-3'), separated by a spacer of either 12+/−1 bp ("12-signal") or 23+/−1 bp ("23-signal"). To begin this lymphoid-specific process, two signals (one 12-signal and one 23-signal) are selected and rearranged under the "12/23 rule"; recombination does not occur between two RSS signals with the same size spacer. In spite of the specificity of the recombinase most of the nucleotide positions within the recombination signals are variable, especially those in the 23 signal. The consensus sequences being accepted as CACAGTG for the heptamer and ACAAAAACC for the nonamer. A number of nucleotide positions have been identified as important for recombination including the CA dinucleotide at position one and two of the heptamer, and a C at heptamer position three has also been shown to be strongly preferred as well as an A nucleotide at positions 5, 6, 7 of the nonamer. (Ramsden et. al 1994; Akamatsu et. al. 1994; Hesse et. al. 1989). Mutations of other nucleotides have minimal or inconsistent effects. The spacer, although more variable, also has an impact on recombination, and single-nucleotide replacements have been shown to significantly impact recombination efficiency (Fanning et. al. 1996, Larijani et. al 1999; Nadel et. al. 1998). Because of the large amount of sequence variability found at functional RSSs it is difficult to comprehensively evaluate the influence of specific sequences on recombination potential. Recently the Schatz laboratory developed genetic and functional screens to evaluate several thousand 12 spacer RSSs in the context of a consensus heptamer and non-consensus nonamer. They were able to demonstrate that non-consensus spacer nucleotides often impaired recombination (Lee et. al. 2003). It is believed that the spacer might influence recombination at a post-cleavage stage, perhaps during formation of the synaptic complex or coding joint resolution. Differences in the spacer can account for over a 30-fold range in recombination efficiency (Cowell et. al 2004). Studies have shown that the nonamer may be the primary determinant of RSS binding by the recombinase while the heptamer sequence guides cleavage.

The final recombination potential of any single RSS is the combination of all its sequences, which has made predictions difficult. Cowell et al. have generated an algorithm and have identified the optimal sequences for high efficiency recombination. Other in vitro studies have defined the minimal distance required between signal sequences as well as the influence of flanking coding sequences on recombination efficiency. Although it is difficult to predict the efficiency of a RSS by its sequence alone, an algorithm of good predictive potential has been generated and there are empirical data on specific RSSs on the basis of which a skilled person can select RSS polynucleotide sequences that would have significantly different recombination efficiencies (Ramsden et. al 1994; Akamatsu et. al. 1994; Hesse et. al. 1989 and Cowell et. al. 1994).

Following the (RSS) signal-directed DNA cleavage the broken DNA ends are repaired by double-strand break repair proteins. The coding ends are often processed before being repaired, which is an additional step that generates more potential for structural diversity from the reaction. Such processing involves deletion of nucleotides at the coding joint of antigen receptor genes, which is commonly observed at the $V_H$ 3' junction, at both sides (5' and 3') of the D segment, and at the 5' junction of the J segment, followed in some cases by addition of other nucleotides at these processing sites. Terminal deoxynucleotide transferase (TdT) has been identified as a polymerase that plays a role in such nucleotide addition during V(D)J recombination, thus contributing further diversity to the antibody repertoire (Landau et al., *Mol. Cell Biol.* 1987 7:3237). The diversity of the antibody repertoire is therefore the combined result of (i) different gene segment utilization through the recombination events, (ii) optional deletion and/or addition of one or more nucleotides at each of the junctions (e.g., mediation of junctional diversity, such as by TdT), and (iii) differential pairings of the various heavy and light chain combinations that may result from (i) and (ii) in different cells. In vivo the process is highly regulated and once a set of gene segments for a specific antigen receptor is successfully rearranged to generate a functional molecule the gene rearrangement process for additional antigen receptors is prohibited within a given lymphocyte; once successful heavy chain rearrangement is achieved no additional rearrangements take place at that locus. (Inlay et. al. 2006; Alt et. al. 1984)

The human genome has approximately 51 functional immunoglobulin $V_H$ (heavy chain variable), 25 functional D (diversity segments) and 6 $J_H$ (heavy chain joining region) gene segments that can be rearranged into a wide variety of V-D-J combinations and which, when combined with the other mechanisms described above, yield greater than $10^{12}$ unique products.

More specifically, the human immunoglobulin heavy chain repertoire contained on chromosome 14q32.3 has been sequenced and characterized (NCBI locus NG_001019 [SEQ ID NO:110]; vbase, 1997 MRC Centre for Protein Engineering; vbase.mrc-cpe.cam.ac.uk; Kabat E A, Wu T T, Perry H M, Gottesman K S, Foeller C, *Sequences of Proteins of Immunological Interest*, Edition: 5, illustrated, 1992 DIANE Publishing, 1992, Darby, Pa., (ISBN 094137565X, 9780941375658, 2719 pages); Tomlinson et al., 1992 *J Mol Biol* 227:776; Milner et al., 1995 *Ann NY Acad Sci* 764:50). It contains 51 functional VH gene segments and 9 non-rearranged open reading frames. The 51 functional gene segments are represented by 7 families. The VH1 family has 11 related members, VH2 has 3 related members, VH3 has 22 related members, VH4 has 11 related members, VH5 has 2 related members, VH6 and VH7 each are represented by a single family member. The human Ig locus also contains 25 functional D gene segments and 2 non-rearranged open reading frames. The D gene segments are represented by 7 families; D1 has 4 family members, D2 has 4 related family members, D3 has 5 related family members, D4 has 4 related family members, D5 has 4 related family members, D6 has 3 related family members and D7 has a single family member. The human Ig locus also contains 6 J gene segments each representing a unique family member JH1 thru JH6.

The human antibody light chains, kappa and lambda, are found on different chromosomes; 2p11-12 and 22q11.2 respectively. The entire locus for both kappa and lambda has been sequenced; human kappa (NG000833 [SEQ ID NO:111], distal duplicated, and NG000834 [SEQ ID NO:112], IgK proximal) and lambda (NG000002 [SEQ ID NO:113]; NCBI GeneID 3535; IgL@). The human kappa locus contains 40 functional Vkappa gene segments represented by 7 families; VKI has 19 family members, VKII has 9 family members, VKIII has 7 family members, VKIV and VKV are represented by single family members and VKVI has 3 family members. The VKVII family has only one family member and it is non-functional. The kappa locus contains 5 Jkappa gene segments all representing a distinct family JK1 thru JK5. The human lambda locus has a total of 31 functional gene segments represented by 10 families; VL1 has 5 family members, VL2 has 5 family members, VL3 has 9 family members, VL4 and VL5 each of 3 family members, VL7 has 2 family members and VL6, VL8, VL9, VL10 are each represented by a single family member. The lambda locus has seven J gene segment families all represented by a single family member but only 4 are functional and found in human antibody repertoires; these include JL1, JL2, JL3 and JL7. (See, e.g., Kabat et al., *Sequences of Proteins of Immunological Interest*, Edition: 5, 1992 DIANE Publishing, 1992, Darby, Pa., ISBN 094137565X, 9780941375658, 2719 pages.)

RAG-induced double-strand breaks (DSBs) also involve the general nonhomologous end-joining DNA repair pathway or NHEJ. The NHEJ pathway is present in all eukaryotic cells ranging from yeast to humans. The NHEJ pathway is needed to repair these physiologic breaks, as well as challenging pathologic breaks that arise from ionizing radiation and oxidative damage to DNA. Many DNA double strand repair proteins have been demonstrated as directly participating in V(D)J recombination. DNA-dependent protein kinase (DNA-PK) can phosphorylate other repair proteins as well as its own subunits of Ku 70 and Ku 86 (Schatz, 2004 *Immunol Rev* 200:5-11). Recently, another component of the V(D)J recombination mechanism, termed Artemis protein, has been shown to have a role as a nuclease involved in opening hairpin intermediates produced from the V(D)J cleavage. Artemis has dual specific nuclease activities (endonuclease or exonuclease activity). DNA-PK-dependent phosphorylation of Artemis appears to resolve the hairpin intermediates by changing its specificity from that of an exonuclease to an endonuclease. XRCC4 and DNA ligase IV are major double strand break repair proteins also implicated in V(D)J recombination. (Schatz, 2004 *Immunol Rev* 200:5-11; Dai et. al. (2003) *Proc Natl Acad Sci USA* 100:2462-7; Frank et al. (1998) *Nature* 396:173-7; Gellert (2002) *Annu Rev Biochem* 71:101-32; Grawunder et al. (1998) *J Biol Chem* 273:24708-14; Jones et al. J (2001) *Proc Natl Acad Sci USA* 98:12926-31; Modesti et al. (1999) *Embo J* 18:2008-18; Moshous et al. (2000) *Hum Mol Genet.* 9:583-8; Verkaik et al. 2002 *Eur J Immunol* 32:701-9)

RAG-1 has been shown to be evolutionarily highly conserved and homology has been reported in chickens, *Xenopus laevis*, rainbow trout, zebrafish and shark. It has been hypothesized that RAG-1 and RAG-2 may be members of the retroviral integrase superfamily and have been shown to be capable of transposition in vitro. A significant amount of detail is now understood about the RAG-1 and RAG-2 mediated recombination. The two proteins' role is to catalyze the first DNA cleavage steps in V(D)J recombination. RAG-1 has been shown to have inherent single-stranded (ss) DNA cleavage activity, which does not require, but is enhanced by, RAG-2. It has also been demonstrated that the V(D)J recombinase protein RAG-1 undergoes ubiquitinylation in cells. In vitro, the RING finger domain of RAG-1 acts as a ubiquitin ligase that mediates its own ubiquitinylation at a highly conserved K residue in the RAG-1 amino-terminal region. In fact, the N-terminal portion of RAG-1 has been shown to have a distinct enzymatic role separate from the rest of the protein, acting as an E3 ligase.

RAG2 has been shown to directly bind to the core histone proteins. The reaction has also been shown to be cell cycle regulated (Lee et al., 1999 *Immunity* 11:771). Studies on RAG-1 and RAG-2 have also been conducted in vitro with purified proteins. Mutational analyses of RAG-1 or RAG-2 have been performed to identify crucial amino acid residues or regions that might be involved in catalysis or interaction with other proteins during the V(D)J recombination process. The RAG-1 domains or amino acid (aa) residues responsible for the interaction with RAG-2 were not clearly defined although few putative regions for the RAG-2 interaction have been suggested. The core domains of RAG-1 (aa 384-1004) and RAG-2 (aa 1-383) have been previously identified, and these minimal regions of RAG proteins were fully catalytically active in vitro or in vivo. Mutagenesis performed by one group describes a particular mutation in RAG-1 that affects recombination by altering the specificity of target sequence usage. Recombination mediated by wild-type RAG-1 is tolerant of a wide range of coding sequences adjacent to the recombination signal, while the mutant RAG-1 was shown to more limited in the range of RSS that it could use.

Monoclonal antibodies have recently been validated as therapeutic agents. Initial use of mouse monoclonal antibodies in humans resulted in a mouse anti-human antibody (MAHA) response that destroyed the potential therapeutic antibody. The first approach to minimize the anti-mouse response was to generate a chimeric molecule with the mouse variable regions and human constant regions. These molecules still contained significant mouse sequences and a human anti-chimeric antibody (HACA) response was observed. Further attempts have been developed to further reduce the content of mouse sequences and a number of humanization approaches including framework and CDR grafting as examples have been developed.

Another approach was to generate fully human antibodies. Two distinct strategies were developed. The first involves the isolation of "naive" antibody sequences directly from humans. Large libraries have been generated using phage display to capture the human repertoire. These "naive" sequences are generally derived from human IgM cDNA libraries from human B-cells. These libraries are fully human but are in fact not completely "naive" since they have been subjected to in vivo positive and negative selection associated with immune tolerance; they are generally "naive" only to the antigen of interest in that these human IgM antibodies are likely to bind unknown antigens that were present in the human source of the B-cells.

The second strategy was to generate transgenic animals that contain the human Ig cis sequences. The use of transgenic mice results in a human antibody repertoire that is also generated in vivo, albeit in a mouse. Different transgenes have been generated and different methods have been used to introduce those transgenes into the genome of a mouse including: pronuclear injection, YAC integration into embryonic stem (ES) cells, microcell fusion of ES cells or targeted integration of human antibody sequences to the mouse Ig locus of ES cells. Additional groups are exploiting the somatic hypermutation or mutagenesis processes as means to generate fully human antibodies.

These approaches each have specific limitations. While a number of "humanized" antibodies are approved therapeutics, these proteins still contain mouse sequences and are not entirely human. In addition, the "humanization" process can be lengthy and often compromises the binding characteristics of the original antibody. Because of the resources and uncertainties involved with the process, "humanization" is often done only on the lead antibodies and by specialized groups with the expertise. An additional disadvantage of the humanization process is that it starts with a mouse antibody and the mouse CDR3. The mouse has fewer D gene segments than humans. The mouse D gene segments also appear to share significant homology and be therefore may not code for as many different amino acids (Schelonka et Al. (2005) *J Immunol* 175:6624-32). The mouse CDR3 has also been shown to contain fewer "N" nucleotide additions and as a result is shorter in length on average compared to the human CDR. As a result the mouse antibody repertoire is significantly less diverse than the human repertoire, and consequently rare antibodies are more difficult to find.

The use of transgenic animals has been attempted in efforts to address a number of these issues, and provides immunoglobulin variable segment sequences that are completely human. Although the repertoire from these animals is theoretically larger than a normal mouse, among the limitations of the transgenic approach is the fact that the human antibody repertoire is actually greater than the B-cell compartment of a mouse. Hence, although these transgenic systems have the potential for a larger antibody repertoire they are in fact limited by the number of B-cells in a mouse. In addition, generating antibodies to highly homologous proteins (human and mouse) is challenging in both normal and transgenic systems as B-cells are deleted as part of immune tolerance.

Another potential disadvantage of currently available transgenic systems is that antibodies generated from these transgenic animals have been subjected to in vivo selection processes involved in tolerance, such that antibodies that specifically recognize human and mouse proteins or protein domains that have high degrees of homology will often be deleted from the repertoire. Antibodies generated in transgenic animals also include mutations different from the germlne sequence as a result of hypermutation processes. Although these mutations are part of the affinity maturation process, many of them do not contribute to antigen binding, and for therapeutics it is therefore desirable to have these sequences removed in a process called "germlining". In addition, these proprietary transgenic technologies are expensive and are not widely available.

In view of these intrinsic limitations in the existing antibody methodologies, and given the limited access to the current technologies, there is clearly a need for additional strategies for the generation of fully human antibodies, including for therapeutic applications. The presently disclosed invention embodiments address this need and offer other related advantages.

BRIEF SUMMARY

According to certain embodiments of the present invention, there is provided a nucleic acid composition for generating immunoglobulin structural diversity, comprising (a) a first isolated nucleic acid that comprises one or a plurality of mammalian immunoglobulin heavy chain variable ($V_H$) region genes, each having (i) an immunoglobulin $V_H$ region encoding polynucleotide sequence, and (ii) a $V_H$ region recombination signal sequence (RSS) that is located 3' to the immunoglobulin $V_H$ region encoding polynucleotide sequence; (b) a second isolated nucleic acid that comprises one or a plurality of mammalian immunoglobulin heavy chain diversity (D) segment genes, each of said immunoglobulin D segment genes having (i) a D segment encoding polynucleotide sequence, (ii) a D segment upstream recombination signal sequence that is located 5' to each of said D segment encoding polynucleotide sequences and that is capable of functional recombination with the $V_H$ region recombination signal sequence, and (iii) a D segment downstream recombination signal sequence that is located 3' to each of said D segment encoding polynucleotide sequences; (c) a third isolated nucleic acid that comprises one or a plurality of mammalian immunoglobulin heavy chain joining ($J_H$) segment genes, each of said immunoglobulin $J_H$ segment genes having (i) a $J_H$ segment encoding polynucleotide sequence in operable linkage to an immunoglobulin heavy chain constant ($C_H$) region gene, and (ii) a $J_H$ segment recombination signal sequence that is located 5' to the $J_H$ segment encoding polynucleotide sequence and that is capable of functional recombination with the D segment downstream recombination signal sequence of (b); and (d) a fourth isolated nucleic acid that comprises a polynucleotide sequence encoding a membrane anchor domain polypeptide, wherein the nucleic acid composition can undergo at least two or more recombination events in a cell to form a recombined polynucleotide that encodes an immunoglobulin heavy chain polypeptide having a membrane anchor domain.

According to certain embodiments there is provided a nucleic acid composition for generating immunoglobulin structural diversity, comprising: (a) a first isolated nucleic acid that comprises one or a plurality of mammalian immunoglobulin heavy chain variable ($V_H$) region genes, each having (i) an immunoglobulin $V_H$ region encoding polynucleotide sequence, and (ii) a $V_H$ region recombination signal sequence (RSS) that is located 3' to the immunoglobulin $V_H$ region encoding polynucleotide sequence; (b) a second isolated nucleic acid that comprises one or a plurality of mammalian immunoglobulin heavy chain diversity (D) segment genes, each of said immunoglobulin D segment genes having (i) a D segment encoding polynucleotide sequence, (ii) a D segment upstream recombination signal sequence that is located 5' to each of said D segment encoding polynucleotide sequences and that is capable of functional recombination with the $V_H$ region recombination signal sequence, and (iii) a D segment downstream recombination signal sequence that is located 3' to each of said D segment encoding polynucleotide sequences; and (c) a third isolated nucleic acid that comprises one or a plurality of mammalian immunoglobulin heavy chain joining ($J_H$) segment genes, each of said immunoglobulin $J_H$ segment genes having (i) a $J_H$ segment encoding polynucleotide sequence in operable linkage to an immunoglobulin heavy chain constant ($C_H$) region gene, and (ii) a $J_H$ segment recombination signal sequence that is located 5' to the $J_H$ segment encoding polynucleotide sequence and that is capable of functional recombination with the D segment downstream recombination signal sequence of (b); wherein the nucleic acid composition can undergo at least two or more recombination events in a cell to form a recombined polynucleotide that encodes an immunoglobulin heavy chain polypeptide.

In certain further embodiments the nucleic acid composition is selected from (a) the nucleic acid composition in which (i) the mammalian immunoglobulin $V_H$ region genes and the mammalian immunoglobulin heavy chain D segment genes are present at a ratio of about 1:1 to 1:2, and (ii) the mammalian immunoglobulin $J_H$ segment genes and the mammalian immunoglobulin heavy chain D segment genes are present at a ratio of about 1:1 to 1:2; (b) the nucleic acid composition in which the mammalian immunoglobulin $V_H$ region genes and the mammalian immunoglobulin $J_H$ segment genes are present at a ratio of less than or equal to approximately 1:2 (V to J) to 2:1 (V to J); (C) the nucleic acid composition in which (i) the one or a plurality of mammalian immunoglobulin $V_H$ region genes, together with (ii) the one or a plurality of mammalian immunoglobulin $J_H$ segment genes, are not greater in number than the mammalian immunoglobulin heavy chain D segment genes; and (d) the nucleic acid composition in which there are 6, 7, 8, 9, 10, 11 or 12 mammalian immunoglobulin heavy chain D segment genes.

In certain other further embodiments (a) the first isolated nucleic acid comprises 12-50 contiguous $V_H$ region genes of which about 10% to about 30% of said $V_H$ region genes that are contiguous with a 5'-most located VH region gene each comprise a $V_H$ region RSS of low or medium RSS efficiency, and about 70% to about 90% of said $V_H$ region genes that are contiguous with a 3'-most located $V_H$ region gene each comprise a $V_H$ region RSS of high RSS efficiency; and (b) the second isolated nucleic acid comprises a plurality of contiguous D segment genes of which about 80% to about 90% of said D segment genes that are contiguous with a 5'-most located D segment gene each comprises a D segment upstream RSS of high RSS efficiency and a D segment downstream RSS of high RSS efficiency, and about 10% to about 20% of said D segment genes that are contiguous with a 3'-most located D segment gene each comprises a D segment upstream RSS of low or medium RSS efficiency and a D segment downstream RSS of low or medium RSS efficiency, wherein (i) the plurality of $V_H$ region genes, together with (ii) the one or a plurality of $J_H$ segment genes, are not greater in number than said plurality of D segment genes.

In certain other embodiments the nucleic acid composition is characterized by one or more of: (a) the first isolated nucleic acid comprises 12-50 contiguous $V_H$ region genes of which about 10% to about 30% of said $V_H$ region genes that are contiguous with a 5'-most located VH region gene each comprise a $V_H$ region RSS of low or medium RSS efficiency; (b) the first isolated nucleic acid comprises 12-50 contiguous $V_H$ region genes of which about 70% to about 90% of said $V_H$ region genes that are contiguous with a 3'-most located $V_H$ region gene each comprise a $V_H$ region RSS of high RSS efficiency; (c) the second isolated nucleic acid comprises a plurality of contiguous D segment genes of which about 80% to about 90% of said D segment genes that are contiguous with a 5'-most located D segment gene each comprise a D segment upstream RSS of high RSS efficiency and a D segment downstream RSS of high RSS efficiency; and (d) the second isolated nucleic acid comprises a plurality of contiguous D segment genes of which about 10% to about 20% of said D segment genes that are contiguous with a 3'-most located D segment gene each comprise a D segment upstream RSS of low or medium RSS efficiency and a D segment downstream RSS of low or medium RSS efficiency.

In certain embodiments the nucleic acid composition comprises 1, 2, 3, 4, 5, 6, 7 or 8 vectors. In another embodiment the membrane anchor domain polypeptide comprises a polypeptide that is selected from a transmembrane domain polypeptide, a glycosyl-phosphatidylinositol-linkage polypeptide, a lipid raft-associating polypeptide and a specific protein-protein association domain polypeptide. In certain embodiments the first, second, third and fourth isolated nucleic acids are joined in operable linkage as a single nucleic acid molecule, and in certain embodiments the first, second and third isolated nucleic acids are joined in operable linkage as a single nucleic acid molecule. In certain other embodiments the first, second, third and fourth isolated nucleic acids are each capable of integration into a mammalian host cell chromosome in operable linkage following said two or more recombination events, to form the polynucleotide that encodes the immunoglobulin heavy chain polypeptide having a membrane anchor domain, and in certain embodiments the first, second and third isolated nucleic acids are each capable of integration into a mammalian host cell chromosome in operable linkage following said two or more recombination events, to form the polynucleotide that encodes the immunoglobulin heavy chain polypeptide. In certain embodiments the nucleic acid composition comprises a vector which comprises the first, second, third and fourth isolated nucleic acids joined in operable linkage, and in certain embodiments the nucleic acid composition comprises a vector which comprises the first, second and third isolated nucleic acids joined in operable linkage. In certain embodiments the nucleic acid composition comprises two, three or four vectors each of which comprises at least one of said first, second, third and fourth isolated nucleic acids, wherein each of said vectors is capable of integration into a mammalian host cell chromosome in operable linkage to form the polynucleotide that encodes the immunoglobulin heavy chain polypeptide, or the immunoglobulin heavy chain polypeptide having a membrane anchor domain. In certain further embodiments the vector is selected from a virus, a plasmid, a cosmid, a transposon and an artificial chromosome.

In certain embodiments the mammalian immunoglobulin $V_H$ gene is selected from a human $V_H$ gene, a mouse $V_H$ gene, a rat $V_H$ gene, a rabbit $V_H$ gene, a canine $V_H$ gene, a feline $V_H$ gene, an equine $V_H$ gene, a bovine $V_H$ gene, a monkey $V_H$ gene, a baboon $V_H$ gene, a macaque $V_H$ gene, a chimpanzee $V_H$ gene, a gorilla $V_H$ gene, an orangutan $V_H$ gene, a camel $V_H$ gene, a llama $V_H$ gene, an alpaca $V_H$ gene and an ovine $V_H$ gene.

In certain embodiments the nucleic acid composition is under control of at least one operably linked recombination control element, which in certain further embodiments is an inducible recombination control element, which in certain still further embodiments is tightly regulated.

In certain embodiments there is provided a host cell comprising a mammalian cell that is capable of immunoglobulin gene rearrangement and that comprises a nucleic acid composition as described above. In certain embodiments the mammalian cell is selected from the a human cell, a non-human primate cell, a camelid cell, a hamster cell, a mouse cell, a rat cell, a rabbit cell, a canine cell, a feline cell, an equine cell, a bovine cell and an ovine cell. In certain embodiments the host cell is capable of expressing a mammalian RAG-1 gene, a mammalian RAG-2 gene and a mammalian TdT gene, or biologically active fragments or derivatives of said genes that are capable of mediating immunoglobulin gene rearrangement and junctional diversity. In certain further embodiments, expression of one or more of the mammalian RAG-1 gene, mammalian RAG-2 gene and mammalian TdT gene, or biologically active fragments or derivatives of said genes, is inducible expression.

In another embodiment there is provided a nucleic acid composition for generating immunoglobulin structural diversity, comprising: (a) a first isolated nucleic acid that comprises one or a plurality of mammalian immunoglobulin light chain variable ($V_L$) region genes, each having (i) an immunoglobulin $V_L$ region encoding polynucleotide sequence, and (ii) a $V_L$ region recombination signal sequence that is located 3' to the immunoglobulin $V_L$ region encoding polynucleotide sequence; (b) a second isolated nucleic acid that comprises one or a plurality of mammalian immunoglobulin heavy chain diversity (D) segment genes, each of said immunoglobulin D segment genes having (i) a D segment encoding polynucleotide sequence, (ii) a D segment upstream recombination signal sequence that is located 5' to each of said D segment encoding polynucleotide sequences and that is capable of functional recombination with the $V_L$ region recombination signal sequence, and (iii) a D segment downstream recombination signal sequence that is located 3' to each of said D segment encoding polynucleotide sequences; and (c) a third isolated nucleic acid that comprises one or a plurality of mammalian immunoglobulin light chain joining ($J_L$) segment genes, each of said immunoglobulin $J_L$ segment genes having (i) a $J_L$ segment encoding polynucleotide sequence in operable linkage to an immunoglobulin light chain constant ($C_L$) region gene, and (ii) a $J_L$ segment recombination signal sequence that is located 5' to the $J_L$ segment encoding polynucleotide sequence and that is capable of functional recombination with the D segment downstream recombination signal sequence of (b); wherein the nucleic acid composition can undergo at least two or more recombination events in a cell to form a recombined polynucleotide that encodes a polypeptide having an immunoglobulin $V_L$ region, an immunoglobulin $J_L$ segment, and an immunoglobulin $C_L$ region.

In another embodiment there is provided a nucleic acid composition for generating immunoglobulin structural diversity, comprising: (a) a first isolated nucleic acid that comprises one or a plurality of mammalian immunoglobulin light chain variable ($V_L$) region genes, each having (i) an immunoglobulin $V_L$ region encoding polynucleotide sequence, and (ii) a $V_L$ region recombination signal sequence that is located 3' to the immunoglobulin $V_L$ region encoding polynucleotide sequence; (b) a second isolated nucleic acid that comprises one or a plurality of mammalian immunoglobulin heavy chain diversity (D) segment genes, each of said immunoglobulin D segment genes having (i) a D segment encoding polynucleotide sequence, (ii) a D segment upstream recombination signal sequence that is located 5' to each of said D segment encoding polynucleotide sequences and that is capable of functional recombination with the $V_L$ region recombination signal sequence, and (iii) a D segment downstream recombination signal sequence that is located 3' to each of said D segment encoding polynucleotide sequences; (c) a third isolated nucleic acid that comprises one or a plurality of mammalian immunoglobulin light chain joining ($J_L$) segment genes, each of said immunoglobulin $J_L$ segment genes having (i) a $J_L$ segment encoding polynucleotide sequence in operable linkage to either a specific protein-protein association domain encoding polynucleotide or a membrane anchor domain encoding polynucleotide, and (ii) a $J_L$ segment recombination signal sequence that is located 5' to the $J_L$ segment encoding polynucleotide sequence and that is capable of functional recombination with the D segment downstream recombination signal sequence of (b), wherein the nucleic acid composition can undergo at least two or more recombination events in a cell to form a recombined polynucleotide that encodes a polypeptide having (i) an immunoglobulin $V_L$ region, (ii) an immunoglobulin $J_L$ segment and (iii) either a specific protein-protein association domain or a membrane anchor domain. In certain further embodiments the protein-protein association domain is selected from a mammalian immunoglobulin light chain ($C_L$) constant region, an RGD-containing polypeptide that is capable of integrin binding, a lipid raft-associating polypeptide domain, and a heterodimer-promoting polypeptide domain. In certain further embodiments the mammalian immunoglobulin light chain ($C_L$) constant region is selected from a kappa constant region and a lambda constant region. In certain other further embodiments at least one mammalian immunoglobulin heavy chain diversity (D) segment gene comprises one or a plurality of artificial D gene segments. In certain other further embodiments the recombined polynucleotide encodes a polypeptide having an immunoglobulin heavy chain D segment, which in certain further embodiments comprises an artificial D segment. In certain other related embodiments the first, second, and third isolated nucleic acids are joined in operable linkage as a single nucleic acid molecule. In certain other related embodiments the first, second, and third isolated nucleic acids are each capable of integration into a mammalian host cell chromosome in operable linkage following said two or more recombination events. In certain other embodiments the nucleic acid composition comprises a vector which comprises the first, second, and third isolated nucleic acids joined in operable linkage. In certain other embodiments the nucleic acid composition comprises two, three or four vectors each of which comprises at least one of said first, second and third isolated nucleic acids, wherein each of said vectors is capable of integration into a mammalian host cell chromosome in operable linkage to form the polynucleotide that encodes the polypeptide having an immunoglobulin $V_L$ region, $J_L$ segment and $C_L$ region, or that encodes the polypeptide having (i) an immunoglobulin $V_L$ region, (ii) an immunoglobulin $J_L$ segment and (iii) either a specific protein-protein association domain or a membrane anchor domain. In certain further embodiments the vector is selected from a virus, a plasmid, a cosmid, a transposon and an artificial chromosome.

According to certain embodiments of the above described nucleic acid composition, the mammalian immunoglobulin $V_L$ gene is selected from a human $V_L$ gene, a mouse $V_L$ gene, a rat $V_L$ gene, a rabbit $V_L$ gene, a canine $V_L$ gene, a feline $V_L$ gene, an equine $V_L$ gene, a bovine $V_L$ gene, a monkey $V_L$ gene, a baboon $V_L$ gene, a macaque $V_L$ gene, a chimpanzee $V_L$ gene, a gorilla $V_L$ gene, an orangutan $V_L$ gene, and an ovine $V_L$ gene.

According to certain embodiments the above described nucleic acid composition is under control of at least one operably linked recombination control element, which in certain further embodiments is an inducible recombination control element and which in certain still further embodiments is tightly regulated. According to certain embodiments the above described nucleic acid composition comprises a first nucleic acid that comprises at least one expression control sequence that is located 5' to the one or a plurality of immunoglobulin variable region genes. In certain further embodiments the expression control sequence is selected from a promoter, a regulated promoter, a repressor binding site and an activator binding site. In certain still further embodiments the regulated promoter is selected from a tightly regulated promoter and an inducible promoter.

In another embodiment there is provided a host cell comprising a mammalian cell that is capable of immunoglobulin gene rearrangement and that comprises any one or more of the above described nucleic acid compositions. In certain embodiments the mammalian cell is selected from a human cell, a non-human primate cell, a camelid cell, a hamster cell, a mouse cell, a rat cell, a rabbit cell, a canine cell, a feline cell, an equine cell, a bovine cell and an ovine cell. In certain embodiments the host cell is capable of expressing a mammalian RAG-1 gene, a mammalian RAG-2 gene and a mammalian TdT gene, or biologically active fragments or derivatives of said genes that are capable of mediating immunoglobulin gene rearrangement and junctional diversity. In certain embodiments expression of one or more of the mammalian RAG-1 gene, mammalian RAG-2 gene and mammalian TdT gene, or biologically active fragments or derivatives of said genes, is inducible expression.

In another embodiment of the present invention there is provided a method for generating structural diversity in one or a plurality of immunoglobulin heavy chain variable ($V_H$) region genes, comprising: (a) introducing a nucleic acid composition as described herein that comprises one or a plurality of immunoglobulin heavy chain variable ($V_H$) region genes into a host cell that comprises a mammalian cell that is capable of immunoglobulin gene rearrangement; and (b) maintaining the host cell under conditions and for a time sufficient for the nucleic acid composition to undergo two or more recombination events to form a recombined polynucleotide that encodes an immunoglobulin heavy chain polypeptide, and thereby generating structural diversity in one or a plurality of immunoglobulin $V_H$ region genes. In certain further embodiments (a) the step of introducing comprises introducing the nucleic acid composition described above that can undergo at least two or more recombination events in a cell to form a recombined polynucleotide that encodes an immunoglobulin heavy chain polypeptide having a membrane anchor domain, and (b) the step of maintaining results in formation of a recombined polynucleotide that encodes an immunoglobulin heavy chain polypeptide having a membrane anchor domain.

In another embodiment there is provided a method for generating structural diversity in one or a plurality of immunoglobulin light chain variable ($V_L$) region genes, comprising (a) introducing a nucleic acid composition as described herein that comprises one or a plurality of immunoglobulin light chain variable ($V_L$) region genes into a host cell that comprises a mammalian cell that is capable of immunoglobulin gene rearrangement; and (b) maintaining the host cell under conditions and for a time sufficient for the nucleic acid composition to undergo one, two or more recombination events to form a recombined polynucleotide that encodes a polypeptide which comprises an immunoglobulin light chain polypeptide, and thereby generating structural diversity in one or a plurality of immunoglobulin $V_L$ region genes. In certain related embodiments there is provided a method comprising at least one of the above described methods, wherein the step of introducing comprises introducing at least one nucleic acid composition as described above, under conditions and for a time sufficient for chromosomal integration of the nucleic acid composition, to obtain at least one chromosomally integrated nucleic acid composition. In certain related embodiments there is provided a method according to one or more of the methods described above wherein the step of introducing comprises introducing sequentially and in any order two or more of the above described nucleic acid compositions, under conditions and for a time sufficient for chromosomal integration of the nucleic acid compositions, to obtain at least two chromosomally integrated nucleic acid compositions. In certain further embodiments of those just described, less than one of said recombination events occurs per cell cycle of the host cell. In certain other further embodiments there is provided a method that comprises, subsequent to the step of introducing and prior to the step of maintaining, expanding the host cell to obtain a plurality of host cells that are capable of immunoglobulin gene rearrangement and that comprise the at least one chromosomally integrated nucleic acid composition.

In another embodiment there is provided a method for generating structural diversity in one or a plurality of immunoglobulin variable region genes, comprising: (a) introducing at least one nucleic acid composition as described above into a host cell that comprises a mammalian cell that is capable of immunoglobulin gene rearrangement, under conditions and for a time sufficient for chromosomal integration of the at least one nucleic acid composition, to obtain at least one chromosomally integrated nucleic acid composition; (b) expanding the host cell to obtain a plurality of host cells that are capable of immunoglobulin gene rearrangement and that comprise the at least one chromosomally integrated nucleic acid composition; and (c) maintaining the host cell under conditions and for a time sufficient for the nucleic acid composition to undergo two or more recombination events to form a recombined polynucleotide that encodes an immunoglobulin polypeptide, and thereby generating structural diversity in one or a plurality of immunoglobulin variable region genes. In certain embodiments related to the above described methods, the at least one chromosomally integrated nucleic acid composition is under control of at least one operably linked recombination control element, which in certain further embodiments is an inducible recombination control element, and which in certain still further embodiments is tightly regulated.

In another related embodiment there is provided a method as described above that further comprises, subsequent to the step of introducing and prior to the step of maintaining, expanding the host cell to obtain a plurality of host cells that are capable of immunoglobulin gene rearrangement and that comprise the at least one chromosomally integrated nucleic acid composition, wherein the at least one chromosomally integrated nucleic acid composition is under control of at least one operably linked recombination control element that is an inducible recombination control element, and wherein the step of maintaining comprises contacting the plurality of host cells with a recombination inducer.

In certain embodiments related to the above described methods, the host cell comprises a rearranged immunoglobulin $V_L$ gene. In certain embodiments related to the above described methods, the host cell comprises a rearranged immunoglobulin $V_H$ gene. In certain embodiments related to the above described methods, the host cell that is capable of immunoglobulin gene rearrangement is selected from the group consisting of: (a) a host cell that is capable of dividing without immunoglobulin gene rearrangement occurring; (b) a host cell that can be induced to express one or more recombination control elements selected from a RAG-1 gene and a RAG-2 gene; and (c) a host cell that expresses first and second recombination control elements that comprise, respectively, a RAG-1 gene and a RAG-2 gene, wherein expression of at least one of said recombination control elements can be substantially impaired.

These and other aspects of the invention will be evident upon reference to the following detailed description and attached drawings. All of the U.S. patents, U.S. patent application publications, U.S. patent applications, foreign patents, foreign patent applications and non-patent publications referred to in this specification and/or listed in the Application Data Sheet, are incorporated herein by reference in their entirety, as if each was incorporated individually. Aspects of the invention can be modified, if necessary, to employ concepts of the various patents, applications and publications to provide yet further embodiments of the invention.

DETAILED DESCRIPTION

Certain embodiments of the invention disclosed herein are based on the surprising discovery that an in vitro system for generating antibody diversity can be constructed using appropriately selected nucleic acid molecules that comprise immunoglobulin V, D, J and C region encoding polynucleotide sequences and recombination signal sequences (RSS). As described herein, by the assembly of such appropriately selected components and their introduction into suitable recombination-competent host cells, previously insurmountable challenges associated with the temporal regulation of V(D)J recombination can be overcome. Despite the identification over 18 years ago of the cis elements and trans factors involved in immunoglobulin gene rearrangement, as described above, an in vitro system for generating large antibody repertoires de novo has not been described prior to the present disclosure.

In particular, according to the present application it is disclosed for the first time that in an in vitro antibody gene recombination system, it is not required that an immunoglobulin D-J gene recombination event precedes a V-to-DJ recombination event in order to generate immunoglobulin sequence diversity.

In addition, the present invention provides, in certain embodiments, compositions and methods that overcome the presumed inefficiencies that would otherwise accompany generation of a productive in-frame V(D)J product using an in vitro system that lacks the regulatory mechanisms that are present in a developing lymphocyte. In the absence of these regulatory systems that exist in vivo there would be extreme biases in segment utilization.

In this regard and without wishing to be bound by theory, the presently disclosed embodiments successfully overcome problems associated with inefficiency in the generation by recombination of productive V-D-J junctions, and biases in the relative utilization of particular V, D and/or J gene segments, when cellular regulatory mechanisms, which govern the temporal steps of first mediating a D-J recombination event prior to a V-(D-J) recombination event, are not present. Such inefficiencies and biases arise due to the need for multiple recombination events having unequal probabilities to take place during immunoglobulin gene rearrangement (and during which intervening sequences that include unused coding regions are deleted) in order for certain V, D and J segments to be utilized, given the disparity in the number of V, D and J genes.

Figure 1A:
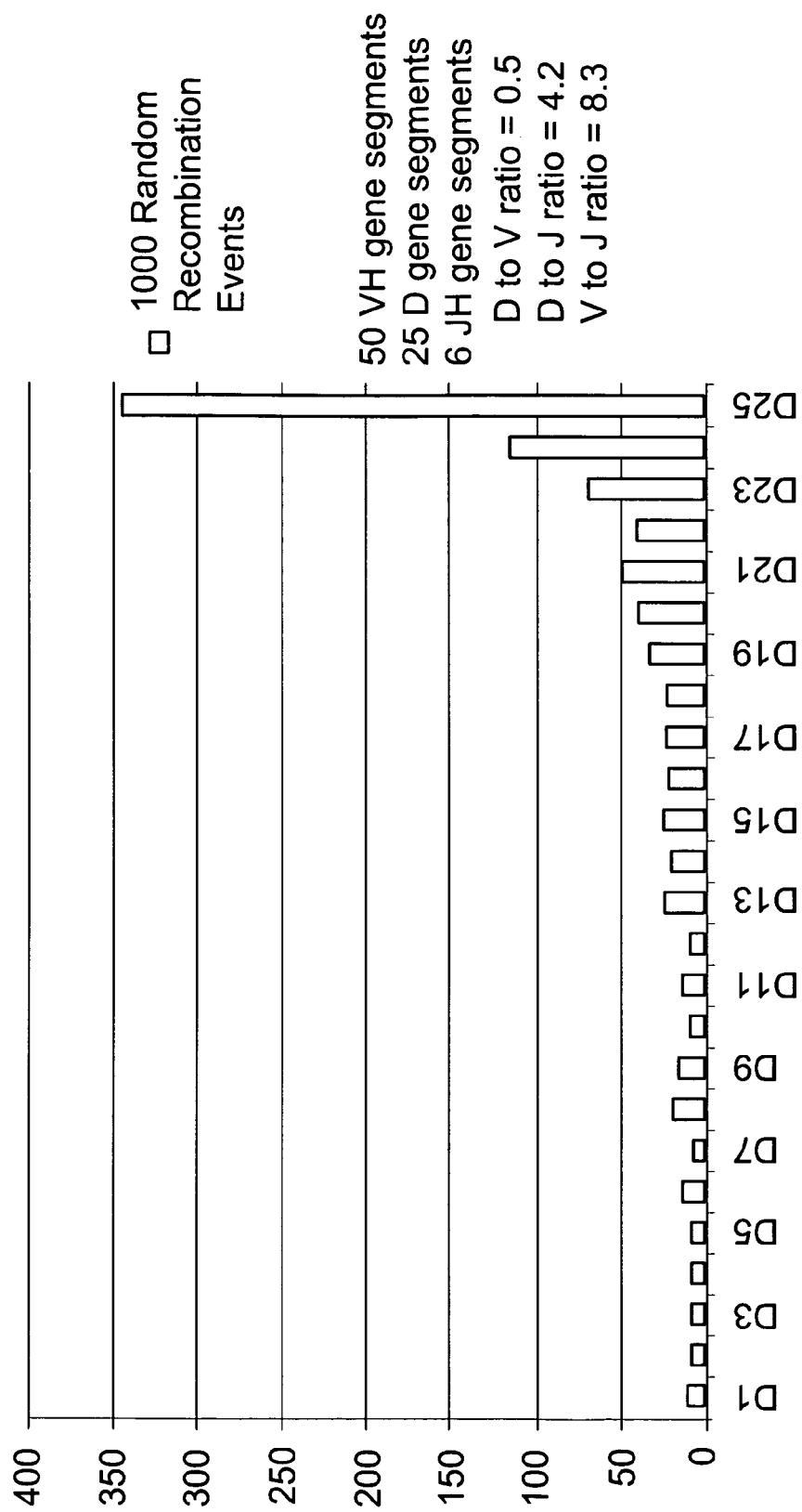
FIG. 1 shows theoretical Ig $V_H$ locus D segment utilization by (FIG. 1A) locus having 50 functional $V_H$, 25 functional D and 6 functional $J_H$ gene segments.
(FIG. 1B) theoretical Ig $V_H$ locus having 21 functional $V_H$, 18 functional D and 6 functional $J_H$ gene segments.
Figure 1B:
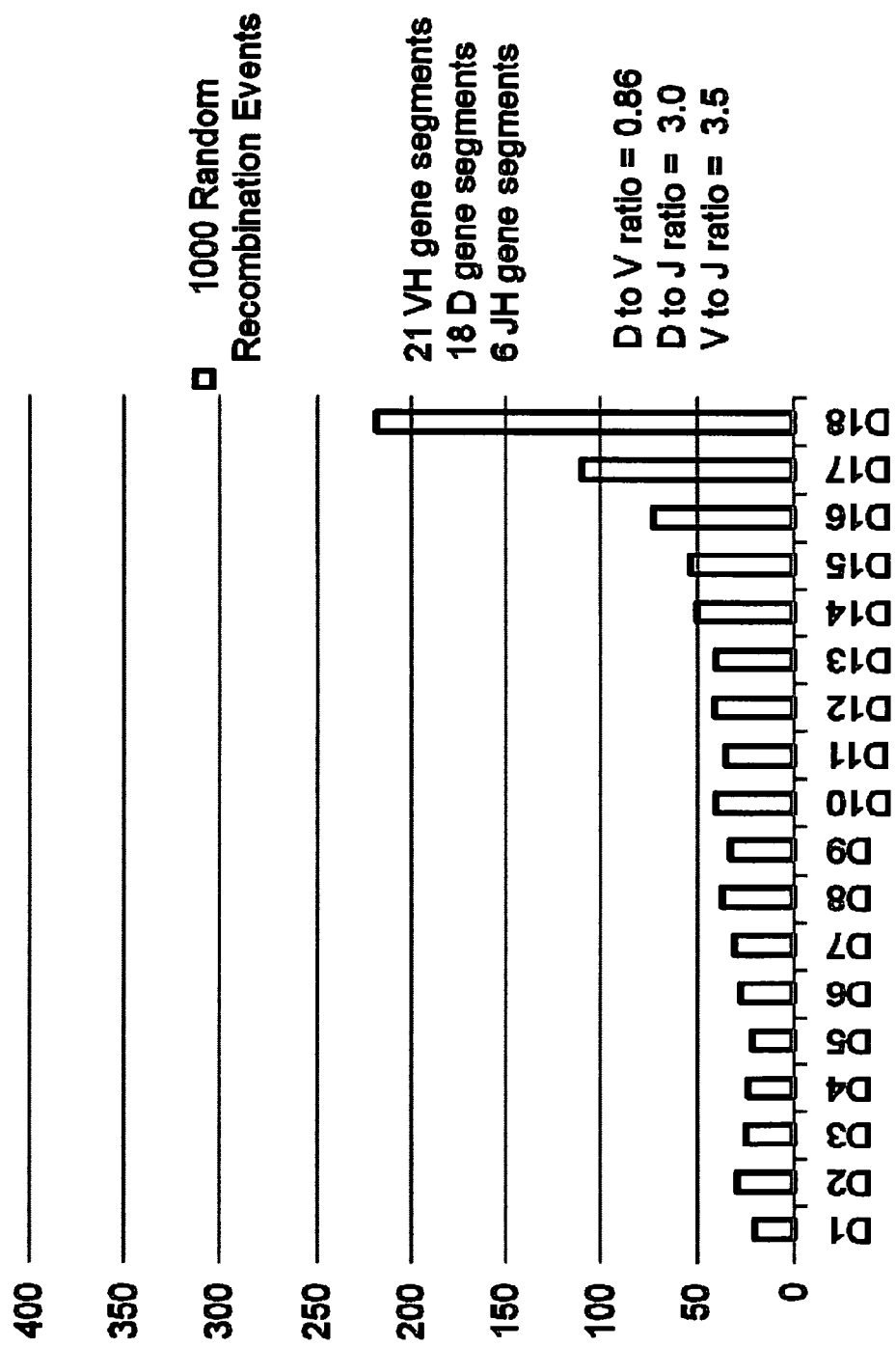

For example, the human Ig $V_H$ locus comprises 51 functional $V_H$, 25 functional D and 6 functional $J_H$ gene segments. As shown in FIG. 1A, 1,000 random V-D-J recombination events (according to a paradigm whereby random V-D events and random D-J events are queried for selection of a common D segment, and whereby equal efficiencies of recombination signal sequences are assumed) within a theoretical Ig $V_H$ locus having 50 functional $V_H$, 25 functional D and 6 functional $J_H$ gene segments, generate an output set having significant disparities in D segment utilization. Further inefficiencies are likely to result from non-productive recombination events. Inversional recombination events will also impact the efficiency of the reaction but do not have a significant impact on segment utilization since gene segment sequences are inverted and not lost. As shown in FIG. 1B, even by reducing the complexity of the theoretical Ig $V_H$ locus to one having 21 functional $V_H$, 18 functional D and 6 functional $J_H$ gene segments, gross disparities in D segment utilization persist.

Figure 2A:
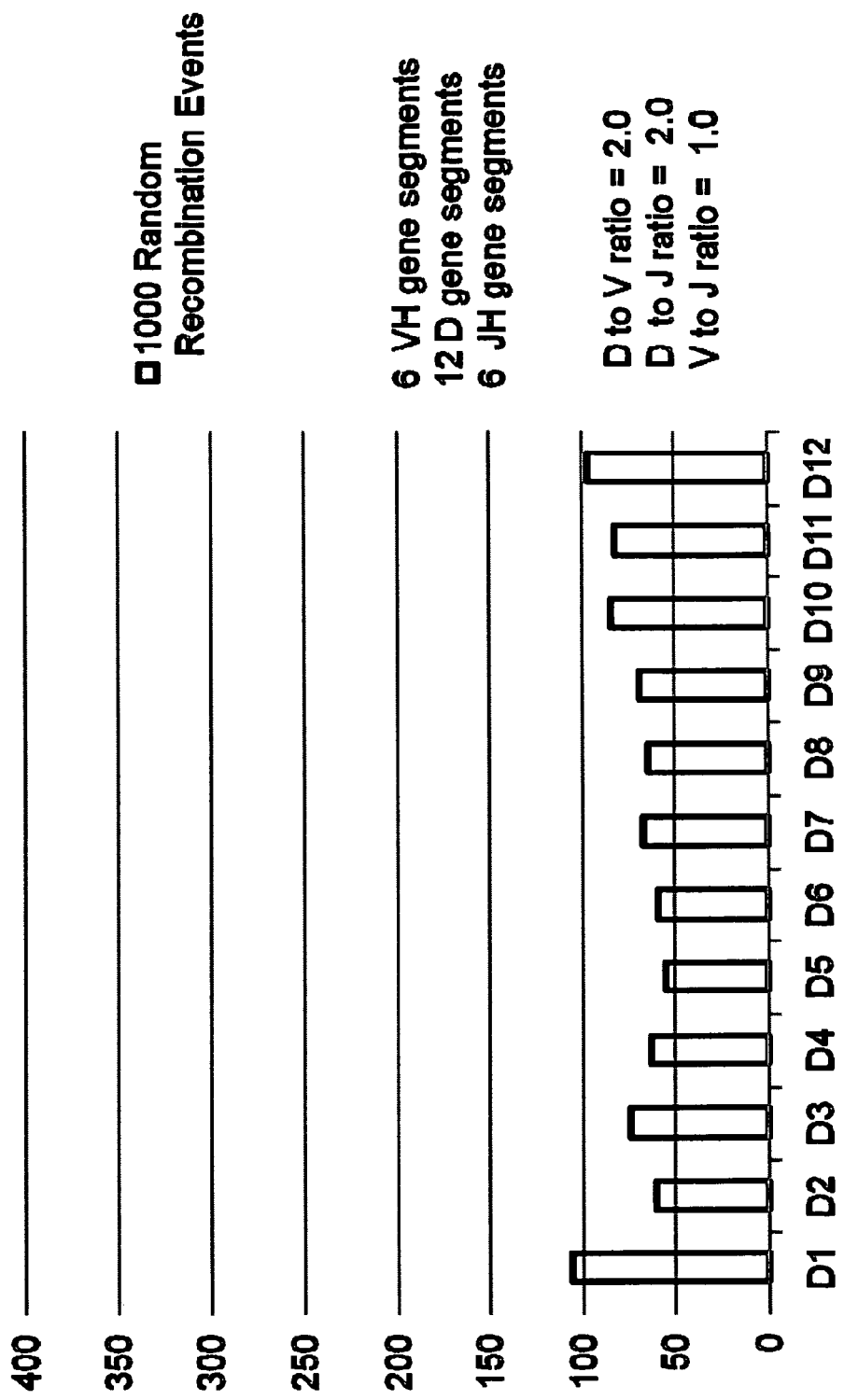
FIG. 2 shows theoretical Ig $V_H$ locus D segment utilization by (FIG. 2A) locus having 6 functional $V_H$, 12 functional D and 6 functional $J_H$ gene segments.
(FIG. 2B) theoretical Ig $V_H$ locus having 12 functional $V_H$, 12 functional D and 12 functional $J_H$ gene segments.
(FIG. 2C) theoretical Ig $V_H$ locus having 13 functional $V_H$, 10 functional D and 9 functional $J_H$ gene segments.
Figure 2B:
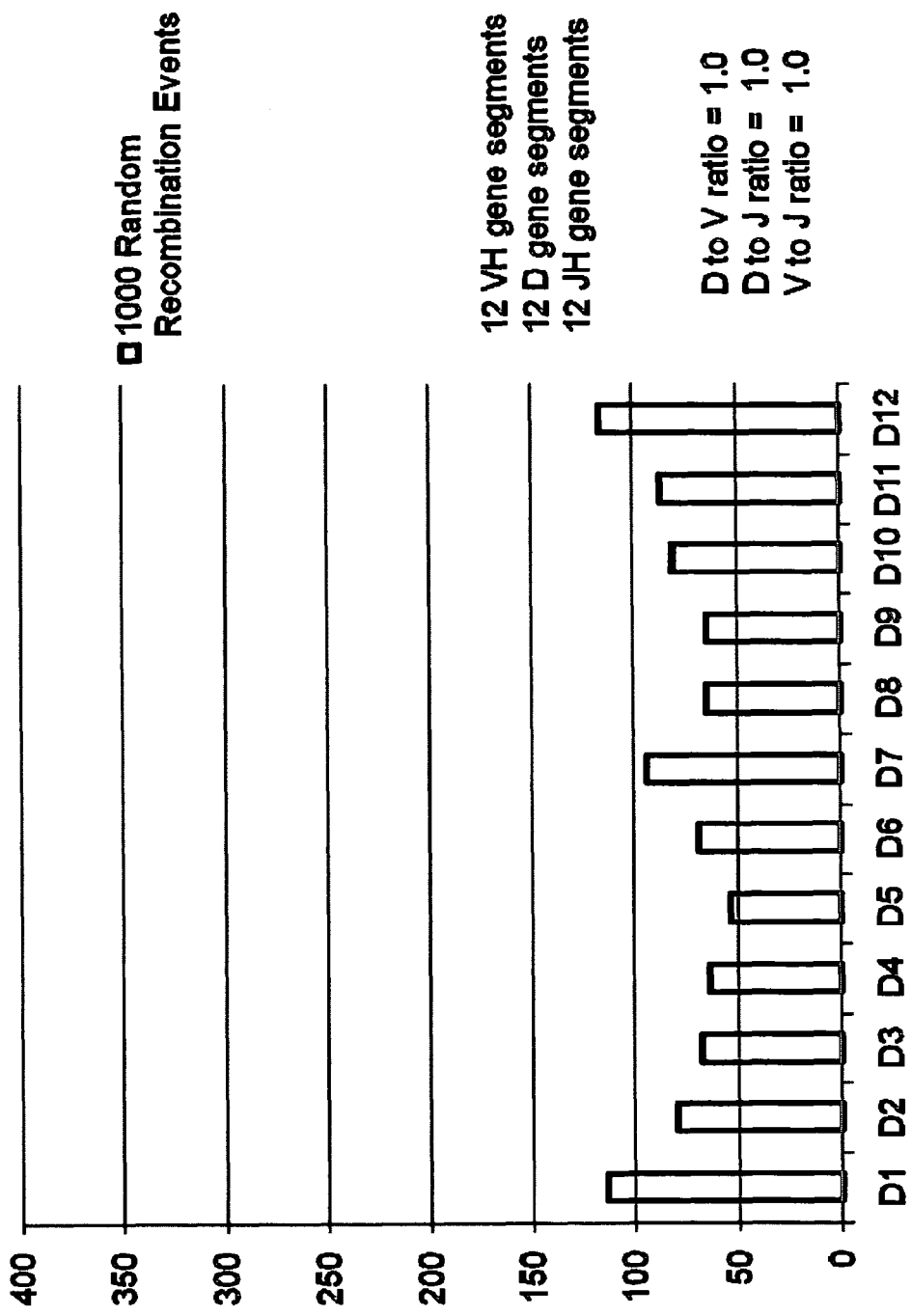
Figure 2C:
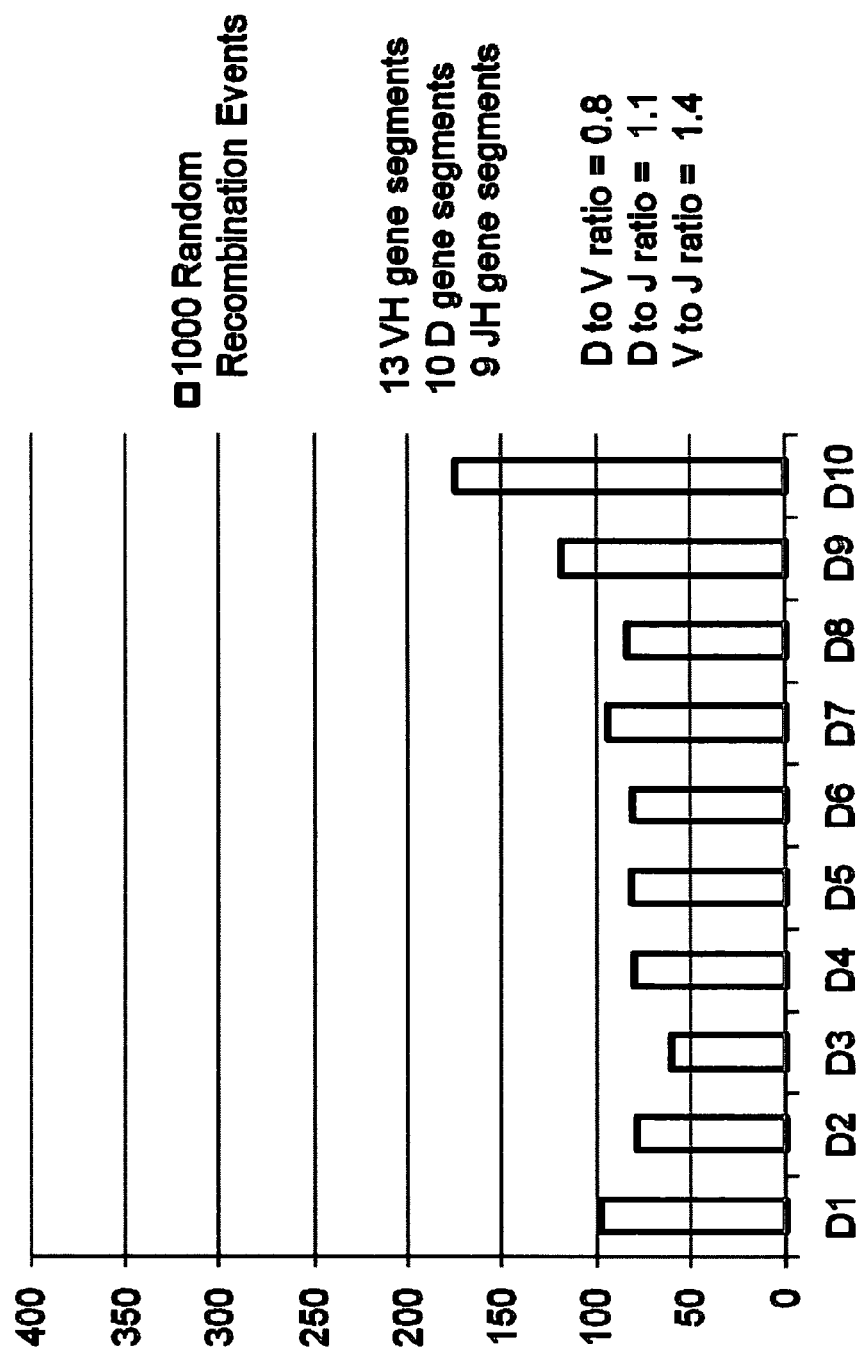

By contrast, according the present disclosure there are provided for the first time compositions and methods in which greater immunoglobulin structural diversity can be generated in vitro through selection of appropriate relative representation of the immunoglobulin gene elements to generate a highly diverse repertoire. As shown in FIG. 2, for example, such enhanced structural diversity is obtained when the ratio of $V_H$ region genes to D segment genes is about 1:1 to 1:2 and the ratio of $J_H$ segment genes to D segment genes is about 1:1 to 1:2, or when the ratio of $V_H$ region genes to $J_H$ segment genes is about 1:2 (V to J) to 2:1 (V to J), or when the combined number of $V_H$ region genes together with $J_H$ segment genes is not greater than the number of D segment genes when there is a plurality of D gene segments, or when 6, 7, 8, 9, 10, 11 or 12 D segment genes are present. A parameter that is described as being "about" a certain quantitative value typically may have a value that varies (i.e., may be greater than or less than) from the stated value by no more than 50%, and in preferred embodiments by no more than 40%, 30%, 25%, 20%, 15%, 10% or 5%. According to certain preferred embodiments as elaborated herein, the unexpected arrival at the present subject matter thus results from previously unappreciated significance of the gene segment usage biases that become apparent in vitro in the absence of the regulation normally imparted during recombination in vivo (as discussed supra), and of the importance of the relative ratios of the gene segments.

According to preferred embodiments disclosed herein, a nucleic acid composition for generating immunoglobulin structural diversity may be assembled from herein specified immunoglobulin gene elements, including naturally occurring and artificial sequences, using genetic engineering methodologies and molecular biology techniques with which those skilled in the art will be familiar. Useful immunoglobulin genetic elements for producing the compositions described herein include mammalian Ig heavy chain variable ($V_H$) and light chain variable ($V_L$) region genes, natural or artificial Ig diversity (D) segment genes, Ig heavy chain joining ($J_H$) and light chain joining ($J_L$) segment genes, and Ig locus recombination signal sequences (RSSs). Immunoglobulin variable (V) region genes are known in the art and include in their polypeptide-encoding sequences at least the polynucleotide coding sequence for one antibody complementarity determining region (CDR), for example, a first or a second CDR known as CDR1 or CDR2 according to conventional nomenclature with which those skilled in the art will be familiar, preferably coding sequence for two CDRs, for example, CDR1 and CDR2, and more preferably coding sequence for CDR1 and CDR2 and at least a portion (e.g., 1, 2, 3, 4, 5, 6, 7, 8, 9, 10, 11, 12, 13 or more amino acids) of CDR3, where it will be appreciated that typically one or more amino acids of CDR3 may be encoded at least in part by at least one nucleotide that is present in a D segment gene and/or in a J segment gene. (See, e.g., Lefranc M.-P., 1997 *Immunology Today* 18:509; Lefranc, 1999 *The Immunologist*, 7:132-13; Lefranc et al., 2003 *Dev. Comp. Immunol.* 27:55-77; Ruiz et al., 2002 *Immunogenetics* 53:857-883; Kaas et al., 2007 *Current Bioinformatics* 2:21-30; Kaas et al., 2004 *Nucl. Acids. Res.*, 32:D208-D210.)

Immunoglobulin D segment genes are also known in the art and as provided herein may include coding regions for natural or non-naturally occurring D segments which coding regions comprise 1, 2, 3, 4, 5, 6, 7, 8, 9, 10, 11, 12, 13, 14, 15, 16, 17, 18, 19, 20, 21, 22, 23 or 24 nucleotides. Immunoglobulin J segment genes are also known in the art, for example, from immunoglobulin genes or cDNAs that have been sequenced, and typically comprise J segment-encoding regions of about 1-51 nucleotides.

As described herein, many such Ig gene sequences are therefore known in the art (e.g., Kabat et al., *Sequences of Proteins of Immunological Interest*, Edition: 5, 1992 DIANE Publishing, 1992, Darby, Pa., ISBN 094137565X, 9780941375658; Tomlinson et al., 1992 *J Mol Biol* 227:776; Milner et al., 1995 *Ann N Y Acad Sci* 764:50) and can be used in the several embodiments herein disclosed, including mammalian Ig gene sequences from human, mouse, rat, rabbit, canine, feline, equine, bovine, monkey, baboon, macaque, chimpanzee, gorilla, orangutan, camel, llama, alpaca and ovine genomes. Preferred embodiments relate to human Ig gene sequences but the invention is not intended to be so limited.

Other genetic elements that may be useful in certain herein disclosed embodiments include membrane anchor domain polypeptide encoding polynucleotide sequences and variants or fragments thereof (e.g., primary sequence variants or truncated products that retain 3D structural properties of the corresponding unmodified polypeptide, such as space-filling, charge distribution and/or hydrophobicity/hydrophilicity) that encode membrane anchor domain polypeptides that localize the polypeptides in which they are present to the surfaces of cells in which they are expressed.

Other genetic elements that may be useful in certain herein disclosed embodiments include specific protein-protein association domain encoding polynucleotide sequences and variants and fragments thereof (e.g., primary sequence variants or truncated products that retain 3D structural properties of the corresponding unmodified polypeptide, such as space-filling, charge distribution and/or hydrophobicity/hydrophilicity) that mediate specific protein-protein associations such as specific binding, as described herein.

Specific binding interactions such as a specific protein-protein association or a specific antibody-antigen binding interaction preferably includes a protein-protein binding event, or an antibody-antigen binding event, having an affinity constant, $K_a$, of greater than or equal to about $10^4 \text{ M}^{-1}$, more preferably of greater than or equal to about $10^5 \text{ M}^{-1}$, more preferably of greater than or equal to about $10^6 \text{ M}^{-1}$, and still more preferably of greater than or equal to about $10^7 \text{ M}^{-1}$. Affinities of specific binding partners including antibodies can be readily determined using conventional techniques, for example, those described by Scatchard et al. (*Ann. N.Y. Acad. Sci. USA* 51:660 (1949)), by Harlow et al., in *Antibodies: A Laboratory Manual*, Cold Spring Harbor Laboratory (1988), by Weir, *Handbook of Experimental Immunology*, 1986, Blackwell Scientific, Boston, by Scopes, *Protein Purification: Principles and Practice*, 1987 Springer-Verlag, New York, by surface plasmon resonance (BIAcore, Biosensor, Piscataway, N.J., see, e.g., Wolff et al., *Cancer Res.* 53:2560-2565 (1993)) or by other techniques known to the art.

As noted above, certain genetic elements that may be useful in presently disclosed embodiments include recombination signal sequences (RSSs), which are nucleic acid sequences that comprise a heptamer and a nonamer separated by a spacer of either 12 or 23 nucleotides, and that are specifically recognized in a complex recombination mechanism according to which a first RSS having a 12-nucleotide spacer recombines with a second RSS having a 23-nucleotide spacer. The orientation of the RSS determines if recombination results in a deletion or inversion of the intervening sequence.

As also described above, extensive investigations of RSS processes have led to an understanding of nucleotide positions within RSSs that cannot be varied without compromising RSS functional activity in genetic recombination mechanisms, and of other nucleotide positions within RSSs that can be varied to alter (e.g., increase or decrease in a statistically significant manner) the efficiency of RSS functional activity in genetic recombination mechanisms, and of other positions within RSSs that can be varied without having any significant effect on RSS functional activity in genetic recombination mechanisms (e.g., Ramsden et. al 1994; Akamatsu et. al. 1994 *J Immunol* 153:4520; Hesse et. al. 1989 *Genes Dev* 3:1053; Fanning et. al. 1996; Larijani et. al 1999; Nadel et. al. 1998 *J Exp Med* 187:1495; Lee et al. 2003 PLoS Biol 1:E1; Cowell et al. 2004 *Immunol. Rev.* 200:57).

According to the presently contemplated embodiments, an RSS may be any RSS that is known to the art, including sequence variants of known RSSs that comprise one or more nucleotide substitutions (e.g., about 1, 2, 3, 4, 5, 6, 7, 8, 9, 10, 11, 12, 13, 14, 15, 16, 17, 18 or more substitutions) relative to the known RSS sequence and which, by virtue of such substitutions, predictably have low efficiency (e.g., about 1% or less, relative to a high efficiency RSS), medium efficiency (e.g., about 10% to about 20%, relative to a high efficiency RSS) or high efficiency, including those variants for which one or more nucleotide substitutions relative to a known RSS sequence will have no significant effect on the recombination efficiency of the RSS (e.g., the success rate of the RSS in promoting formation of a recombination product, as known in the art and readily determined according to assays such as those disclosed in Hesse et al., 1989 *Genes Dev* 3:1053; Akamatsu et al., 1994 *J Immunol* 153:4520; Nadel et al., 1998 *J Exp Med* 187:1495; Lee et al., 2003 *PLoS Biol* 1:E1; Cowell et al., 2004 *Immunol Rev* 200:57).

Further according to the presently disclosed embodiments, it is to be understood that when, for instance, a first nucleic acid comprising a first RSS is described as being capable of functional recombination with a second RSS that is present in a second nucleic acid, such capability includes compliance with the 12/23 rule for RSS nucleotide spacers as described herein and known in the art, such that if the first RSS comprises a 12-nucleotide spacer then the second RSS will comprise a 23-nucleotide spacer, and similarly if the first RSS comprises a 23-nucleotide spacer then the second RSS will comprise a 12-nucleotide spacer.

Certain embodiments of the presently disclosed nucleic acid compositions comprise one or more of first, second, third and fourth isolated nucleic acids as described herein, where such nucleic acids may be separate molecules or may be joined into a single nucleic molecule, or may be present as two or three nucleic acid molecules, so long as the nucleic acid is capable of undergoing recombination events to form a recombined polynucleotide that encodes an immunoglobulin polypeptide as recited. These nucleic acid compositions may comprise one or more RSSs which, as noted above, may be any RSS provided the 12/23 rule for RSS spacers is satisfied in any particular nucleic acid composition as a whole. The identities of particular RSSs may be specified by qualifying the RSS according to a particular genetic element with which it is associated in an isolated nucleic acid.

For example, where a nucleic acid composition comprises a first isolated nucleic acid that comprises one or a plurality of mammalian immunoglobulin heavy chain variable ($V_H$) region genes, each having a $V_H$ encoding polynucleotide sequence and a RSS that is situated 3' to the $V_H$ encoding polynucleotide sequence, the RSS may be referred to as a "$V_H$ region RSS" that is located 3' to the $V_H$ encoding sequence. As another example, where a nucleic acid composition comprises a second isolated nucleic acid that comprises one or a plurality of mammalian immunoglobulin heavy chain diversity (D) segment genes, each having a D segment encoding polynucleotide sequence and two RSSs, with the first RSS being situated 5' to the D segment encoding sequence and the second RSS being situated 3' to the D segment encoding sequence, the first RSS may be referred to as "a D segment upstream RSS" that is located 5' to each D segment encoding sequence, and the second RSS may be referred to as "a D segment downstream RSS" that is located 3' to each D segment encoding sequence. The skilled person will accordingly appreciate what is meant by other similarly specified RSSs, including, for example, an RSS that is "a $J_H$ segment RSS" that is located 5' to a $J_H$ segment encoding polynucleotide sequence, another RSS that is "a $V_L$ region RSS" that is located 3' to a $V_L$ region encoding polynucleotide sequence, and another RSS that is "a $J_L$ segment RSS" that is located 5' to a $J_L$ segment encoding polynucleotide sequence.

Examples of RSS sequences known to the art, including their characterization as high, medium or low efficiency RSSs, are presented in Table 1.

TABLE 1

EXEMPLARY RECOMBINATION SIGNAL SEQUENCES

| heptamer H12 | spacer S12 | nonamer N12 | Seq. ID No. | heptamer H23 | spacer S23 | nonamer N23 | Seq Id No: * |
|---|---|---|---|---|---|---|---|
| Part I. Efficiency: HIGH | | | | | | | |
| CACAGTG | ATACAG ACCTTA | ACAAAAAC C | 29 | CACAGTG | GTAGTACTCCACTGTCTGGCACAAAAACC TGT | | 30 4 |
| CACAGTG | CTACAG ACTGGA | ACAAAAAC C | 31 | CACAGTG | GTAGTACTCCACTGTCTGGCACAAAAACC TGT | | 32 3 |
| CACAGTG | CTCCAG GGCTGA | ACAAAAAC C | 33 | CACAGTG | GTAGTACTCCACTGTCTGGGACAAAAACC TGT | | 34 1 |
| CACAGTG | CTACAG ACTGGA | ACAAAAAC C | 35 | CACAGTG | TTGCAACCACATCCTGAGTGACAAAAACC TGT | | 36 2 |
| CACAGTG | CTACAG ACTGGA | ACAAAAAC C | 37 | CACAGTG | GTAGTACTCCACTGTCTGGCACAAAAACC TGT | | 38 2 |
| CACAGTG | CTACAG ACTGGA | ACAAAAAC C | 39 | CACAGTG | ACGGAGATAAAGGAGGAAG CAGG | ACAAAAACC | 40 2 |
| CACAGTG | GTACAG ACCAAT | ACAGAAAC C | 41 | CACAGTG | GCCGGGCCCCGCGGCCCG GCGGC | ACAAAAACC | 42 5 |
| Part II. Efficiency: MEDIUM (~10-20% of High) | | | | | | | |
| CACGGTG | CTACAG ACTGGA | ACAAAAAC C | 43 | CACAGTG | GTAGTACTCCACTGTCTGGCACAAAAACC TGT | | 44 3 |
| CACAATG | CTACAG ACTGGA | ACAAAAAC C | 45 | CACAGTG | GTAGTACTCCACTGTCTGGCACAAAAACC TGT | | 46 3 |
| CACAGCG | CTACAG ACTGGA | ACAAAAAC C | 47 | CACAGTG | GTAGTACTCCACTGTCTGGCACAAAAACC TGT | | 48 3 |
| CACAGTG | CTACAG ACTGGA | ACAAAAAC C | 49 | CACAATG | GTAGTACTCCACTGTCTGGCACAAAAACC TGT | | 50 3 |
| CACAGTG | CTACAG ACTGGA | ACAAAAAC C | 51 | CACAGCG | GTAGTACTCCACTGTCTGGCACAAAAACC TGT | | 52 3 |
| CACAGTG | CTACAG ACTGGA | ACAAAAAC C | 53 | CACAGTA | GTAGTACTCCACTGTCTGGCACAAAAACC TGT | | 54 3 |
| CACAGTG | CTACAG ACTGGA | ACAAAAAC C | 55 | CACAGTG | GTAGTACTCCACTGTCTGGCACAATAACC TGT | | 56 3 |
| CACAGTG | CTACAG ACTGGA | ACAAAAAC C | 57 | CACAGTG | GTAGTACTCCACTGTCTGGCACAAGAACC TGT | | 58 3 |
| CACAGTG | CTACAG ACTGGA | ACAAAAAC C | 59 | CACAGTG | GTAGTACTCCACTGTCTGGCACACGAACC TGT | | 60 3 |
| CACAGTG | CTACAG ACTGGA | CAAAAACC C | 61 | CACAGTG | GTAGTACTCCACTGTCTGGCACAAAAACC TGT | | 62 3 |
| CACAGTG | CTACAG ACTGGA | ACAAAAAC C | 63 | CACAGTG | GTAGTACTCCACTGTCTGGCACACGAACC TGT | | 64 3 |
| CACAATG | CTACAG ACTGGA | ACAAAAAC C | 65 | CACAATG | GTAGTACTCCACTGTCTGGCACAAAAACC TGT | | 66 3 |
| CACAGCG | CTACAG ACTGGA | ACAAAAAC C | 67 | CACAGCG | GTAGTACTCCACTGTCTGGCACAAAAACC TGT | | 68 3 |

TABLE 1-continued

EXEMPLARY RECOMBINATION SIGNAL SEQUENCES

| heptamer H12 | spacer S12 | nonamer N12 | Seq. ID No. | heptamer H23 | spacer S23 | nonamer N23 | Seq Id No: * |
|---|---|---|---|---|---|---|---|
| Part III. Efficiency: LOW (~1% or less of High) | | | | | | | |
| TACAGTG | CTACAG ACTGGA | ACAAAAAC C | 69 | CACAGTA | GTAGTACTCCACTGTCTGGCACAAAAACC TGT | | 70 3 |
| GACAGTG | CTACAG ACTGGA | ACAAAAAC C | 71 | CACAGTG | GTAGTACTCCACTGTCTGGCACAAAAACC TGT | | 72 3 |
| CATAGTG | CTACAG ACTGGA | ACAAAAAC C | 73 | CACAATG | GTAGTACTCCACTGTCTGGCACAAAAACC TGT | | 74 3 |
| CACAATG | CTACAG ACTGGA | ACAAAAAC C | 75 | CATAGTG | GTAGTACTCCACTGTCTGGCACAAAAACC TGT | | 76 3 |
| CACAGTG | CTACAG ACTGGA | ACAAAAAC C | 77 | CACAGTG | GTAGTACTCCACTGTCTGGTGTCTCTGA TGT | | 78 3 |
| CAGAGTG | CTCCAG GGCTGA | ACAAAAAC C | 79 | CACAGTG | GTAGTACTCCACTGTCTGGGACAAAAACC TGT | | 80 1 |
| CACAGTG | CTCCAG GGCTGA | AAAAAAAC C | 81 | CACAGTG | GTAGTACTCCACTGTCTGGGACAAAAACC TGT | | 82 1 |
| CTCAGTG | CTCCAG GGCTGA | ACAAAAAC C | 83 | CACAGTG | GTAGTACTCCACTGTCTGGGACAAAAACC TGT | | 84 1 |

*(1) Akamatsu et al. 1994; (2) Cowell et al. 2004; (3) Hesse et al. 1989; (4) Lee et al. 2003; (5) Nadel et al. 1998.

Certain preferred embodiments contemplate construction of nucleic acid compositions for generating immunoglobulin structural diversity as provided herein whereby selection of RSSs of known efficiencies at prescribed positions may advantageously counteract biases in particular immunoglobulin gene utilization that would otherwise result from the relative locations of the several Ig genetic elements. More specifically, and without wishing to be bound by theory, the nucleic acid compositions disclosed herein are envisioned as comprising, in a 5' to 3' orientation according to molecular biology conventions for designating directionality to a DNA coding strand:

(a) one or a plurality of Ig V region genes, each having (i) an Ig V region encoding polynucleotide sequence and (ii) a V region RSS that is located 3' to the V region encoding polynucleotide;

(b) one or a plurality of Ig D segment genes, each having (i) a D segment encoding polynucleotide sequence, (ii) a D segment upstream RSS that is located 5' to the D segment encoding polynucleotide, and (iii) a D segment downstream RSS that is located 3' to the D segment encoding polynucleotide; and (c) one or a plurality of Ig J segment genes, each having (i) a J segment encoding polynucleotide sequence and (ii) a J segment RSS that is located 5' to the J segment encoding polynucleotide.

According to such a configuration, it will be appreciated that in the course, simultaneously or sequentially and in either order, of functional recombination of the V region RSS with the D segment upstream RSS, and functional recombination of the D segment downstream RSS with the J segment RSS, unused intervening V, D and J genes are deleted such that if the selection of V, D and J genes is random, the frequency of usage of particular genes will be biased.

For example, V region genes situated closer to the 5' end of the construct are likely to be overused in productive RSS-RSS recombination events, because they have a lower probability of being deleted during V-D recombination, while V region genes situated closer to the 3' end of (a) are likely to be underused given the higher probability they will be deleted during recombination. Similarly, D segment genes situated at or near the 5' end of (b) are likely to be underused, while those situated at or near the 3' end of (b) are more likely to survive deletion events accompanying recombinase-mediated DNA cleavage and subsequent repair, and so would be overused in productive recombination events.

As provided herein, enhanced generation of immunoglobulin structural diversity in the present artificial system is accomplished through efficient and relatively unbiased utilization of Ig V, D and J genetic elements, including by designing nucleic acid constructs that have defined relative ratios of V, D and J genes and/or restricted number of D segment genes and/or by strategic positioning of RSSs of predefined efficiencies.

Accordingly, in certain embodiments there is provided a nucleic acid composition for generating Ig structural diversity that comprises one or a plurality of Ig V region genes, Ig D segment genes, and Ig J segment genes as described herein, and optionally further comprising a polynucleotide encoding a membrane anchor domain polypeptide and/or a polynucleotide encoding a specific protein-protein association domain, in which (a) the V region genes and the D segment genes are present at a ratio of about 1:1 to 1:2, and the J segment genes and the mammalian D segment genes are present at a ratio of about 1:1 to 1:2; or in which (b) the V region genes and the J segment genes are present at a ratio of about 1:2 (V to J) to 2:1 (V to J); or in which (c) the V region genes, together with the J segment genes, are not greater in number than the D segment genes; or in which (d) there are 6, 7, 8, 9, 10, 11 or 12 D segment genes.

In certain further embodiments, (a) 12-50 contiguous V region genes (in preferred embodiments $V_H$ region genes) are present of which about 10% to about 30% of said V region genes are contiguous with a 5'-most located V region gene and each V region gene comprises a V region (preferably a $V_H$ region) RSS of low or medium RSS efficiency, and of which about 70% to about 90% of said V region genes are contiguous with a 3'-most located V region gene and each comprises a V region RSS of high RSS efficiency; and (b) a plurality of contiguous D segment genes are present of which (i) about 80% to about 90% of said D segment genes are contiguous with a 5'-most located D segment gene and each comprises a D segment upstream RSS of high RSS efficiency and a D segment downstream RSS of high RSS efficiency, and (ii) about 10% to about 20% of said D segment genes are contiguous with a 3'-most located D segment gene and each comprises a D segment upstream RSS of low or medium RSS efficiency and a D segment downstream RSS of low or medium RSS efficiency, wherein the plurality of V region genes, together with the one or a plurality of J segment genes, are not greater in number than said plurality of D segment genes.

It will be understood by those familiar with the art that by convention and due to nucleic acid 5'-to-3' polarity, a nucleic acid coding strand comprises an upstream or 5' end (or 5' terminus) and a downstream or 3' end (or 3' terminus) such that in the linear polymer containing a plurality of linked and tandemly, consecutively and/or sequentially arrayed (e.g., contiguous) genes, a single gene (e.g., of a designated class, such as a V region gene) may be situated closer to the 5' terminus than all others (e.g., the "5'-most located" gene) and a different single gene (e.g., of the designated class) may be situated closer to the 3' terminus than all the others (e.g., the "3'-most located" gene). Hence, distribution of RSSs having specified recombination efficiencies amongst the plurality of contiguous genes in the nucleic acid molecule will vary according to the number of genes that are used in a particular construct, in order for a specified percentage of such genes to comprise a specified RSS type. Additionally and as provided herein according to certain preferred embodiments such RSS distributions will accordingly confer gene utilizations that are about equal, thereby advantageously providing compositions for generating increased Ig structural diversity.

In related but distinct embodiments, there is accordingly provided a nucleic acid composition for generating Ig structural diversity that comprises one or a plurality of Ig V region genes, Ig D segment genes, and Ig J segment genes as described above, and that is characterized by one or more of (a) 12-50 contiguous V (preferably $V_H$) region genes are present of which about 10% to about 30% are contiguous with a 5'-most located V region gene and each V region gene comprises a V region RSS of low or medium RSS efficiency; (b) 12-50 contiguous V (preferably $V_H$) region genes are present of which about 70% to about 90% are contiguous with a 3'-most located V region gene and each V region gene comprises a V region RSS of high RSS efficiency; (c) a plurality of contiguous D segment genes are present of which about 80% to about 90% are contiguous with a 5'-most located D segment gene and each D segment gene comprises a D segment upstream RSS of high RSS efficiency and a D segment downstream RSS of high RSS efficiency; and (d) a plurality of contiguous D segment genes are present of which about 10% to about 20% are contiguous with a 3'-most located D segment gene and each comprises a D segment upstream RSS of low or medium RSS efficiency and a D segment downstream RSS of low or medium RSS efficiency.

As disclosed herein according to certain embodiments there are provided nucleic acid compositions for generating immunoglobulin structural diversity by including, for example by way of illustration and not limitation in a composition that contains immunoglobulin light chain-encoding sequences (e.g., $V_L$ and $J_L$), an immunoglobulin diversity (D) segment gene, which may in certain related embodiments comprise a naturally occurring D segment encoding sequence (e.g., Corbett et al., 1997 *J Mol Biol* 270:587; NCBI locus NG_001019; vbase, 1997 MRC Centre for Protein Engineering). In certain distinct but related embodiments, however, a nucleic acid composition as provided herein, for instance and without limitation, an Ig light-chain or light-chain fusion protein encoding nucleic acid composition, may comprise an artificial D segment gene that may comprise a non-naturally occurring sequence encoding an artificial D segment and that is positioned to be recombined between $V_L$ and $J_L$, and which may comprise a nucleotide sequence representing a subset or combination of sequences found in any human D segment gene including a single nucleotide, a dinucleotide or a fusion of complete or partial human D segment gene sequences, but which in preferred embodiments is not generally recognized as a conventional human D segment gene. Such an artificial D segment encoding sequence of 1, 2, 3, 4, 5, 6, 7, 8, 9, 10, 11, 12, 13, 14, 15, 16, 17, 18, 19, 20, 21, 22, 23 or 24 nucleotides is contemplated. Accordingly, a D segment encoding sequence may include a single nucleotide, or any dinucleotide, or any combination of two or more fused D segment encoding polynucleotide sequences from two or more distinct, recognized immunoglobulin D segment genes that occur naturally in a genome, preferably the human genome. Non-limiting examples of D segment encoding polynucleotide sequences are presented in Table 2.

TABLE 2

EXEMPLARY D SEGMENT ENCODING SEQUENCES

| D | # | Nucleotide Sequence | SEQ ID NO: |
|---|---|---|---|
| D1 | 1-1 | GGTACAACTGGAACGAC | 85 |
| | 1-7 | GGTATTACTGGAACTAC | 86 |
| | 1-20 | GGTATAACTGGAACGAC | 87 |
| | 1-26 | GGTATAGTGGGAGCTACTAC | 88 |
| D2 | 2-2 | AGGATATTGTAGTAGTACCAGCTGCTATACC | 89 |
| | 2-8 | AGGATATTGTACTAATGGTGIATGCTATACC | 90 |
| | 2-15 | AGGATATTGTAGTGGTGGTAGCTGCTACTCC | 91 |
| | 2-21 | AGCATATTGTGGTGGTGACTGCTATTCC | 92 |
| D3 | 3-3 | GTATTACGATTTTTGGAGTGGTTATTATACC | 93 |
| | 3-9 | GTATTACGATATTTTGACTGGTTATTATAAC | 94 |
| | 3-10 | GTATTACTATTGGTTCGGGGAGTTATTATAAC | 95 |
| | 3-16 | GTATTATTGATTACGTTTGGGGGAGTTATCGTTATACC | 96 |
| | 3-22 | GTATTACTATGATAGTAGTGGTTATTACTAC | 97 |
| D4 | 4-4 | TGACTACAGTAACTAC | 98 |
| | 4-11 | TGACTACAGTAACTAC | 99 |
| | 4-17 | TGACTACGGTGACTAC | 100 |
| | 4-23 | TGACTACGGTGGTAACTCC | 101 |
| D5 | 5-5 | GTGGATACAGCTATGGTTAC | 102 |
| | 5-12 | GTGGATATAGTGGCTACGATTAC | 103 |
| | 5-18 | GTGGATACAGCTATGGTTAC | 104 |
| | 5-24 | GTAGAGATGGCTACAATTAC | 105 |
| D6 | 6-6 | GAGTATAGCAGCTCGTCC | 106 |
| | 6-13 | GGGTATAGCAGCAGCTGGTAC | 107 |
| | 6-19 | GGGTATAGCAGTGGCTGGTAC | 108 |
| D7 | 7-27 | CTAACTGGGGA | 109 |

In certain embodiments a D segment gene may therefore be provided on immunoglobulin light chain diversity generating constructs, as described in detail, for instance, in Example 2. The inclusion of a D segment gene converts an otherwise bimolecular reaction system into a tripartite system. Because of the 12/23 pairing rule (discussed supra), in an exemplary bimolecular system all the V segments may be adjacent to RSSs (i.e., V region RSSs) having spacers of a first common size (e.g., utilizing either 12 or 23 nucleotides) and the J segments are all adjacent to RSSs (i.e., J segment RSSs) having spacers of a second common size that is not the same as the first common size used in V region RSS spacers. In other words, if the V region RSSs contain 23-nucleotide spacers then the J segment RSSs would contain 12-nucleotide spacers, and vice versa. This configuration directs V to J recombination, but without the regulation found in vivo it would continue to consume Ig gene segments until either only a single V or J gene segment remains, or until the recombinase is turned off by cellular mechanisms. In the absence of being able to turn off the recombinase in a specific cell that has completed recombination as is accomplished in vivo, continuing recombination would result in the vast underrepresentation of proximal V-J segments and would favor usage of the distal segments. In a tripartite system, the V and J segments would both use RSSs having the same spacer sizes (i.e., V region RSSs and J segment RSSs would have the same spacer size, being either 12- or 23-nucleotides) and the D segment gene RSSs (i.e., the D segment upstream RSS and the D segment downstream RSS) would each use the complementary RSS signal size (i.e., 23 nucleotides if V region RSSs and J segment RSSs use 12-nucleotide spacers, and 12 nucleotides if V region RSSs and J segment RSSs use 23-nucleotide spacers). In this exemplary configuration, because the V region RSSs and J segment RSSs have spacers of the same size, the 12/23 rule prevents them from recombining directly. Instead recombination proceeds through a D segment gene that comprises a D segment upstream RSS and a D segment downstream RSS having spacers of the same size. In certain related embodiments and without wishing to be bound by theory, it is contemplated therefore that limiting the number of D segment genes may limit the number of rounds of recombination that a particular Ig diversity-generating nucleic acid composition can undergo; recombination stops when there is only a single D segment remaining and all D segment RSSs have been utilized. In another related embodiment in which the Ig diversity-generating nucleic acid composition comprises one D segment gene, V-D recombination can occur only once via functional recombination of the D segment upstream RSS with the V region RSS, and D-J recombination can occur only once via functional recombination of the D segment downstream RSS with the J segment RSS, thus reducing biases in gene segment utilization.

As the D segment is found naturally in heavy chains and not light chains, these and related embodiments also contemplate unprecedented expansion of the immunoglobulin light chain variable region repertoire, by providing the D segment as an additional combinatorial source of structural diversity through V-D-J recombination events as described herein.

Among the several embodiments described herein, there are also provided the means for generating structurally diverse immunoglobulin gene libraries, including recombined genes encoding antibodies having membrane anchor domains that permit their display on the surfaces of host cells expressing such immunoglobulin genes. Advantages associated with cell surface expression, as distinct from secreted forms, of structurally diverse immunoglobulins as described herein, will be readily appreciated by persons familiar with the art in view of the present disclosure, for example, to facilitate the identification and/or selection of cells containing a particular rearranged immunoglobulin gene, such as a cell expressing an antibody having a desired antigen specificity.

In addition, certain preferred embodiments include the use of host cells that are capable of immunoglobulin gene rearrangement, but that may usefully be expanded in number without immunoglobulin gene rearrangement taking place. In certain particularly preferred embodiments, such host cells are capable of expressing recombination control elements that mediate immunoglobulin gene rearrangement events, but the expression of control elements is regulated in such a manner as to permit expansion of the host cell population prior to permitting the V-D-J gene rearrangement which generates CDR3 sequence diversity.

As also described elsewhere herein, recombination control elements include the RAG-1, and RAG-2 genes and their respective gene products, for which defined roles in regulating immunoglobulin gene rearrangement/recombination events have been biochemically defined. Preferably such recombination control elements are operably linked to the nucleic acid compositions that, as described herein, comprise immunoglobulin structural domain-encoding polynucleotide sequences and recombination signal sequences (RSSs). According to certain such embodiments a nucleic acid composition for generating Ig structural diversity as provided herein is under control of an operably linked recombination control element when one, two or more recombination events that the nucleic acid composition undergoes to form a recombined polynucleotide that encodes an immunoglobulin polypeptide or fusion protein are mediated by the recombination control element. The recombination control element may be inducible, for example, through regulation of its expression by a promoter such as a tightly regulated promoter.

For example and in certain preferred embodiments, a host cell that comprises a nucleic acid composition for generating Ig structural diversity as provided herein, and that also comprises an operably linked inducible recombination control element that controls one or more recombination events which give rise to a productive immunoglobulin or Ig fusion protein encoding polynucleotide, may contain the chromosomally integrated nucleic acid composition under conditions wherein at least one component of the recombination control element (e.g., RAG-1 or RAG-2) is not constitutively (productively, e.g., at functionally relevant levels) expressed, but may be expressed upon exposure of the host cell to an inducer.

Such a host cell may advantageously be expanded to obtain a population of host cells bearing the chromosomally integrated nucleic acid composition, such that the expanded population can be induced with the inducer to obtain a population of cells each expressing a structurally diverse immunoglobulin subsequent to two or more recombination events to form a recombined polynucleotide that encodes the immunoglobulin, where such recombination events are mediated by recombination control elements the expression of which is induced by the inducer. This important feature of these and related preferred embodiments allows recombination to occur subsequent to expansion of the host cell population. According to non-limiting theory, such preferred embodiments (in which Ig gene recombination takes place only after expansion of a host cell population) offer particular advantages associated with increasing the opportunities for different structurally diverse immunoglobulins to result from random recombination events in a large number of distinct cells that have chromosomally integrated the herein disclosed nucleic acid compositions for generating Ig structural diversity. Further according to non-limiting theory, absent such an opportunity to first expand the host cell population, an Ig gene recombination-competent cell having a chromosomally integrated nucleic acid composition for generating Ig structural diversity would be able to complete recombination soon after subcloning, such that only a limited number of different antibodies would have been generated.

Certain related embodiments advantageously provide non-naturally occurring immunoglobulin fusion proteins that usefully feature immunoglobulin heavy chains having a membrane anchor domain polypeptide, and/or recombination-mediated assembly of functional immunoglobulin light chains having either or both of (i) a heavy chain diversity (D) segment (including an artificial D segment as described herein) and (ii) a specific protein-protein association domain (e.g., all or a protein-protein associating portion of a mammalian immunoglobulin $C_L$ chain, or an RGD-containing polypeptide that is capable of integrin binding, or a heterodimer-promoting polypeptide domain, or other such domains as described herein and known in the art), or a lipid raft-associating polypeptide domain, where such modified immunoglobulin structures may facilitate generation of large antibody repertoires and identification of cells expressing an immunoglobulin or immunoglobulin-like molecule having a desired V region.

Hence, according to certain embodiments disclosed herein there are provided immunoglobulin fusion polypeptides and proteins that localize to the cell surface by virtue of having naturally present or artificially introduced structural features that direct the fusion protein to the cell surface (e.g., Nelson et al. 2001 *Trends Cell Biol.* 11:483; Ammon et al., 2002 *Arch. Physiol. Biochem.* 110:137; Kasai et al., 2001 *J. Cell Sci.* 114:3115; Watson et al., 2001 *Am. J. Physiol. Cell Physiol.* 281:C215; Chatterjee et al., 200 *J. Biol. Chem.* 275:24013) including by way of illustration and not limitation, secretory signal sequences, leader sequences, plasma membrane anchor domain polypeptides such as hydrophobic transmembrane domains (e.g., Heuck et al., 2002 *Cell Biochem. Biophys.* 36:89; Sadlish et al., 2002 *Biochem J.* 364:777; Phoenix et al., 2002 *Mol. Membr. Biol.* 19:1; Minke et al., 2002 *Physiol. Rev.* 82:429) or glycosylphosphatidylinositol attachment sites ("glypiation" sites, e.g., Chatterjee et al., 2001 *Cell Mol. Life. Sci.* 58:1969; Hooper, 2001 *Proteomics* 1:748; Spiro, 2002 *Glycobiol.* 12:43R), cell surface receptor binding domains, extracellular matrix binding domains, or any other structural feature that causes the fusion protein to localize to the cell surface.

Particularly preferred are fusion proteins that comprise a plasma membrane anchor domain, which may include a transmembrane polypeptide domain typically comprising a membrane spanning domain (e.g., an α-helical domain) which includes a hydrophobic region capable of energetically favorable interaction with the phospholipid fatty acyl tails that form the interior of the plasma membrane bilayer, or which may include a membrane-inserting domain polypeptide typically comprising a membrane-inserting domain which includes a hydrophobic region capable of energetically favorable interaction with the phospholipid fatty acyl tails that form the interior of the plasma membrane bilayer (e.g., outer leaflet phospholipids) but that may not span the entire membrane. Such features are well known to those of ordinary skill in the art, who will further be familiar with methods for introducing nucleic acid sequences encoding these features into the subject expression constructs by genetic engineering, and with routine testing of such constructs to verify cell surface localization of the product. Well known examples of transmembrane proteins having one or more transmembrane polypeptide domains include members of the integrin family, CD44, glycophorin, MHC Class I and II glycoproteins, EGF receptor, G protein coupled receptor (GPCR) family, porin family and other transmembrane proteins. Certain embodiments contemplate using a portion of a transmembrane polypeptide domain such as a truncated polypeptide having membrane-inserting characteristics as may be determined according to standard and well known methodologies.

Certain other embodiments relate to immunoglobulin fusion polypeptides having a specific protein-protein association domain (e.g., Ig $C_L$ polypeptide regions that mediate association to cell surface Ig H chains; $\beta_2$-microglobulin polypeptide regions that mediate association to class I MHC molecule extracellular domains, etc.), an RGD-containing polypeptide that is capable of integrin binding, a lipid raft-associating polypeptide domain, and/or a heterodimer-promoting polypeptide domain. A number of such domains are exemplified by the presently cited publications but these and related embodiments are not intended to be so limited and contemplate other specific protein-protein associating polypeptide domains that are capable of specifically associating with an extracellularly disposed region of a cell surface protein, glycoprotein, lipid, glycolipid, proteoglycan or the like, even where, importantly, such associations may in certain cases be initiated intracellularly, for instance, concomitant with the synthesis, processing, folding, assembly, transport and/or export to the cell surface of a cell surface protein. In another related embodiment, there may be included in the structure of an Ig fusion polypeptide as described herein a domain of a protein, such as a subunit of an integrin, that is known to associate with another cell surface protein that is membrane anchored and exteriorly disposed on a cell surface. Non-limiting examples of such polypeptide domains include, for $C_L$ H-chain-associating domains: (Azuma, T. and Hamaguchi, K. (1976). *J Biochem* 80:1023-38; Hamel et. al. (1987). *J Immunol* 139:3012-20; Horne et. al. (1982). *J Immunol* 129:660-4; Lilie et. al. (1995). *J Mol Biol* 248:190-201; Masuda et. al. (2006). *Febs J* 273:2184-94; Padlan et. al. (1986). *Mol Immunol* 23:951-60; Rinfret et. al. (1985). *J Immunol* 135:2574-81); for RGD-containing polypeptides including those that are capable of integrin binding, Heckmann, D. and Kessler, H. (2007). *Methods Enzymol* 426:463-503 and Takada et. al. (2007). *Genome Biol* 8:215; for lipid raft-associating domains, Browman et. al. 2007). *Trends Cell Biol* 17:394-402; Harder, T. (2004). *Curr Opin Immunol* 16:353-9; Hayashi, T. and Su, T. P. (2005). *Life Sci* 77:1612-24; Holowka, D. and Baird, B. (2001). *Semin Immunol* 13:99-105; Wollscheid et. al. (2004) *Subcell Biochem* 37:121-52).

Extracellular domains include portions of a cell surface molecule, and in particularly preferred embodiments cell surface molecules that are integral membrane proteins or that comprise a plasma membrane spanning transmembrane domain, that extend beyond the outer leaflet of the plasma membrane phospholipid bilayer when the molecule is expressed at a cell surface, preferably in a manner that exposes the extracellular domain portion of such a molecule to the external environment of the cell, also known as the extracellular milieu. Methods for determining whether a portion of a cell surface molecule comprises an extracellular domain are well known to the art and include experimental determination (e.g., direct or indirect labeling of the molecule, evaluation of whether the molecule can be structurally altered by agents to which the plasma membrane is not permeable such as proteolytic or lipolytic enzymes) or topological prediction based on the structure of the molecule (e.g., analysis of the amino acid sequence of a polypeptide) or other methodologies.

Host Cells

According to particularly preferred embodiments a host cell is capable of utilizing recombination signals and undergoing RAG-1/RAG-2 mediated recombination and, more importantly, the recombination is controlled. Preferably the host cell is capable of cell divisions without recombination. For example, in certain embodiments one nucleic acid composition as provided herein may be introduced into a host cell, or in certain other embodiments two or more nucleic acid compositions as provided herein may be introduced into a host cell sequentially and in any order, under conditions and for a time sufficient for chromosomal integration of the nucleic acid composition(s), to obtain one, two or more chromosomally integrated nucleic acid compositions that can undergo at least two or more recombination events in the cell to form a recombined polynucleotide that encodes an immunoglobulin polypeptide, wherein less than one of said recombination events occurs per cell cycle of the host cell. As described herein, these and related embodiments permit expansion of the host cell population prior to the completion of recombination events that give rise to functionally recombined artificial immunoglobulin genes, to obtain a host cell population having immunoglobulin structural diversity.

Control of recombination in such host cells may be achieved according to the compositions and methods described herein, including but not limited to the use of an operably linked recombination control element (e.g., an inducible recombination control element, which may be a tightly regulated inducible recombination control element), and/or through the use of one or more low efficiency RSSs in the nucleic acid composition(s), and/or through the use of low host cell expression levels of one or more of RAG1 or RAG-2, and/or through design of the nucleic acid composition to integrate at a chromosomal integration site offering poor accessibility to host cell recombination mechanisms (e.g., RAG1, RAG-2).

Cell lines to be used as host cells may in certain preferred embodiments additionally contain a functional TdT gene that may be expressed to provide additional diversity at the junctions (e.g., D-J and V-D junctions).

Cell lines may in certain embodiments be pre-B cells or pre-T cells that express these immunoglobulin gene rearrangement-competent cell-specific proteins (e.g., are capable of being induced to express RAG1, RAG-2 and TdT, or alternatively, constitutively express RAG1, RAG-2 and TdT but can be modified to substantially impair the expression of one, two or all three of these enzymes), or genes encoding each of these recombination-associated enzymes can be introduced into a non-B cell expression host cell, for example CHO or 293 cells. For RAG1/2 (also sometimes referred to as RAG-1 and Rag-2, see, e.g., Schatz, D G et. al. (1989) *Cell* 59:1035-48; Oettinger, M. A. et. al. (1990) *Science* 248:1517-23; for TdT see, e.g., That, T. H. & Kearney, J. F. (2004). *J Immunol* 173:4009-19; Koiwai, O. et. al. (1987). *Biochem Biophys Res Commun* 144:185-90; Peterson, R. C. et. al. (1984). *Proc Natl Acad Sci USA* 81:4363-7; for transfection of a host cell with all three of RAG-1, RAG-2 and TdT see, e.g., U.S. Pat. No. 5,756,323.

These and other host cells may be used according to contemplated embodiments of the present invention. For example, it has also been observed that expression of RAG-1 and/or RAG-2 is not restricted to immature developing B-cells in the bone marrow and pre-T cells of the developing thymus, but can also be observed in mature B-cells in vivo and in vitro (Maes et al., 2000 *J Immunol.* 165:703; Hikida et al., 1998 *J Exp Med.* 187:795; Casillas et. al., 1995 *Mol Immunol.* 32:167; Rathbun et. al., 1993 *Int Immunol.* 5:997, Hikida et. al., 1996 *Science* 274:2092). Cell lines have also been shown to continue recombination in vitro and undergo light chain replacement (Maes et. al. 2000 *J Immunol.* 165:703). The secondary rearrangement of Ig genes is speculated to promote receptor editing and has been shown to occur in the germinal centers of secondary lymphoid tissue like the lymph node. IL-6 has been shown to have a role in the regulation of RAG-1 and RAG-2 in mature B-cells in both inducing and terminating expression of the recombinase for secondary rearrangements. (Hillion et. al. 2007 *J Immunol.* 179:6790)

In addition to mature B-cells undergoing secondary rearrangement, RAG-1 and RAG-2 have also been shown to be expressed in mature T-cell lines including Jurkat T-cells. CEM cells have been shown to have V(D)J recombination activity using extrachromosomal substrates (Gauss et. al. 1998 *Eur J Immunol.* 28:351). Treatment of wild-type Jurkat T cells with chemical inhibitors of signaling components revealed that inhibition of Src family kinases using PP2, FK506 etc. overcame the repression of RAG-1 and resulted in increased RAG-1 expression. Mature T-cells have also been shown to reactivate recombination with treatment of anti-CD3/IL7 (Lantelme et. al. 2008 *Mol Immunol.* 45:328).

Recently, tumor cells of non-lymphoid origin have also been shown to express RAG-1 and RAG-2 (Zheng et. al. (2007 Mol Immunol. 44: 2221, Chen et. al. (2007 Faseb J. 21: 2931). Accordingly and without wishing to be restricted by theory, these cells may also be suitable for use as host cells in the presently described in vitro system for generating immunoglobulin structural diversity. According to related embodiments that are contemplated herein, reactivation of V(D)J recombination would provide another approach to generating a suitable host cell with inducible recombinase expression. Use of other host cells is contemplated according to certain embodiments, which may vary depending on the particular mammalian immunoglobulin genes that are employed or for other reasons, including a human cell, a non-human primate cell, a camelid cell, a hamster cell, a mouse cell, a rat cell, a rabbit cell, a canine cell, a feline cell, an equine cell, a bovine cell and an ovine cell.

Alternatively, only one of the RAG-1, or RAG-2 genes may be stably integrated into a host cell, and the other gene can be introduced by transfection to regulate whether or not recombination can take place. For example, a cell line that is stably transfected with TdT and RAG-2 would be recombinationally silent. Upon transient transfection with RAG-1, or viral infection with RAG-1, the cell lines would become recombinationally active. The skilled person will appreciate from these illustrative examples that other similar approaches may be used to control the onset of recombination in a host cell.

Another approach may be to use specific small interfering RNA (siRNA) to repress the expression in a host cell of RAG-1 and/or RAG-2 by RNA interference (RNAi) (including specific siRNAs the biosynthesis of which within a cell may be directed by introduced encoding DNA vectors having regulatory elements for controlling siRNA production), and then to relieve such repression when it is desired to induce recombination.

For instance, in certain such embodiments a cell line in which active RAG-1- and/or RAG-2-specific siRNA expression is present will be recombinationally silent. Activation of recombination occurs when RAG-1- and/or RAG-2-specific siRNA expression is shut off or repressed. Regulation of such siRNA expression may be achieved using inducible systems like the Tet system or other similar expression-regulating components. These include the Tet/on and Tet/off system (Clontech Inc., Palo Alto, Calif.), the Regulated Mammalian Expression system (Promega, Madison, Wis.), and the GeneSwitch System (Invitrogen Life Technologies, Carlsbad, Calif.). Alternatively, host cells may be transfected with an expression vector that encodes a repressing protein that prevents transcription of the inhibiting RNA.

In yet another alternative embodiment according to which RAG-1- and/or RAG-2-specific siRNA expression may regulate the recombination competence of the host cell, deletion of the introduced siRNA encoding sequences by use of the Cre/Lox recombinase system (e.g., Sauer, 1998 *Methods* 14:381; Kaczmarczyk et al., 2001 *Nucleic Acids Res* 29:E56; Sauer, 2002 *Endocrine* 19:221; Kondo et al., 2003 *Nucleic Acids Res* 31:e76) may also permit activation of recombination mechanisms. Activation of recombination capability in a host cell may also be achieved by transfecting or infecting an expression construct containing the repressed gene with modified codons so that it is not inhibited by the siRNA molecules.

Substantial impairment of the expression of one or more recombination control elements (e.g., a RAG-1 gene, or RAG-2 gene) may be achieved by any of a variety of methods that are well known in the art for blocking specific gene expression, including antisense inhibition of gene expression, ribozyme mediated inhibition of gene expression, siRNA mediated inhibition of gene expression, cre recombinase regulation of expression control elements using the Cre/Lox system in the design of constructs encoding one or more recombination control elements, or other molecular regulatory strategies. As used herein, expression of a gene encoding a recombination control element is substantially impaired by any such method for inhibiting when host cells are substantially but not necessarily completely depleted of functional DNA or functional mRNA encoding the recombination control element, or of the relevant RAG-1, or RAG-2 polypeptide. Recombination control element expression is substantially impaired when cells are preferably at least 50% depleted of DNA or mRNA encoding the endogenous RAG-1, and/or RAG-2 polypeptide (as detected using high stringency hybridization) or 50% depleted of detectable RAG-1 and/or RAG-2 polypeptide (e.g., as measured by Western immunoblot); and more preferably at least 75% depleted of detectable RAG-1, and/or RAG-2 polypeptide. Most preferably, recombination control element expression is substantially impaired when host cells are depleted of >90% of their endogenous RAG-1 and/or RAG-2 DNA, mRNA, or polypeptide.

It will be appreciated that certain embodiments disclosed herein relate to the use of nucleic vectors for the assembly of the nucleic acid compositions for generating immunoglobulin structural diversity, and also for RAG-1, RAG-2 and/or TdT gene expression and for regulatory constructs such as siRNA regulators of RAG-1, RAG-2 and/or TdT expression. A wide variety of suitable nucleic acid vectors are known in the art and may be employed as described or according to conventional procedures, including modifications, as described for example in Sambrook et al., Molecular Cloning: A Laboratory Manual, Cold Spring Harbor Laboratories, Cold Spring Harbor, N.Y., 1989; Ausubel et al., Current Protocols in Molecular Biology, Greene Publ. Assoc. Inc. & John Wiley & Sons, Inc., Boston, Mass., 1993); Maniatis et al. (Molecular Cloning, Cold Spring Harbor Laboratory, Plainview, N.Y., 1982) and elsewhere.

Other vectors that may be adapted for use according to certain herein disclosed embodiments include those described by Choi, S. & Kim, U. J. (2001) 175:57-68; Fabb, S. A. & Ragoussis, J. (1995) *Mol Cell Biol Hum Dis Ser* 5:104-24; Monaco, Z. L. & Moralli, D. (2006). *Biochem Soc Trans* 34:324-7; Ripoll et. al. (1998). *Gene* 210:163-72. Also contemplated are the use of protoplast fusion systems such as those described by Caporale et. al. (1990). *Gene* 87:285-9; Ferguson et. al. (1986). *J Biol Chem* 261:14760-3, Sandri-Goldin et. al. (1981). *Mol Cell Biol* 1:743-52; and yeast artificial chromosome (YAC) spheroblast fusion as described by Davies, N. P. and Huxley, C. (1996). *Methods Mol Biol* 54:281-92; Gnirke et. al (1991). *Embo J* 10:1629-34; Ikeno et. al. (1998). *Nat Biotechnol* 16:431-9; Jakobovits, A et. al. (1993). *Nature* 362:255-8; Pavan et. al. (1990). *Mol Cell Biol* 10:4163-9. In preferred embodiments the nucleic acid compositions for generating immunoglobulin structural diversity as provided herein are stably integrated into host cell chromosomes using known methodologies and where such integration can be confirmed according to established techniques (e.g., Sambrook et al., 1989; Ausubel et al., 1993; Maniatis et al. 1982). Related embodiments contemplate chromosomal EBV elements that mediate integration, and other embodiments contemplate extrachromosomal maintenance of natural or artificial centromere-containing constructs.

The appropriate DNA sequence(s) may be inserted into the vector by a variety of procedures. In general, the DNA sequence is inserted into an appropriate restriction endonuclease site(s) by procedures known in the art. Standard techniques for cloning, DNA isolation, amplification and purification, for enzymatic reactions involving DNA ligase, DNA polymerase, restriction endonucleases and the like, and various separation techniques are those known and commonly employed by those skilled in the art. A number of standard techniques are described, for example, in Ausubel et al. (1993 *Current Protocols in Molecular Biology*, Greene Publ. Assoc. Inc. & John Wiley & Sons, Inc., Boston, Mass.); Sambrook et al. (1989 *Molecular Cloning*, Second Ed., Cold Spring Harbor Laboratory, Plainview, N.Y.); Maniatis et al. (1982 Molecular Cloning, Cold Spring Harbor Laboratory, Plainview, N.Y.); and elsewhere.

The DNA sequence in the vector (e.g., an expression vector) is operatively linked to at least one appropriate expression control sequences (e.g., a promoter or a regulated promoter) to direct mRNA synthesis. Representative examples of such expression control sequences include LTR or SV40 promoter, the *E. coli* lac or trp, the phage lambda $P_L$ promoter and other promoters known to control expression of genes in prokaryotic or eukaryotic cells or their viruses. Promoter regions can be selected from any desired gene using CAT (chloramphenicol transferase) vectors or other vectors with selectable markers. Two appropriate vectors are pKK232-8 and pCM7. Particular named bacterial promoters include lac, lacZ, T3, T7, gpt, lambda $P_R$, $P_L$ and trp. Eukaryotic promoters include CMV immediate early, HSV thymidine kinase, early and late SV40, LTRs from retrovirus, and mouse metallothionein-I. Selection of the appropriate vector and promoter is well within the level of ordinary skill in the art, and preparation of certain particularly preferred recombinant expression constructs comprising at least one promoter or regulated promoter operably linked to a nucleic acid encoding an immunoglobulin region.

In certain preferred embodiments the expression control sequence is a "regulated promoter", which may be a promoter as provided herein and may also be a repressor binding site, an activator binding site or any other regulatory sequence that controls expression of a nucleic acid sequence as provided herein. In certain particularly preferred embodiments the regulated promoter is a tightly regulated promoter that is specifically inducible and that permits little or no transcription of nucleic acid sequences under its control in the absence of an induction signal, as is known to those familiar with the art and described, for example, in Guzman et al. (1995 *J.*

*Bacteriol.* 177:4121), Carra et al. (1993 *EMBO J.* 12:35), Mayer (1995 *Gene* 163:41), Haldimann et al. (1998 *J. Bacteriol.* 180:1277), Lutz et al. (1997 *Nuc. Ac. Res.* 25:1203), Allgood et al. (1997 *Curr. Opin. Biotechnol.* 8:474) and Makrides (1996 *Microbiol. Rev.* 60:512), all of which are hereby incorporated by reference. In other preferred embodiments of the invention a regulated promoter is present that is inducible but that may not be tightly regulated. In certain other preferred embodiments a promoter is present in the recombinant expression construct of the invention that is not a regulated promoter; such a promoter may include, for example, a constitutive promoter such as an insect polyhedrin promoter. The expression construct also contains a ribosome binding site for translation initiation and a transcription terminator. The vector may also include appropriate sequences for amplifying expression.

Transcription of the DNA encoding the polypeptides of the present invention by higher eukaryotes may be increased by inserting an enhancer sequence into the vector. Enhancers are cis-acting elements of DNA, usually about from 10 to 300 bp that act on a promoter to increase its transcription. Examples including the SV40 enhancer on the late side of the replication origin bp 100 to 270, a cytomegalovirus early promoter enhancer, the polyoma enhancer on the late side of the replication origin, and adenovirus enhancers.

As noted above, in certain embodiments the vector may be a viral vector such as a retroviral vector. For example, retroviruses from which the retroviral plasmid vectors may be derived include, but are not limited to, Moloney Murine Leukemia Virus, spleen necrosis virus, retroviruses such as Rous Sarcoma Virus, Harvey Sarcoma virus, avian leukosis virus, gibbon ape leukemia virus, human immunodeficiency virus, adenovirus, Myeloproliferative Sarcoma Virus, and mammary tumor virus.

The viral vector includes one or more promoters. Suitable promoters which may be employed include, but are not limited to, the retroviral LTR; the SV40 promoter; and the human cytomegalovirus (CMV) promoter described in Miller, et al., *Biotechniques* 7:980-990 (1989), or any other promoter (e.g., cellular promoters such as eukaryotic cellular promoters including, but not limited to, the histone, pol III, and β-actin promoters). Other viral promoters which may be employed include, but are not limited to, adenovirus promoters, thymidine kinase (TK) promoters, and B19 parvovirus promoters. The selection of a suitable promoter will be apparent to those skilled in the art from the teachings contained herein, and may be from among either regulated promoters or promoters as described above.

The retroviral plasmid vector is employed to transduce packaging cell lines to form producer cell lines. Examples of packaging cells which may be transfected include, but are not limited to, the PE501, PA317, ψ-2, ψ-AM, PA12, T19-14X, VT-19-17-H2, ψCRE, ψCRIP, GP+E-86, GP+envAm12, and DAN cell lines as described in Miller, *Human Gene Therapy*, 1:5-14 (1990), which is incorporated herein by reference in its entirety. The vector may transduce the packaging cells through any means known in the art. Such means include, but are not limited to, electroporation, the use of liposomes, and CaPO$_4$ precipitation. In one alternative, the retroviral plasmid vector may be encapsulated into a liposome, or coupled to a lipid, and then administered to a host.

The producer cell line generates infectious retroviral vector particles which include the nucleic acid sequence(s) encoding the immunoglobulin polypeptides or fusion proteins. Such retroviral vector particles then may be employed, to transduce eukaryotic cells, either in vitro or in vivo. The transduced eukaryotic cells will express the nucleic acid sequence(s) encoding the immunoglobulin polypeptide or fusion protein. Eukaryotic cells which may be transduced include, but are not limited to, embryonic stem cells, embryonic carcinoma cells, as well as hematopoietic stem cells, hepatocytes, fibroblasts, myoblasts, keratinocytes, endothelial cells, and bronchial epithelial cells.

As described herein, certain embodiments relate to compositions that are capable of delivering nucleic acid molecules comprising mammalian immunoglobulin gene regions and/or encoding immunoglobulin fusion proteins. Such compositions include recombinant viral vectors (e.g., retroviruses (see WO 90/07936, WO 91/02805, WO 93/25234, WO 93/25698, and WO 94/03622), adenovirus (see Berkner, *Biotechniques* 6:616-627, 1988; Li et al., *Hum. Gene Ther.* 4:403-409, 1993; Vincent et al., *Nat. Genet.* 5:130-134, 1993; and Kolls et al., *Proc. Natl. Acad. Sci. USA* 91:215-219, 1994), pox virus (see U.S. Pat. No. 4,769,330; U.S. Pat. No. 5,017,487; and WO 89/01973)), recombinant expression construct nucleic acid molecules complexed to a polycationic molecule (see WO 93/03709), and nucleic acids associated with liposomes (see Wang et al., *Proc. Natl. Acad. Sci. USA* 84:7851, 1987). In certain embodiments, the DNA may be linked to killed or inactivated adenovirus (see Curiel et al., *Hum. Gene Ther.* 3:147-154, 1992; Cotton et al., *Proc. Natl. Acad. Sci. USA* 89:6094, 1992). Other suitable compositions include DNA-ligand (see Wu et al., *J. Biol. Chem.* 264:16985-16987, 1989) and lipid-DNA combinations (see Felgner et al., *Proc. Natl. Acad. Sci. USA* 84:7413-7417, 1989).

Various mammalian cell culture systems can also be employed to express recombinant protein. Examples of mammalian expression systems include the COS-7 lines of monkey kidney fibroblasts, described by Gluzman, *Cell* 23:175 (1981), and other cell lines capable of expressing a compatible vector, for example, the C127, 3T3, CHO, HeLa and BHK cell lines. Mammalian expression vectors will comprise an origin of replication, a suitable promoter and enhancer, and also any necessary ribosome binding sites, polyadenylation site, splice donor and acceptor sites, transcriptional termination sequences, and 5' flanking nontranscribed sequences, for example as described herein regarding the preparation of immunoglobulin or immunoglobulin fusion expression constructs. DNA sequences derived from the SV40 splice, and polyadenylation sites may be used to provide the required nontranscribed genetic elements. Introduction of the construct into the host cell can be effected by a variety of methods with which those skilled in the art will be familiar, including but not limited to, for example, calcium phosphate transfection, DEAE-Dextran mediated transfection, or electroporation (Davis et al., 1986 *Basic Methods in Molecular Biology*). Additional methods include spheroplast fusion and protoplast fusion.

Nucleic Acids

The nucleic acids of the present invention, also referred to herein as polynucleotides, may be in the form of RNA or in the form of DNA, which DNA includes cDNA, genomic DNA, and synthetic DNA. The DNA may be double-stranded or single-stranded, and if single stranded may be the coding strand or non-coding (anti-sense) strand. A coding sequence which encodes an immunoglobulin or a region thereof (e.g., a V region, a D segment, a J region, a C region, etc.) or an immunoglobulin fusion polypeptide for use according to the present embodiments may be identical to the coding sequence known in the art for any given immunoglobulin gene regions or fusion polypeptide domains (e.g., membrane anchor domains, extracellular domain-associating polypeptides, etc.), or may be a different coding sequence, which, as a result of the redundancy or degeneracy of the genetic code, encodes the same immunoglobulin region or fusion polypeptide.

The term "isolated" means that the material is removed from its original environment (e.g., the natural environment if it is naturally occurring). For example, a naturally occurring nucleic acid or polypeptide present in a living animal is not isolated, but the same nucleic acid or polypeptide, separated from some or all of the co-existing materials in the natural system, is isolated. Such nucleic acids could be part of a vector and/or such nucleic acids or polypeptides could be part of a composition, and still be isolated in that such vector or composition is not part of its natural environment.

The term "gene" means the segment of DNA involved in producing a polypeptide chain; it includes regions preceding and following the coding region "leader and trailer" as well as intervening sequences (introns) between individual coding segments (exons), and may also include regulatory elements (e.g., promoters, enhancers, repressor binding sites and the like), and may also include recombination signal sequences (RSSs) as described herein.

The nucleic acids for use according to the embodiments described herein may include, but are not limited to: only the coding sequence for an immunoglobulin or immunoglobulin fusion polypeptide; the coding sequence for the immunoglobulin or immunoglobulin fusion polypeptide and additional coding sequence; the coding sequence for the immunoglobulin or immunoglobulin fusion polypeptide (and optionally additional coding sequence) and non-coding sequence, such as introns or non-coding sequences 5' and/or 3' of the coding sequence for the immunoglobulin or immunoglobulin fusion polypeptide, which for example may further include but need not be limited to one or more regulatory nucleic acid sequences that may be a regulated or regulatable promoter, enhancer, other transcription regulatory sequence, repressor binding sequence, translation regulatory sequence or any other regulatory nucleic acid sequence. Thus, the term "nucleic acid encoding" or "polynucleotide encoding" an immunoglobulin or immunoglobulin fusion protein encompasses a nucleic acid which includes only coding sequence for an immunoglobulin or immunoglobulin fusion polypeptide as well as a nucleic acid which includes additional coding and/or non-coding sequence(s).

Nucleic acids and oligonucleotides for use as described herein can be synthesized by any method known to those of skill in this art (see, e.g., WO 93/01286, U.S. application Ser. No. 07/723,454; U.S. Pat. No. 5,218,088; U.S. Pat. No. 5,175, 269; U.S. Pat. No. 5,109,124). Identification of oligonucleotides and nucleic acid sequences for use in the present invention involves methods well known in the art. For example, the desirable properties, lengths and other characteristics of useful oligonucleotides are well known. In certain embodiments, synthetic oligonucleotides and nucleic acid sequences may be designed that resist degradation by endogenous host cell nucleolytic enzymes by containing such linkages as: phosphorothioate, methylphosphonate, sulfone, sulfate, ketyl, phosphorodithioate, phosphoramidate, phosphate esters, and other such linkages that have proven useful in antisense applications (see, e.g., Agrwal et al., *Tetrehedron Lett.* 28:3539-3542 (1987); Miller et al., *J. Am. Chem. Soc.* 93:6657-6665 (1971); Stec et al., *Tetrehedron Lett.* 26:2191-2194 (1985); Moody et al., *Nucl. Acids Res.* 12:4769-4782 (1989); Uznanski et al., *Nucl. Acids Res.* (1989); Letsinger et al., *Tetrahedron* 40:137-143 (1984); Eckstein, *Annu. Rev. Biochem.* 54:367-402 (1985); Eckstein, *Trends Biol. Sci.* 14:97-100 (1989); Stein In: *Oligodeoxynucleotides. Antisense Inhibitors of Gene Expression*, Cohen, Ed, Macmillan Press, London, pp. 97-117 (1989); Jager et al., *Biochemistry* 27:7237-7246 (1988)).

As known in the art "similarity" between two polypeptides is determined by comparing the amino acid sequence and conserved amino acid substitutes thereto of the polypeptide to the sequence of a second polypeptide. Fragments or portions of the nucleic acids encoding polypeptides of the present invention may be used to synthesize full-length nucleic acids of the present invention. As used herein, "% identity" refers to the percentage of identical amino acids situated at corresponding amino acid residue positions when two or more polypeptide are aligned and their sequences analyzed using a gapped BLAST algorithm (e.g., Altschul et al., 1997 *Nucl. Ac. Res.* 25:3389) which weights sequence gaps and sequence mismatches according to the default weightings provided by the National Institutes of Health/NCBI database (Bethesda, Md.; see ncbi.nlm.nih.gov/cgi-bin/BLAST/nph-newblast).

Determination of the three-dimensional structures of representative polypeptides (e.g., immunoglobulins, membrane anchor domain polypeptides, specific protein-protein association domains, etc.) may be made through routine methodologies such that substitution of one or more amino acids with selected natural or non-natural amino acids can be virtually modeled for purposes of determining whether a so derived structural variant retains the space-filling properties of presently disclosed species. See, for instance, Donate et al., 1994 *Prot. Sci.* 3:2378; Bradley et al., *Science* 309: 1868-1871 (2005); Schueler-Furman et al., *Science* 310:638 (2005); Dietz et al., *Proc. Nat. Acad. Sci. USA* 103:1244 (2006); Dodson et al., *Nature* 450:176 (2007); Qian et al., *Nature* 450:259 (2007). Some additional non-limiting examples of computer algorithms that may be used for these and related embodiments, such as for rational design of membrane anchor domains or specific protein-protein association domains as provided herein, include Desktop Molecular Modeler (See, for example, Agboh et al., *J. Biol. Chem.,* 279, 40: 41650-57 (2004)), which allows for determining atomic dimensions from spacefilling models (van der Waals radii) of energy-minimized conformations; GRID, which seeks to determine regions of high affinity for different chemical groups, thereby enhancing binding, Monte Carlo searches, which calculate mathematical alignment, and CHARMM (Brooks et al. (1983) *J. Comput. Chem.* 4:187-217) and AMBER (Weiner et al (1981) *J. Comput. Chem.* 106: 765), which assess force field calculations, and analysis (see also, Eisenfield et al. (1991) *Am. J. Physiol.* 261:C376-386; Lybrand (1991) *J. Pharm. Belg.* 46:49-54; Froimowitz (1990) *Biotechniques* 8:640-644; Burbam et al. (1990) *Proteins* 7:99-111; Pedersen (1985) *Environ. Health Perspect.* 61:185-190; and Kini et al. (1991) *J. Biomol. Struct. Dyn.* 9:475-488).

A truncated molecule may be any molecule that comprises less than a full length version of the molecule. Truncated molecules provided by the present invention may include truncated biological polymers, and in preferred embodiments of the invention such truncated molecules may be truncated nucleic acid molecules or truncated polypeptides. Truncated nucleic acid molecules have less than the full length nucleotide sequence of a known or described nucleic acid molecule, where such a known or described nucleic acid molecule may be a naturally occurring, a synthetic or a recombinant nucleic acid molecule, so long as one skilled in the art would regard it as a full length molecule. Thus, for example, truncated nucleic acid molecules that correspond to a gene sequence contain less than the full length gene where the gene comprises coding and non-coding sequences, promoters, enhancers and other regulatory sequences, flanking sequences and the like, and other functional and non-functional sequences that are recognized as part of the gene. In another example, truncated nucleic acid molecules that correspond to a mRNA sequence contain less than the full length mRNA transcript, which may include various translated and non-translated regions as well as other functional and non-functional sequences.

In other preferred embodiments, truncated molecules are polypeptides that comprise less than the full length amino acid sequence of a particular protein or polypeptide component. As used herein "deletion" has its common meaning as understood by those familiar with the art, and may refer to molecules that lack one or more of a portion of a sequence from either terminus or from a non-terminal region, relative to a corresponding full length molecule, for example, as in the case of truncated molecules provided herein. Truncated molecules that are linear biological polymers such as nucleic acid molecules or polypeptides may have one or more of a deletion from either terminus of the molecule or a deletion from a non-terminal region of the molecule, where such deletions may be deletions of 1-1500 contiguous nucleotide or amino acid residues, preferably 1-500 contiguous nucleotide or amino acid residues and more preferably 1-300 contiguous nucleotide or amino acid residues, including deletions of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31-40, 41-50, 51-74, 75-100, 101-150, 151-200, 201-250 or 251-299 contiguous nucleotide or amino acid residues. In certain particularly preferred embodiments truncated nucleic acid molecules may have a deletion of 270-330 contiguous nucleotides. In certain other particularly preferred embodiments truncated polypeptide molecules may have a deletion of 80-140 contiguous amino acids.

The present invention further relates to variants of the herein referenced nucleic acids which encode fragments, analogs and/or derivatives of an immunoglobulin or immunoglobulin fusion polypeptide. The variants of the nucleic acids encoding such polypeptides may be naturally occurring allelic variants of the nucleic acids or non-naturally occurring variants. As is known in the art, an allelic variant is an alternate form of a nucleic acid sequence which may have at least one of a substitution, a deletion or an addition of one or more nucleotides, any of which does not substantially alter the function of the encoded polypeptide.

Variants and derivatives of immunoglobulin or immunoglobulin fusion polypeptide may be obtained by mutations of nucleotide sequences encoding such polypeptides or any portion thereof. Alterations of the native amino acid sequence may be accomplished by any of a number of conventional methods. Mutations can be introduced at particular loci by synthesizing oligonucleotides containing a mutant sequence, flanked by restriction sites enabling ligation to fragments of the native sequence. Following ligation, the resulting reconstructed sequence encodes an analog having the desired amino acid insertion, substitution, or deletion.

Alternatively, oligonucleotide-directed site-specific mutagenesis procedures can be employed to provide an altered gene wherein predetermined codons can be altered by substitution, deletion or insertion. Exemplary methods of making such alterations are disclosed by Walder et al. (*Gene* 42:133, 1986); Bauer et al. (*Gene* 37:73, 1985); Craik (*BioTechniques*, January 1985, 12-19); Smith et al. (*Genetic Engineering: Principles and Methods BioTechniques*, January 1985, 12-19); Smith et al. (*Genetic Engineering: Principles and Methods*, Plenum Press, 1981); Kunkel (*Proc. Natl. Acad. Sci. USA* 82:488, 1985); Kunkel et al. (*Methods in Enzymol.* 154:367, 1987); and U.S. Pat. Nos. 4,518,584 and 4,737,462.

As an example, modification of DNA may be performed by site-directed mutagenesis of DNA encoding the protein combined with the use of DNA amplification methods using primers to introduce and amplify alterations in the DNA template, such as PCR splicing by overlap extension (SOE). Site-directed mutagenesis is typically effected using a phage vector that has single- and double-stranded forms, such as M13 phage vectors, which are well-known and commercially available. Other suitable vectors that contain a single-stranded phage origin of replication may be used (see, e.g., Veira et al., *Meth. Enzymol.* 15:3, 1987). In general, site-directed mutagenesis is performed by preparing a single-stranded vector that encodes the protein of interest. An oligonucleotide primer that contains the desired mutation within a region of homology to the DNA in the single-stranded vector is annealed to the vector followed by addition of a DNA polymerase, such as *E. coli* DNA polymerase I (Klenow fragment), which uses the double stranded region as a primer to produce a heteroduplex in which one strand encodes the altered sequence and the other the original sequence. The heteroduplex is introduced into appropriate bacterial cells and clones that include the desired mutation are selected. The resulting altered DNA molecules may be expressed recombinantly in appropriate host cells to produce the modified protein.

Equivalent DNA constructs that encode various additions or substitutions of amino acid residues or sequences, or deletions of terminal or internal residues or sequences not needed for biological activity are also encompassed by the invention. For example, sequences encoding Cys residues that are not desirable or essential for biological activity can be altered to cause the Cys residues to be deleted or replaced with other amino acids, preventing formation of incorrect or undesirable intramolecular disulfide bridges upon renaturation.

Immunoglobulins

As described herein and as also known in the art, immunoglobulins comprise products of a gene family the members of which exhibit a high degree of sequence conservation, such that amino acid sequences of two or more immunoglobulins or immunoglobulin domains or regions or portions thereof (e.g., VH domains, VL domains, hinge regions, CH2 constant regions, CH3 constant regions) can be aligned and analyzed to identify portions of such sequences that correspond to one another, for instance, by exhibiting pronounced sequence homology. (See, e.g., Kabat et al., *Sequences of Proteins of Immunological Interest*, Edition: 5, 1992 DIANE Publishing, 1992, Darby, Pa.; Tomlinson et al., 1992 *J Mol Biol* 227:776; Milner et al., 1995 *Ann N Y Acad Sci* 764:50.) Determination of sequence homology may be readily determined with any of a number of sequence alignment and analysis tools, including computer algorithms well known to those of ordinary skill in the art, such as Align or the BLAST algorithm (Altschul, *J. Mol. Biol.* 219:555-565, 1991; Henikoff and Henikoff, *Proc. Natl. Acad. Sci. USA* 89:10915-10919, 1992), which is available at the NCBI website (ncbi.nlm.nih.gov/cgi-bin/BLAST). Default parameters may be used.

Portions of a particular immunoglobulin reference sequence and of any one or more additional immunoglobulin sequences of interest that may be compared to the reference sequence are regarded as "corresponding" sequences, regions, fragments or the like, based on the convention for numbering immunoglobulin amino acid positions according to Kabat, *Sequences of Proteins of Immunological Interest*, ($5^{th}$ ed. Bethesda, Md.: Public Health Service, National Institutes of Health (1991)). For example, according to this convention, the immunoglobulin family to which an immunoglobulin sequence of interest belongs is determined based on conservation of variable region polypeptide sequence invariant amino acid residues, to identify a particular numbering system for the immunoglobulin family, and the sequence(s) of interest can then be aligned to assign sequence position numbers to the individual amino acids which comprise such sequence(s). Preferably at least 70%, more preferably at least 80%-85% or 86%-89%, and still more preferably at least 90%, 92%, 94%, 96%, 98% or 99% of the amino acids in a given amino acid sequence of at least 1000, more preferably 700-950, more preferably 350-700, still more preferably 100-350, still more preferably 80-100, 70-80, 60-70, 50-60, 40-50 or 30-40 consecutive amino acids of a sequence, are identical to the amino acids located at corresponding positions in a reference sequence such as those disclosed by Kabat et al. (1991) or Kabat et al. (1992) or in a similar compendium of related immunoglobulin sequences, such as may be generated from public databases (e.g., Genbank, SwissProt, etc.) using sequence alignment tools as described above. In certain preferred embodiments, an immunoglobulin sequence of interest or a region, portion, derivative or fragment thereof is greater than 95% identical to a corresponding reference sequence, and in certain preferred embodiments such a sequence of interest may differ from a corresponding reference at no more than 1, 2, 3, 4, 5, 6, 7, 8, 9 or 10 amino acid positions.

Human immunoglobulin gene libraries are currently generated by any number of techniques with which those having ordinary skill in the art will be familiar. Such methods include but are not limited to, Epstein Barr Virus (EBV) transformation of human peripheral blood cells (e.g., containing B lymphocytes), in vitro immunization of human B cells, fusion of spleen cells from immunized transgenic mice carrying human immunoglobulin genes inserted by yeast artificial chromosomes (YAC), isolation from human immunoglobulin V region phage libraries, or other procedures as known in the art and based on the disclosure herein. See, e.g., U.S. Pat. No. 5,877,397; Bruggemann et al., 1997 *Curr. Opin. Biotechnol.* 8:455-58; Jakobovits et al., 1995 *Ann. N.Y. Acad. Sci.* 764: 525-35. In the described human immunoglobulin gene-carrying transgenic mice, human immunoglobulin heavy and light chain genes have been artificially introduced by genetic engineering in germlne configuration, and the endogenous murine immunoglobulin genes have been inactivated. See, e.g., Bruggemann et al., 1997 *Curr. Opin. Biotechnol.* 8:455-58. For example, human immunoglobulin transgenes may be mini-gene constructs, or transloci on yeast artificial chromosomes, which undergo B cell-specific DNA rearrangement and hypermutation in the mouse lymphoid tissue. See, Bruggemann et al., 1997 *Curr. Opin. Biotechnol.* 8:455-58.

According to certain embodiments, structurally diverse non-human, human, or humanized immunoglobulin heavy chain and/or light chain variable regions such as can be generated using the compositions and methods disclosed herein, may be constructed as single chain Fv (sFv) polypeptide fragments (single chain antibodies). See, e.g., Bird et al., 1988 *Science* 242:423-426; Huston et al., 1988 *Proc. Natl. Acad. Sci. USA* 85:5879-5883. Multi-functional sFv fusion proteins may be generated by linking a polynucleotide sequence encoding an sFv polypeptide in-frame with at least one polynucleotide sequence encoding any of a variety of known effector proteins. These methods are known in the art, and are disclosed, for example, in EP-B1-0318554, U.S. Pat. No. 5,132,405, U.S. Pat. No. 5,091,513, and U.S. Pat. No. 5,476,786. By way of example, effector proteins may include immunoglobulin constant region sequences. See, e.g., Hollenbaugh et al., 1995 *J. Immunol. Methods* 188:1-7. Other examples of effector proteins are enzymes. As a non-limiting example, such an enzyme may provide a biological activity for therapeutic purposes (see, e.g., Siemers et al., 1997 *Bioconjug Chem.* 8:510-19), or may provide a detectable activity, such as horseradish peroxidase-catalyzed conversion of any of a number of well-known substrates into a detectable product, for diagnostic uses. Still other examples of sFv fusion proteins include Ig-toxin fusions, or immunotoxins, wherein the sFv polypeptide is linked to a toxin. Those having ordinary skill in the art will appreciate that a wide variety of polypeptide sequences have been identified that, under appropriate conditions, are toxic to cells. As used herein, a toxin polypeptide for inclusion in an immunoglobulintoxin fusion protein may be any polypeptide capable of being introduced to a cell in a manner that compromises cell survival, for example, by directly interfering with a vital function or by inducing apoptosis. Toxins thus may include, for example, ribosome-inactivating proteins, such as *Pseudomonas aeruginosa* exotoxin A, plant gelonin, bryodin from *Bryonia dioica*, or the like. See, e.g., Thrush et al., 1996 *Annu. Rev. Immunol.* 14:49-71; Frankel et al., 1996 *Cancer Res.* 56:926-32. Numerous other toxins, including chemotherapeutic agents, antimitotic agents, antibiotics, inducers of apoptosis (or "apoptogens", see, e.g., Green and Reed, 1998, *Science* 281:1309-1312), or the like, are known to those familiar with the art, and the examples provided herein are intended to be illustrative without limiting the scope and spirit of the invention.

A sFv may be fused to peptide or polypeptide domains that permit detection of specific binding between the fusion protein and a desired antigen. For example, the fusion polypeptide domain may be an affinity tag polypeptide. Binding of the sFv fusion protein to a binding partner (e.g., an antigen of interest such as a diagnostic or therapeutic target molecule) may therefore be detected using an affinity polypeptide or peptide tag, such as an avidin, streptavidin or a H is (e.g., polyhistidine) tag, by any of a variety of techniques with which those skilled in the art will be familiar. Detection techniques may also include, for example, binding of an avidin or streptavidin fusion protein to biotin or to a biotin mimetic sequence (see, e.g., Luo et al., 1998 *J. Biotechnol.* 65:225 and references cited therein), direct covalent modification of a fusion protein with a detectable moiety (e.g., a labeling moiety), noncovalent binding of the fusion protein to a specific labeled reporter molecule, enzymatic modification of a detectable substrate by a fusion protein that includes a portion having enzyme activity, or immobilization (covalent or non-covalent) of the fusion protein on a solid-phase support.

The following Examples are presented by way of illustration and not limitation.

EXAMPLES

Example 1

Specific Constructs for the Recombination Control Elements and Mediators of Junctional Diversity This Example describes the sequences of the recombination control elements and mediators of junctional diversity [SEQ ID NOS:1-6]. These elements were codon optimized (Geneart, Inc., Toronto, Canada) for translation in mammalian cells and contain 5' HindIII and 3' XbaI restriction sites to facilitate cloning into expression vectors containing CMV or SV40 promoters. The RAG-1 polynucleotide [SEQ ID NO:1]

encodes human RAG-1 polypeptide [SEQ ID NO:2], and was gene optimized for expression in mammalian cells. The translation product of this construct was identical to the deduced translation of RAG-1 mRNA in the Genbank database (NM_000448). The polynucleotide sequence is provided in SEQ ID NO:1 and the amino acid sequence is provided in SEQ ID NO:2. The RAG-2 polynucleotide [SEQ ID NO:3] encodes the human RAG-2 polypeptide [SEQ ID NO:4], and was codon optimized (Geneart, Inc., Toronto, Canada) for expression in mammalian cells. The translation product of this construct was identical to the deduced translation of RAG-2 mRNA in the Genbank database (NM_000536). The polynucleotide sequence is provided in SEQ ID NO:3 and the amino acid sequence is provided in SEQ ID NO:4. ITS-5 [SEQ ID NO:5] encoded human TdT, codon optimized (Geneart, Inc., Toronto, Canada) for expression in mammalian cells. The translation product of ITS-5 was identical to the deduced translation of TdT mRNA in the Genbank sequence (NM_004088). The polynucleotide sequence is provided in SEQ ID NO:5 and the amino acid sequence is provided in SEQ ID NO:6. RAG-1 and RAG-2 were cloned into pcDNA3.1(+) (Invitrogen, Carlsbad, Calif.) and were shown to mediate VDJ recombination (described below).

Example 2

RAG-1/RAG-2 Mediated Recombination

Figure 3:
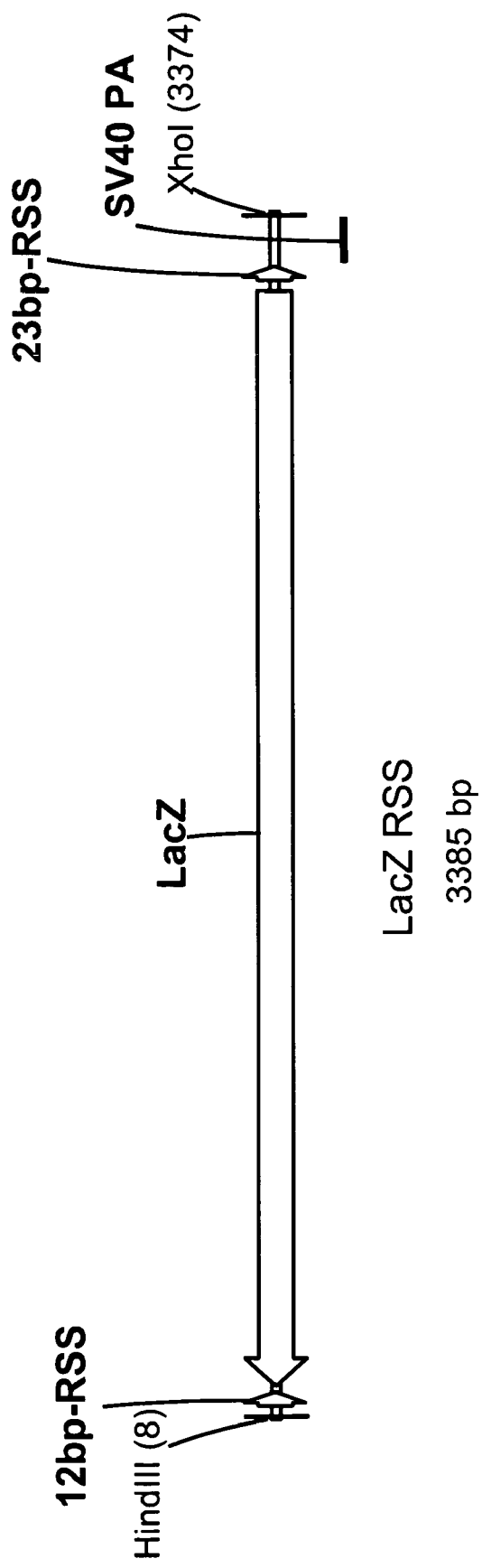
FIG. 3 shows a schematic diagram of the LacZ-RSS. The RSS with the 12 base pair recombination signal sequence and the RSS with the 23 base pair recombination signal sequence are positioned in the same orientation. The HindIII-XhoI fragment of LacZ-RSS was inserted into pcDNA3.1(+) so that the LacZ open reading frame is in the opposite orientation relative to the CMV promoter to create vector V25. V25 is an inversional VDJ substrate.

RAG-1/RAG-2 mediated recombination was targeted through cis recombination signal sequences (RSS). DNA containing the *E. coli* LacZ gene flanked by RSS sequences was custom synthesized by Geneart Inc. (Toronto, Canada) with HindIII and XhoI ends for subsequent cloning (LacZ-RSS, SEQ ID NO:7). A recombination substrate vector, V25, was generated by cloning the HindIII/XhoI restriction fragment containing coding sequence for the beta-galactosidase reporter flanked by upstream and downstream RSSs, LacZ-RSS, into plasmid vector pcDNA3.1(+) (Invitrogen, Carlsbad, Calif.). FIG. 3 shows a schematic diagram of LacZ-RSS. The polynucleotide sequence of LacZ-RSS is provided in SEQ ID NO:7 and the translated amino acid sequence is provided in SEQ ID NO:8. The recombination substrate encoded the bacterial enzyme LacZ (beta-galactosidase) and was codon optimized for expression in mammalian cells, such that the LacZ was flanked by two recombination signal sequences in the same orientation. The sequences of the RSSs were as follows:

```
12-bp RSS:
                                    [SEQ ID NO: 18]
CACAGTGCTCCAGGGCTGAACAAAAACC 23-bp RSS:
                                    [SEQ ID NO: 19]
CACAGTGGTAGTACTCCACTGTCTGGGTGTACAAAACC
```

The LacZ coding sequence was initially in the reverse orientation relative to the CMV promoter and thus no beta-galactosidase was expressed when the vector was transected into cells. An SV40 polyadenylation signal next to the 23-bp RSS ensured that unintended expression of lacZ was minimal prior to recombination. In the presence of RAG-1/RAG-2, the orientation of the LacZ coding sequence was reversed since the recombination signals were in the same orientation, generating an inversional event. Following recombination LacZ coding sequence was placed in the same orientation as the CMV promoter and beta-galactosidase was expressed. Beta-galactosidase enzymatic activity expressed by cells that had undergone RAG-1/RAG-2 mediated recombination was assayed with colorimetric β-gal substrates, by enzyme linked immunosorbent assay (ELISA) and by microscopy.

The RAG-1 and RAG-2 constructs were confirmed to mediate recombination using the following procedure. 293-H cells were transfected according to the supplier's recommendations (Invitrogen, Carlsbad, Calif., Cat. No. 11631-017). Cells were seeded at 20,000 cells/well in a tissue culture treated 96-well plate and incubated overnight. The next day, cells were transfected with Lipofectamine 2000 (Invitrogen, Carlsbad, Calif., Cat. No. 11668-019) according to the manufacturer's recommendations. Cells were transfected with 67 ng of the LacZ-RSS plasmid, 0 or 33 ng of the RAG-2 plasmid and 0, 8, 17, 33 or 67 ng of the RAG-1 plasmid. Carrier plasmid was added such that all samples received the same total amount of DNA. Two days after transfection, cell lysates were prepared and beta-galactosidase activity was determined using the calorimetric substrate chlorophenol red-β-D-galactopyranoside (Sigma, St. Louis, Mo., Cat. No. 59767-25MG-F).

Figure 4:
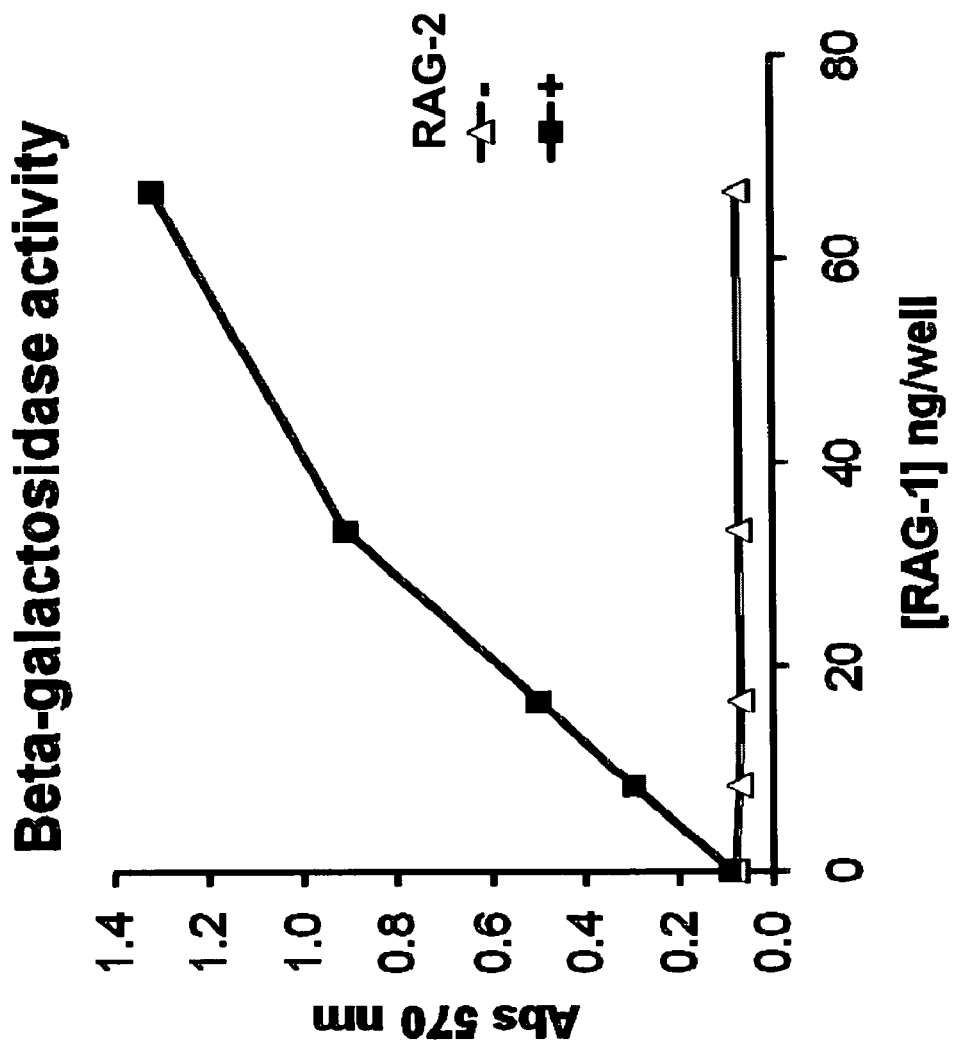
FIG. 4 shows RAG-1/RAG-2 mediated recombination of a β-gal substrate (LacZ-RSS). 293 Cells were transfected with 67 ng of the LacZ-RSS plasmid, 0 (diamonds) or 33 ng (squares) of the RAG-2 plasmid and 0, 8, 17, 33 or 67 ng of the RAG-1 plasmid. Carrier plasmid was added such that all samples received the same total amount of DNA. Two days after transfection, cell lysates were prepared and beta-galactosidase activity was determined using the calorimetric substrate chlorophenol red-β-D-galactopyranoside (Sigma, St. Louis, Mo., Cat. No. 59767-25MG-F).

The results shown in FIG. 4 demonstrated that recombination was dependent on the expression of both RAG-1 and RAG-2. The figure also shows that recombination activity increased with increasing amounts of the RAG-1 plasmid during the transfection step.

Example 3

RAG-1/RAG-2 Induced Recombination of an Integrated Substrate

A stable cell line integrated with the recombination substrate V25, prepared as described above (e.g., Example 2), was generated by transfection of HEK-293 cells with Lipofectamine™ 2000 according to the manufacturer's instructions (Invitrogen, Carlsbad, Calif.). Stable pools of transfected cells were selected using 1 mg/ml G418. Stably selected cell pools were subsequently split into a 96 well plate and 24 hours later wells were transiently transfected with equal amounts of the RAG1 and RAG2 expression vectors (RAG-1 and RAG-2 coding sequences, respectively, cloned into pcDNA3.1(+) (Invitrogen, Carlsbad, Calif.). Forty-eight hours following transfection cells were fixed and stained for beta-galactosidase activity according to the manufacturer's instructions (Cat. # K1465-01, Invitrogen, Carlsbad, Calif.), by which a detectable blue stain indicates beta-galactosidase activity.

Staining was allowed to proceed overnight. There were no blue cells observed amongst 293 cells that were stably integrated with V25 but that had not been transiently transfected with RAG-1 and RAG-2. Amongst 293 cells that were stably integrated with V25 and transiently transfected with RAG-1 and RAG-2, blue stained cells were readily detectable by light microscopy, with multiple blue stained cells observed per field. The results demonstrated that recombination of the integrated substrate was successfully induced by the transient expression of RAG-1 and RAG-2.

Example 4

Diversifying an Immunoglobulin Heavy Chain

An antibody (immunoglobulin) molecule is a heterodimer comprised of two subunits, a heavy chain and a light chain. This example demonstrates the assembly of intact antibodies as the result of the recombination of surface Ig heavy chain encoding VDJ recombination substrates in HEK-293 cells transiently expressing RAG-1 and RAG-2 and the human kappa light chain.

Figure 5:
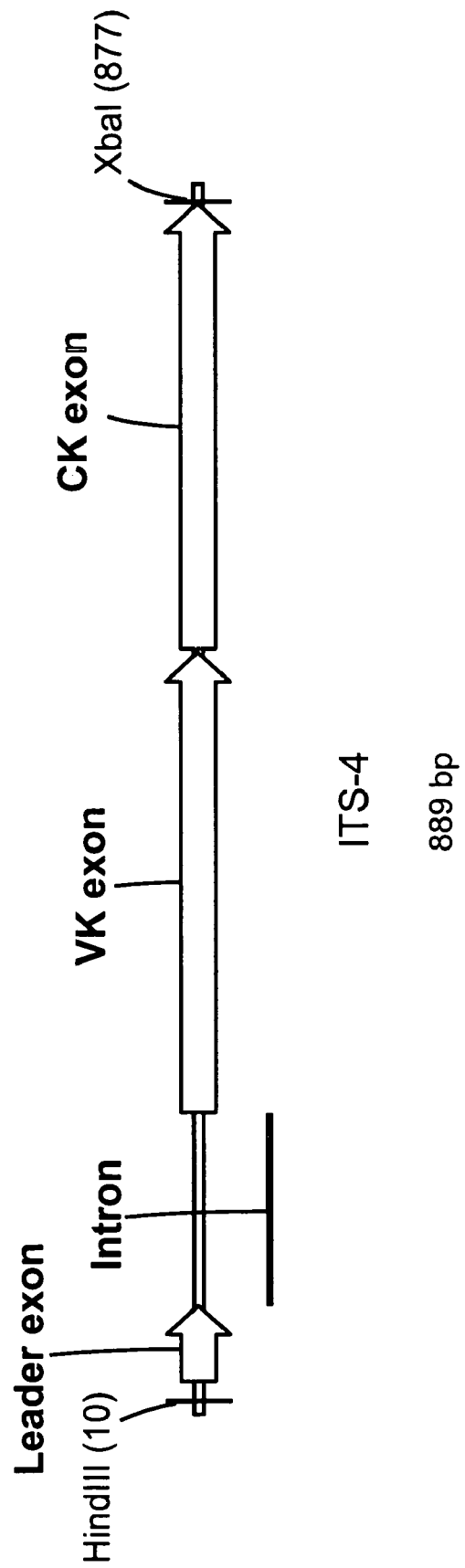
FIG. 5 shows a schematic diagram of ITS-4, a vector encoding a functional immunoglobulin kappa antibody light chain protein.

A light chain vector encoding a functional immunoglobulin kappa chain was prepared containing a leader exon, an intron, a V kappa exon and a constant kappa exon, and was designated ITS-4. The sequence of the constant region was based on the Genebank sequence NG_000834. The entire coding sequence was codon optimized (Geneart, Inc., Toronto, Canada) for expression in mammalian cells. FIG. 5 shows a schematic diagram of ITS-4. The polynucleotide sequence is provided in SEQ ID NO:9 and the amino acid sequence is provided in SEQ ID NO:10.

Figure 6:
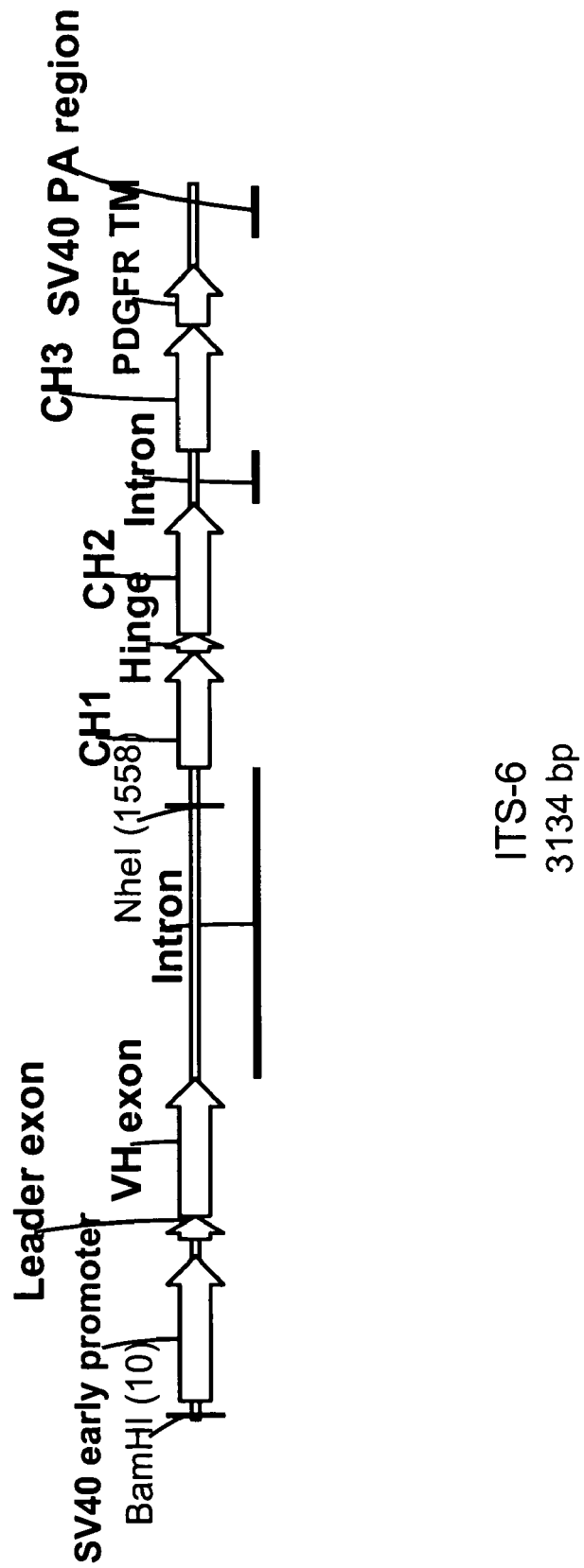
FIG. 6 shows a schematic diagram of ITS-6, a vector encoding a functional immunoglobulin IgG heavy chain membrane-expressed protein.

A heavy chain vector designed to express IgG on the surface of the cell was also generated, and designated ITS-6. ITS-6 [SEQ ID NO:11] encoded a functional human IgG1 antibody heavy chain [SEQ ID NO:12] that localized to the cell surface and was anchored to the plasma membrane by a transmembrane domain derived from the human platelet derived growth factor receptor (PDGFR). A schematic diagram of ITS-6 is shown in FIG. 6. Expression was driven by a SV40 promoter. An SV40 polyadenylation signal was present at the downstream (3') end of the construct. There were two introns in the construct, one between the VDJH exon (preassembled heavy chain exon) and the CH1 exon, and the other between the CH2 exon and the CH3 exon. The restriction enzyme sites BamHI and NheI facilitated substitution of the variable domain for VDJ substrates. Transfection of HEK-293 cells with both ITS-6 and ITS-4 (co-transfection) resulted in human IgG expressed on the surface of cells. The ITS-6 vector was the backbone for all additional tripartite antibody diversification vectors. The polynucleotide sequence of ITS-6 is provided in SEQ ID NO:11 and the amino acid sequence is provided in SEQ ID NO:12.

The vector ITS-6 [SEQ ID NO:6] was modified to remove the functional antibody encoding sequences and replace them with VH gene segments with appropriate recombination signal sequences (RSSs), D gene segments with and appropriate RSSs, and J gene segments with appropriate RSSs, to create recombination vectors designated V64 [SEQ ID NOS:14-15], V67 [SEQ ID NO:16] and V86 [SEQ ID NO:17]. In each vector, each V segment had an upstream SV40 early promoter and a downstream 23-bp RSS in the forward orientation. The D segments each had an upstream 12-bp RSS in the reverse orientation and a downstream 12-bp RSS in the forward orientation. The J segments had an upstream 23-bp RSS in the reverse orientation and a downstream splice donor site. The sequences of the 12-bp and 23-bp RSSs were as follows:

```
12-bp RSS:
                                  [SEQ ID NO: 20]
CACAGTGGTACAGACCAATACAAAAACC 23-bp RSS:
                                  [SEQ ID NO: 19]
CACAGTGGTAGTACTCCACTGTCTGGGTGTACAAAAACC
```

Figure 7:
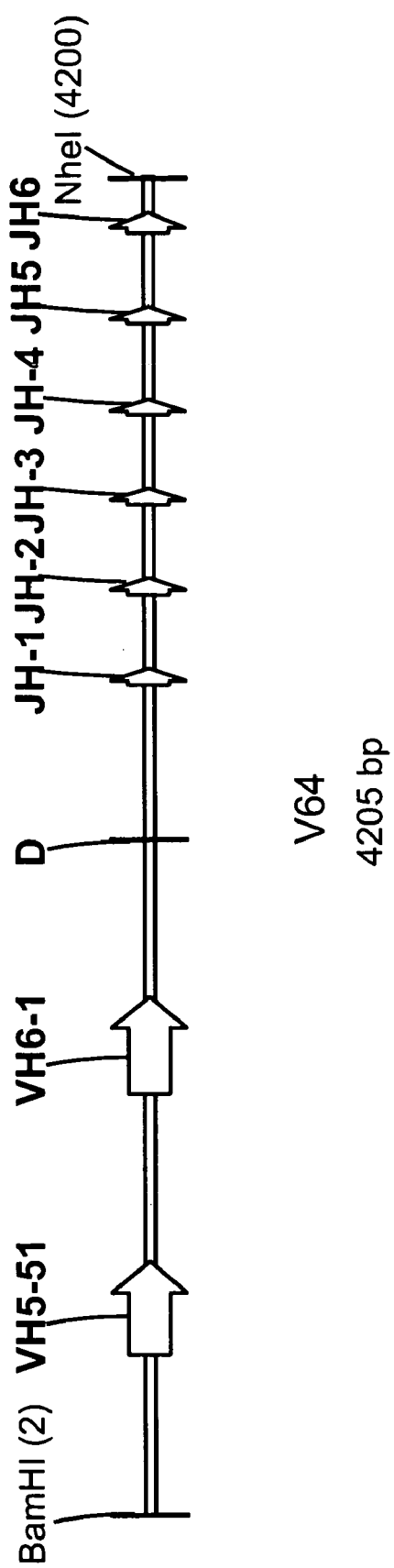
FIG. 7 shows a schematic diagram of V64, a tripartite immunoglobulin diversifying vector with a 2:1:6 (V:D:J) ratio.

V64 encoded a VDJ heavy chain recombination substrate consisting of two V segments, a single D segment and six J segments (schematic diagram shown in FIG. 7). The sequences of two V64 variants are shown in SEQ ID NO:14 and SEQ ID NO:15, each having a different D segment. In these two variants, each V segment had an upstream SV40 early promoter and a downstream 23-bp RSS in the forward orientation. The D segment had an upstream 12-bp RSS in the reverse orientation and a downstream 12-bp in the forward orientation. The J segments each had an upstream 23-bp RSS in the reverse orientation and a downstream splice donor site. The sequences of the 12-bp and 23-bp RSSs were as follows:

```
Upstream V64.1 12-bp RSS
                                  SEQ ID NO: 21
CACATAGCAGGAGGGCCTTCACAAAAAGC Downstream V64.1 12-bp RSS
                                  SEQ ID NO: 22
CACAGTGATGAACCCAGCAGCAAAAACT Upstream V64.3 12-bp RSS
                                  SEQ ID NO: 23
CACAGTAGGAGGGGCCTTCACAAAAAGC Downstream V64.3 12-bp RSS
                                  SEQ ID NO: 24
CACAGTGATGAAACTAGCAGCAAAAACT 23-bp RSS (all)
                                  SEQ ID NO: 19
CACAGTGGTAGTACTCCACTGTCTGGGTGTACAAAAACC
```

Vector V67 encoded a VDJ heavy chain recombination substrate having one V segment, a single D segment and six J segments. The V segment had an upstream SV40 early promoter and a downstream 23-bp RSS in the forward orientation. The D segment had an upstream 12-bp RSS in the reverse orientation and a downstream 12-bp in the forward orientation. The J segments each had an upstream 23-bp RSS in the reverse orientation and a downstream splice donor site. The sequence of the 12-bp and 23-bp RSSs were as follows:

```
Upstream 12-bp RSS:
                                  [SEQ ID NO: 25]
CACATAGCAGGAGGGCCTTCACAAAAAGC Downstream 12-bp RSS:
                                  [SEQ ID NO: 26]
CACAGTGATGAACCCAGCAGCAAAAACT 23-bp RSS (all):
                                  [SEQ ID NO: 19]
CACAGTGGTAGTACTCCACTGTCTGGGTGTACAAAAACC
```

Figure 8:
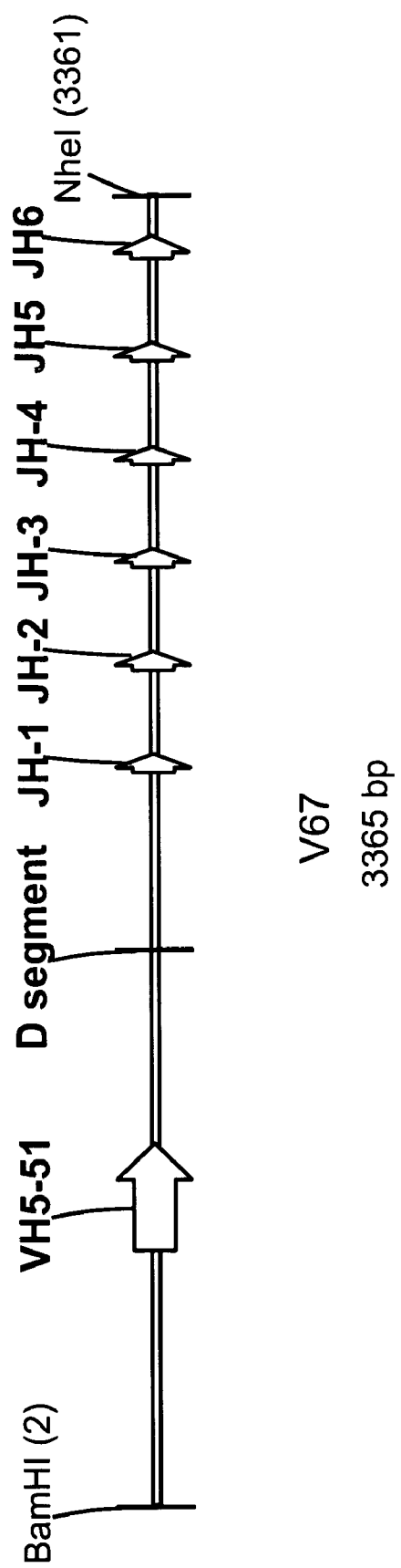
FIG. 8 shows a schematic diagram of V67, a tripartite immunoglobulin diversifying vector with a 1:1:6 (V:D:J) ratio.
Figure 9:
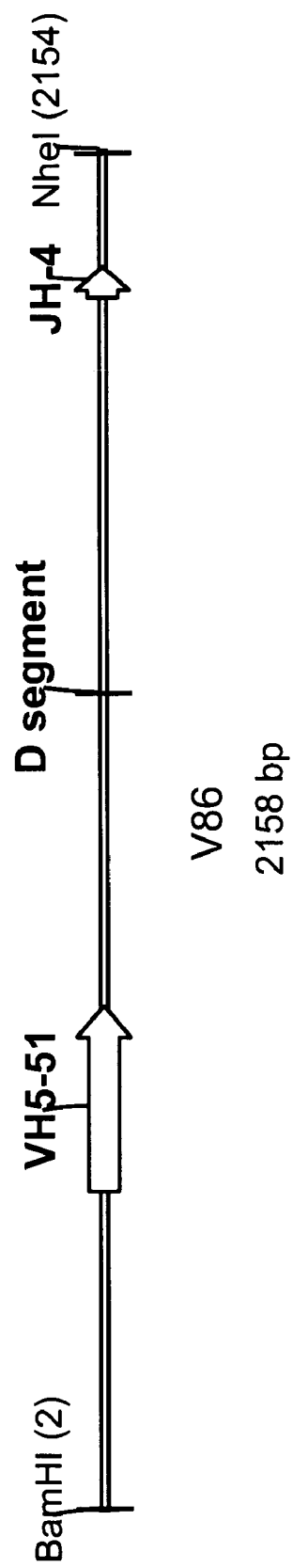
FIG. 9 shows a schematic diagram of V86, a tripartite immunoglobulin diversifying vector with a 1:1:1 (V:D:J) ratio.

A schematic diagram of V67 is shown in FIG. 8. The sequence is shown in SEQ ID NO:16.

Another antibody generating substrate, V86, encoded a heavy chain recombination substrate having one V segment, one D segment and one J segment. The V segment had an upstream SV40 early promoter and a downstream 23-bp RSS in the forward orientation. The D segment had an upstream 12-bp RSS in the reverse orientation and a downstream 12-bp in the forward orientation. The J segment had an upstream 23-bp RSS in the reverse orientation and a downstream splice donor site. The sequences of the 12-bp and 23-bp RSSs were as follows:

```
Upstream 12-bp RSS:
                                  SEQ ID NO: 27
CACATAGCAGGAGGGCCTTCACAAAAAGC Downstream 12-bp RSS:
                                  SEQ ID NO: 28
CACAGTGATGAACCCAGCAGCAAAAACT
```

A schematic diagram of V86 is shown in FIG. 12. The V86 sequence is shown in SEQ ID NO:17. The antibody generation vectors V67 and V86 were shown to generate a membrane expressed antibody when co-transfected with RAG-1, RAG-2 and a human kappa chain antibody.

Briefly, 293-HEK cells were split 1:4 into 10 cm² dishes 24 hours prior to transfection. Transfection was performed with Lipofectamine™ 2000 (Invitrogen, cat #11668-019) per the manufacturer's suggested protocol. The heavy chain recombining vector (12.0 µg), V67 or V86, was transfected with an equal mass of DNA representing a 1:1:1:1 ratio of RAG-1, RAG-2, ITS-4 and V25, respectively. V25 was included as an internal control for recombination. In addition to the heavy chain recombining substrates (V67 or V86), ITS-6 was also transfected as a positive control. 72 hours post-transfection, media were aspirated and the cells were washed 1× with 5 ml of PBS and then detached using 1 ml of 0.1× trypsin for 5 minutes at room temperature. Following this 5-minute incubation, the trypsin was neutralized with 8 ml of DMEM supplemented with 10% FBS. The cells were then transferred to a 15 ml conical vial and centrifuged at approximately 800 g for 5 minutes. Media were then aspirated and the cells were resuspended in 500 ul of PBS containing 2% FBS (staining buffer) transferred to a 1.5 ml microcentrifuge tube and centrifuged for an additional 2 minutes at 3000 rpm. Media were then aspirated and the cells were resuspended in 200 µl of staining buffer with 1:200 dilution of a Goat-anti-Human IgG H+L–PE conjugated polyclonal antibody (Cedarlane, Burlington, N.C., Cat. #109-115-098, stock concentration 0.5 µg/ml). The cells were incubated on ice for 1 hour and then washed 2 times with 200 µl PBS and finally resuspended into 100 µl of staining buffer. Positive cells were visualized by fluorescence microscopy and quantified using flow cytometry (Table 3).

TABLE 3

Immunocytofluorimetric Detection of Surface Ig Positive (sIg+) Transfectants

| Vector Name | Description | Surface Ig Positive Events | |
|---|---|---|---|
| | | # of Events | % Positive |
| V2 | Empty vector | 476 | 0.05% |
| ITS-6 | Recombined Heavy Chain | 26824 | 27.82% |
| V67 | 1V-1D-6J substrate | 1486 | 0.15% |
| V86 | 1V-1D-1J substrate | 1074 | 0.11% |

Transfection with the control ITS-6 vector showed that a large fraction of cells expressed membrane human IgG1. Transfection with V67 and V86 each showed a low percentage of positive cells. Although these frequencies were relatively low, fluorescent cells were visualized under the microscope for each vector (V67 and V86).

In a separate experiment, stable cell lines were generated using the V64.1 and V64.3 substrates (described above). HEK-293H cells were transfected with equal amounts of five expression plasmids using Lipofectamine 2000 (Invitrogen, Cat. #11668-019) as per the manufacturer's suggested protocol. The vectors included: 1) RAG1, 2) RAG2, 3) V64, (2V-1D-6J), heavy chain VDJ substrate, 4) a fully recombined antibody light chain (ITS-4) and 5) a vector containing the puromycin resistance gene. Forty-eight hours post-transfection, cells were selected using 1.0 ug/ml puromycin for 2 weeks. Puromycin resistant clones were then plucked and expanded into 6 well dishes. Once the cells had achieved confluence, media were aspirated and the cells were washed 1× with 2 ml of PBS and then detached using 0.5 ml of 0.1× trypsin for 5 minutes at room temperature. Following the 5 minute incubation the trypsin was neutralized with 2 ml of DMEM supplemented with 10% FBS. Half of the cells were then transferred to a 1.5 ml microcentrifuge tube and spun at 3000 rpm for 2 minutes. Media were then aspirated and the cells were resuspended in 200 ul of PBS containing 2% FBS (staining buffer) with 1:200 dilution of a Goat anti-Human IgG H+ L–PE conjugated polyclonal antibody (Cedarlane, Cat #109-115-098, stock concentration 0.5 ug/ml). The cells were incubated at 4 degree Celsius for 1 hr and then washed 2 times with 150 ul PBS, then resuspended into 100 ul of staining buffer. Positive cells were visualized using fluorescent microscopy and quantified using flow cytometry (Table 4).

The transfection resulted in host cells containing chromosomally integrated, fully assembled (e.g., rearranged relative to the germline) and functional immunoglobulin light chain gene that was constitutively expressed (ITS-4). The stable cell line also expressed RAG-1 and RAG-2 and a heavy chain diversity generating vector(s) encoding an Ig fusion protein having a membrane anchor domain as described herein (V64). The light chain was secreted and was not found on the cell surface unless associated with a membrane-associating heavy chain. Cells that did not produce Ig heavy chain gene VDJ events, or that generated out-of-frame products, were not able to generate a heavy chain. Cells that did produce a functionally rearranged heavy chain gene were able to assemble the expressed heavy chain in association with the light chain and so generated a membrane bound antibody, due to the membrane anchoring domains included in the heavy chain diversity generating vector. Clones of 293 cells harboring integrated V64 (2V-1 D-6J) VDJ substrates were analyzed by FACS (10,000 cells analyzed). A number of clones were identified that expressed human IgG on the cell surface of a significant number of cells (Table 5). Immunofluorescence microscopy readily permitted visualization of cells with fluorescently stained human IgG on their surfaces.

TABLE 4

Immunocytofluorimetric Detection of Surface Ig Positive (sIg+) Transfectants by Fluorescence Activated Cell Sorter (FACS) Analysis

| Filename | Clone ID | Description | % Surface Ig Positive Cells |
|---|---|---|---|
| Specimen_001_1.fcs | 1 | V64.3 clone 1 | 0.2% |
| Specimen_001_4_003.fcs | 7 | V64.3 clone 7 | 5.4% |
| Specimen_001_4_012.fcs | 16 | V64.1 clone 8 | 8.2% |
| Specimen_001_4_021.fcs | 25 | V64.1 clone 17 | 10.5% |
| Specimen_001_4_023.fcs | 27 | V64.1 clone 19 | 3.1% |

With such demonstrated expression of the antibody product of VDJ recombination on the cell surface, antigen-binding or anti-Ig binding assays can be performed to identify cells expressing Ig heavy chains having desired binding properties.

It should be appreciated that in related alternative embodiments, the above described process can be conducted with a stably integrated immunoglobulin heavy chain gene in the host cell, into which are introduced light chain diversity generating vectors assembled as described herein. A rearranged heavy chain gene recovered from a host cell expressing an immunoglobulin having desired binding properties and identified as described above in this Example, can be integrated into a host cell and subsequently a light chain diversity generating vector can be used. For example and according to non-limiting theory, by this approach both the heavy chain and the light chain CDR3s are selected for a desired binding activity (e.g., specific binding to a desired antigen) to generate high affinity antibodies.

Example 5

Diversifying Both Heavy and Light Chains in a Single Host Cell

This Example describes introducing Ig heavy and light chain diversification constructs into the same host cell. In order to avoid the recombination signals from the two constructs being utilized inappropriately (e.g., $V_H$ to $J_L$ etc.) it is preferred to have the constructs introduced sequentially so that they integrate into different chromosomes. A trans-chromosomal recombination event between the two constructs is not impossible but kinetically the intrachromosomal recombination event is favored. At least one D segment gene is present on each nucleic acid construct for generating immunoglobulin diversity, so that all V and J gene segments (both heavy chain and light chain) contain the same RSS spacer size (i.e., 12 or 23 nucleotide signals as described above) whilst the D segment gene contains the functionally complementary RSS spacer size (i.e., 23 nt if V and J use 12 nt; 12 nt if V and J use 23 nt); this configuration precludes direct V to J recombination events.

Including the D segment gene on the Ig light chain diversity construct promotes the generation of a diverse light chain repertoire. Again, because of the 12/23 rule it prevents direct V to J recombination. In the in vitro system, which does not contain the regulatory controls found in vivo that terminate recombination following the successful completion of a functional light chain gene assembly, multiple rounds of light chain recombination transpire until either the expression of the recombinase is stopped or all the light chain V and J gene segments are consumed. In either event significant biases are observed and proximal V and J genes (e.g., V region genes further from the 5' terminus and J segment genes further from the 3' terminus) are more frequently deleted and under-utilized.

The tripartite V-D-J assembly process for Ig light chain gene recombination promotes an unprecedentedly diverse light chain repertoire. The D segment encoding polynucleotides of the D segment gene(s) include natural D segment encoding gene sequences found in the human genome and/or artificial D segment encoding sequences.

In a preferred embodiment artificial D segment genes having D segment encoding polynucleotide sequences with between 1 and 6 nucleotides predominantly containing a "G" or "C" are included so as to mimic the biased addition of TdT. Because N nucleotide addition is generally lower at the light chain locus and deletions occur at both the 5' and 3' ends of the D segment encoding sequence, the remaining G/C nucleotides are functionally equivalent to TdT additions and provide additional diversity at the light chain locus. The products from larger species of such D-like segments with high G/C content thus represent the functional equivalents of larger N nucleotide insertions.

Although an artificial D segment encoding sequence having one or only a few nucleotides (e.g., 2, 3, 4, 5) is likely on a probabilistic basis to be eliminated by deletion accompanying recombination, low probability successful recombination events that utilize the D segment encoding sequence enhance light chain sequence diversity, and delusional events that eliminate the D segment still contribute to reduced positional (e.g., 5' or 3') bias in the usage of light chain V and J gene segments in productive recombination.

Another nucleic acid composition for generating Ig structural diversity includes three D segment genes on a light chain diversity generating construct: 3' to the V region genes is a first D segment encoding gene having the nucleotide sequence 5'-(GCGC)-3' situated between a first D segment upstream RSS and a first D segment downstream RSS; downstream from the first D segment encoding gene is a second D segment encoding gene having a single "G" nucleotide situated between a second D segment upstream RSS and a second D segment downstream RSS; downstream from the second D segment encoding gene is a third D segment encoding gene that is proximal to a J segment gene and that has the nucleotide sequence 5'-(GGCGCC)-3' situated between a third D segment upstream RSS and a third D segment downstream RSS. In this exemplary light chain diversity-generating composition, D segment encoding sequences are separated by sequences that are also found separating D segment genes of the heavy chain locus in the human genome.

REFERENCES

Azuma et al., 1976 *J Biochem* 80:1023; Alt et al., 1984 *Embo J* 3:1209; Chaney et al., 1986 *Somat Cell Mol Genet.* 12:237; Caporale et al., 1990 *Gene* 87:285; Alessandrini et al., 1991 *Mol Cell Biol* 11:2096; Akamatsu et al., 1994 *J Immunol* 153:4520; Bradshaw et al., 1995 *Nucleic Acids Res* 23:4850; Connor et al., 1995 *J Immunol* 155:5268; Corbett et al., 1997 *J Mol Biol* 270:587; Sauer, 1998 *Methods* 14:381; Arakawa et al., 2001 *BMC Biotechnol* 1:7; Choi et al., 2001 *Methods Mol Biol* 175:57; Chowdhury et al., 2001 *Embo J* 20:6394; Kaczmarczyk et al., 2001 *Nucleic Acids Res* 29:E56; Sauer, 2002 *Endocrine* 19:221; Bruce et al., 2003 *Rna* 9:1264; Cowell et al., 2003 *J Exp Med* 197:207; Kondo et al., 2003 *Nucleic Acids Res* 31:e76; Chatterjee et al., 2004 *Nucleic Acids Res* 32:5668; Chowdhury et al., 2004 *Immunol Rev* 200:182; Ciubotaru et al., 2004 *Mol Cell Biol* 24:8727; Cowell et al., 2004 *Immunol Rev* 200:57; Arnaout, 2005 *BMC Genomics* 6:148; Afshar et al., 2006 *J Immunol* 176:2439; Baird et al., 2006 *Rna* 12:1755; Browman et al., 2007 *Trends Cell Biol* 17:394; Chakraborty et al., 2007 *Mol Cell* 27:842; Chen et al., 2007 *Faseb J* 21:2931; Ferguson et al., 1986 *J Biol Chem* 261:14760; Engler et al., 1987 *Proc Natl Acad Sci USA* 84:4949; Galli et al., 1988 *Proc Natl Acad Sci USA* 85:2439; Ferrier et al., 1990 *Embo J* 9:117; Gnirke et al., 1991 *Embo J* 10:1629; Gauss et al., 1992 *Nucleic Acids Res* 20:6739; Gauss et al., 1992 *Genes Dev* 6:1553; Gauss et al., 1993 *Mol Cell Biol* 13:3900; Gerstein et al., 1993 *Genes Dev* 7:1459; Ezekiel et al., 1995 *Immunity* 2:381; Fabb et al., 1995 *Mol Cell Biol Hum Dis Ser* 5:104; Davies et al., 1996 *Methods Mol Biol* 54:281; Dul et al., 1996 *J Immunol* 157:2969; Eastman et al., 1996 *Nature* 380:85; Fanning et al., 1996 *Immunogenetics* 44:146; Gauss et al., 1996 *Mol Cell Biol* 16:258; Eastman et al., 1997 *Nucleic Acids Res* 25:4370; Ezekiel et al., 1997 *Mol Cell Biol* 17:4191; Delassus et al., 1998 *J Immunol* 160:3274; Frank et al., 1998 *Nature* 396:173; Gauss et al., 1998 *Eur J Immunol* 28:351; Grawunder et al., 1998 *J Biol Chem* 273:24708; Eastman et al., 1999 *Mol Cell Biol* 19:3788; Fugmann et al., 2000 *Annu Rev Immunol* 18:495; Gellert, 2002 *Annu Rev Biochem* 71:101; Dai et al., 2003 *Proc Natl Acad Sci USA* 100:2462; De et al., 2004 *Mol Cell Biol* 24:6850; Espinoza et al., 2005 *J Immunol* 175:6668; Drejer-Teel et al., 2007

Mol Cell Biol 27:6288; Horne et al., 1982 *J Immunol* 129: 660; Hamel et al., 1987 *J Immunol* 139:3012; Hesse et al., 1987 *Cell* 49:775; Hoeijmakers et al., 1987 *Exp Cell Res* 169:111; Koiwai et al., 1987 *Biochem Biophys Res Commun* 144:185; Kojima et al., 1987 *Biochem Biophys Res Commun* 143:716; Ichihara et al., 1988 *Embo J* 7:4141; Hesse et al., 1989 *Genes Dev* 3:1053; Hendrickson et al., 1991 *Proc Natl Acad Sci USA* 88:4061; Huang et al., 1992 *J Clin Invest* 89:1331; Ichihara et al., 1992 *Immunol Lett* 33:277; Kim, U. J. et al., 1992 *Nucleic Acids Res* 20:1083; Jakobovits et al., 1993 *Nature* 362:255; Knarr et al., 1995 *J Biol Chem* 270:27589; Huxley, 1997 *Trends Genet.* 13:345; Julicher et al., 1997 *Genomics* 43:95; Hikida et al., 1998 *J Exp Med* 187:795; Ikeno et al., 1998 *Nat Biotechnol* 16:431; Kim, S.Y. et al., 1998 *Genome Res* 8:404; Hesslein et al., 2001 *Adv Immunol* 78:169; Holowka et al., 2001 *Semin Immunol* 13:99; Kaczmarczyk et al., 2001 *Nucleic Acids Res* 29:E56; Jones et al., 2003 *Proc Natl Acad Sci USA* 100:15446; Jung et al., 2003 *Immunity* 18:65; Kondo et al., 2003 *Nucleic Acids Res* 31:e76; Harder, 2004 *Curr Opin Immunol* 16:353; Ko et al., 2004 *J Biol Chem* 279: 7715; Hayashi et al., 2005 *Life Sci* 77:1612; Ivanov et al., 2005 *J Immunol* 174:7773; Kapitonov et al., 2005 *PLoS Biol* 3:e181; Heaney et al., 2006 *Mamm Genome* 17:791; Inlay et al., 2006 *J Exp Med* 203:1721; Jung et al., 2006 *Annu Rev Immunol* 24:541; Heckmann et al., 2007 *Methods Enzymol* 426:463; Hillion et al., 2007 *J Immunol* 179: 6790; Hillion et al., 2007 *Autoimmun Rev* 6:415; Meyerowitz et al., 1980 *Gene* 11:271; Landau et al., 1987 *Mol Cell Biol* 7:3237; Lee et al., 1999 *Immunity* 11:771; Lieber et al., 1987 *Genes Dev* 1:751; McCormick et al., 1987 *Methods Enzymol* 151:397; Lieber et al., 1988 *Cell* 55:7; Lieber et al., 1988 *Proc Natl Acad Sci USA* 85:8588; Lewis, 1994 *Proc Natl Acad Sci USA* 91:1332; Lieber et al., 1994 *Semin Immunol* 6:143; Lonberg et al., 1994 *Nature* 368: 856; Lilie et al., 1995 *J Mol Biol* 248:190; Lonberg et al., 1995 *Int Rev Immunol* 13:65; Mattila et al., 1995 *Eur J Immunol* 25:2578; Livak et al., 1996 *Mol Cell Biol* 16:609; Leu et al., 1997 *Immunity* 7:303; Livak et al., 1997 *J Mol Biol* 267:1; Larijani et al., 1999 *Nucleic Acids Res* 27:2304; Modesti et al., 1999 *Embo J* 18:2008; Maes et al., 2000 *J Immunol* 165:703; Moshous et al., 2000 *Hum Mol Genet* 9:583; Mageed et al., 2001 *Clin Exp Immunol* 123:1; Moshous et al., 2001 *Cell* 105:177; Larin et al., 2002 *Trends Genet* 18:313; Ma et al., 2002 *Cell* 108:781; Lee et al., 2003 *PLoS Biol* 1:E1; Market et al., 2003 *PLoS Biol* 1:E16; Martin et al., 2003 *J Immunol* 171:4663; Montalbano et al., 2003 *J Immunol* 171:5296; Morshead et al., 2003 *Proc Natl Acad Sci USA* 100:11577; Moshous et al., 2003 *Ann N Y Acad Sci* 987:150; Le Deist et al., 2004 *Immunol Rev* 200:142; Li et al., 2005 *J Immunol* 174:2420; London, 2005 *Biochim Biophys Acta* 1746:203; Maes et al., 2006 *J Immunol* 176:5409; Masuda et al., 2006 *Febs J* 273:2184; Masumoto et al., 2006 *Tanpakushitsu Kakusan Koso* 51:2155; Monaco et al., 2006 *Biochem Soc Trans* 34:324; Lu et al., 2007 *Nucleic Acids Res* 35:6917; Lantelme et al., 2008 *Mol Immunol* 45:328; Ravetch et al., 1981 *Cell* 27:583; Peterson et al., 1984 *Proc Natl Acad Sci USA* 81:4363; Reth, M. G. et al., 1985 *Nature* 317:353; Rinfret et al., 1985 *J Immunol* 135:2574; Padlan et al., 1986 *Mol Immunol* 23:951; Reth, M. G. et al., 1986 *Embo J* 5:2131; Reth, M. et al., 1987 *Embo J* 6:3299; Pavan et al., 1990 *Mol Cell Biol* 10:4163; Ramsden et al., 1991 *Proc Natl Acad Sci USA* 88:10721; Rathbun et al., 1993 *Int Immunol* 5:997; Ramsay, 1994 *Mol Biotechnol* 1:181; Rolink et al., 1995 *Semin Immunol* 7:155; Pan et al., 1997 *Int Immunol* 9:515; Raaphorst et al., 1997 *Int Immunol* 9:1503; Roch et al., 1997 *Nucleic Acids Res* 25:2303; Nadel et al., 1998 *J Exp Med* 187:1495; Ohmori et al., 1998 *Crit Rev Immunol* 18:221; Ripoll et al., 1998 *Gene* 210: 163; Nitschke et al., 2001 *J Immunol* 166:2540; Rooney et al., 2002 *Mol Cell* 10:1379; Oberdoerffer et al., 2003 *Nucleic Acids Res* 31:e140; Roose et al., 2003 *PLoS Biol* 1:E53; Poinsignon et al., 2004 *J Exp Med* 199:315; Repasky et al., 2004 *J Immunol* 172:5478; Reddy et al., 2006 *Genes Dev* 20:1575; Sandri-Goldin et al., 1981 *Mol Cell Biol* 1:743; Schatz et al., 1988 *Cell* 53:107; Schroeder et al., 1988 *Proc Natl Acad Sci USA* 85:8196; Sauer et al., 1990 *New Biol* 2:441; Yamada et al., 1991 *J Exp Med* 173:395; Schatz et al., 1992 *Annu Rev Immunol* 10:359; Seto et al., 1992 *Nucleic Acids Res* 20:3786; Solin et al., 1992 *Immunogenetics* 36:306; Taylor et al., 1992 *Nucleic Acids Res* 20:6287; Shapiro et al., 1993 *Mol Cell Biol* 13:5679; Tuaillon et al., 1993 *Proc Natl Acad Sci USA* 90:3720; Wei et al., 1993 *J Biol Chem* 268:3180; Schlissel et al., 1994 *J Immunol* 153:1645; Slightom et al., 1994 *Gene* 147:77; Woo et al., 1994 Nucleic Acids Res 22:4922; Schatz, 1997 Semin Immunol 9:149; Sauer, 1998 Methods 14:381; Skowronek et al., 1998 *Proc Natl Acad Sci USA* 95:1574; Tuaillon et al., 1998 *Proc Natl Acad Sci USA* 95:1703; Yu, C. C. et al., 1998 *J Immunol* 161:3444; Sun et al., 1999 *Mol Immunol* 36:551; Yu, K. et al., 1999 *Mol Cell Biol* 19:8094; Soderlind et al., 2000 *Nat Biotechnol* 18:852; Tevelev et al., 2000 *J Biol Chem* 275:8341; Tuaillon et al., 2000 *J Immunol* 164:6387; Tuaillon et al., 2000 *Eur J Immunol* 30:2998; Shizuya et al., 2001 *Keio J Med* 50:26; Wang et al., 2001 *Genome Res* 11:137; Williams et al., 2001 *J Immunol* 167:257; Sauer, 2002 Endocrine 19:221; Schlissel, 2002 Cell 109:1; Tsai et al., 2002 *Genes Dev* 16:1934; Verkaik et al., 2002 *Eur J Immunol* 32:701; Yu, Y. et al., 2003 *DNA Repair (Amst)* 2:1239; Yurchenko et al., 2003 *Genes Dev* 17:581; Schatz, 2004 Immunol Rev 200:5; Shockett et al., 2004 *Mol Immunol* 40:813; Souto-Carneiro et al., 2004 *J Immunol* 172:6790; That et al., 2004 *J Immunol* 173:4009; Wollscheid et al., 2004 *Subcell Biochem* 37:121; Schatz et al., 2005 *Curr Top Microbiol Immunol* 290:49; Schelonka et al., 2005 *J Immunol* 175: 6624; Spicuglia et al., 2006 *Curr Opin Immunol* 18:158; Suarez et al., 2006 *Mol Immunol* 43:1827; Semprini et al., 2007 *Nucleic Acids Res* 35:1402; Takada et al., 2007 *Genome Biol* 8:215; VanDyk et al., 1996 *J. Immunol* 157: 4005-4015; Vanura et al., 2007 *PLoS Biol* 5:e43; Zheng et al., 2007 *Mol Immunol* 44:2221; Zou et al., 2007 *Chin Med J (Engl)* 120:410.

The various embodiments described above can be combined to provide further embodiments. All of the U.S. patents, U.S. patent application publications, U.S. patent applications, foreign patents, foreign patent applications and non-patent publications referred to in this specification and/or listed in the Application Data Sheet, are incorporated herein by reference, in their entirety. Aspects of the embodiments can be modified, if necessary to employ concepts of the various patents, applications and publications to provide yet further embodiments.

These and other changes can be made to the embodiments in light of the above-detailed description. In general, in the following claims, the terms used should not be construed to limit the claims to the specific embodiments disclosed in the specification and the claims, but should be construed to include all possible embodiments along with the full scope of equivalents to which such claims are entitled. Accordingly, the claims are not limited by the disclosure.

SEQUENCE LISTING (113 sequences)

SEQ ID NO: 1 - DNA, 3206 bp, Artificial Sequence
  Codon optimized sequence for translation into mammalian cells.
ggcgcgccaagcttgcggccgcggtaccgctagcgccgccaccatggccgccagcttcccccctaccctgggcctgagcagcgcccctgacgagatccagcacccccacatcaagttcagcgagtggaagttcaagctgttcagagtgcggagcttcgaaaagacccccgaggaggcccagaaggagaagaaggacagcttcgagggcaagcccagcctggagcagagccctgccgtgctggacaaggccgacggccagaagcccgtccccacccagcccctgctgaaggcccaccccaagttcagcaagaagttccacgacaacgagaaggccaggggcaaggccatccaccaggccaacctgcggcacctgtgccggatctgcggcaacagcttccgggccgacgagcacaaccggcgctaccccgtgcacggccccgtggacggcaagaccctgggactgctgcggaagaaggagaagcgggccacctcctggcccgacctgatcgccaaggtgttcaggatcgacgtgaaggccgacgtggacagcatccaccccaccgagttctgccacaactgctggtccatcatgcaccggaagttcagctccgccccctgcgaggtgtacttcccccggaacgtgaccatggagtggcaccctcacacccccagctgcgacatctgcaacaccgccagacggggcctgaagcggaagtccctgcagcccaacctgcagctgtccaagaagctgaaaaccgtcctggatcaggcccggcaggccaggcagagaaagcggagagcccaggcccggatcagcagcaaggacgtgatgaagaagatcgccaactgcagcaagatccacctgagcaccaagctgctggccgtggacttccccgagcacttcgtgaagtccatcagctgccagatctgcgagcacatcctggccgaccccgtggagacaaactgcaagcacgtgttctgcagagtgtgcatcctgcggtgcctgaaggtgatgggcagctactgccccagctgcagatacccctgcttccccaccgacctggagagccccgtgaagtccttcctgagcgtgctgaacagcctgatggtgaagtgccccgccaaggagtgcaacgaggaggtctccctggagaagtacaaccaccacatcagcagccacaaggagagcaaggagatcttcgtccacatcaacaagggcggcagaccccggcagcacctgctgtccctgaccagacgggcccagaagcacagactgcgggagctgaagctgcaggtgaaggccttcgccgacaaggaggagggcggcgacgtcaagtccgtgtgcatgaccctgtttctgctggccctgagagctaggaacgagcaccggcaggccgatgagctggaggccatcatgcagggcaagggcagcggcctgcagcctgccgtgtgcctggccatcagagtgaacacctttctgagctgcagccagtaccacaagatgtaccggaccgtgaaggccatcaccggcagacagatcttccagcctctgcacgccctgcggaacgccgagaaggtgctgctgcccggctaccaccacttcgagtggcagccccccctgaagaacgtgtccagcagcaccgacgtgggcatcatcgacggcctgagcggcctgtccagctccgtggacgactaccctgtggacacaatcgccaagcggttcagatacgacagcgccctggtgtccgccctgatggacatggaggaggacatcctggagggcatgcggagccaggacctggacgattacctgaacggccccttcaccgtggtggtgaaagaatcctgcgacggcatgggcgacgtgtccgagaagcacggcagcggccctgtggtgcccgagaaggccgtgcggttcagcttcaccatcatgaagatcacaatcgcccacagcagccagaacgtgaaggtgttcgaggaggccaagcccaacagcgagctgtgctgcaagcccctgtgcctgatgctggccgacgagagcgaccacgagacactgaccgccatcctgagccccctgatcgccgagcgggaggccatgaagtcctccgagctgatgctggagctgggcggcatcctgaggaccttcaagttcatcttccggggcaccggctacgacgagaagctggtgcgggaggtggagggcctggaggccagcggcagcgtgtacatctgcaccctgtgcgacgccacccggctggaggcctcccagaacctggtgttccacagcatcacccggtcccacgccgagaacctggagagatacgaggtgtggcggagcaacccctaccacgagagcgtggaggagctgcgggacagagtgaagggcgtgagcgccaagcccttcatcgagacagtgcccagcatcgacgccctgcactgcgatatcggcaacgccgccgagttctacaagatctttcagctggagatcggagaggtgtacaagaaccccaacgccagcaaggaggagcggaagcgctggcaggccaccctggacaagcacctgcgcaagaagatgaacctgaagcccatcatgcggatgaacggcaacttcgccagaaagctgatgaccaaggaaacagtggacgccgtctgcgagctgatccccagcgaggagcggcacgaggccctgcgcgagctgatggacctgtacctgaagatgaagcccgtgtggcggtccagctgtcctgccaaggagtgtcccgagagcctgtgccagtacagcttcaacagccagcggttcgccgagctgctgtccaccaagttcaagtaccgctacgagggcaagatcaccaactacttccacaagacactggcccacgtgcccgagatcatcgagcgggacggcagcatcggcgcctgggccagcgagggcaacgagagcggcaacaagctgttccggcggttcaggaagatgaacgccaggcagagcaagtgctacgagatggaggacgtgctgaagcaccactggctgtacaccagcaagtacctgcagaaattcatgaacgcccacaacgccctgaaaaccagcggcttcaccatgaaccctcaggccagcctgggcgaccctctgggcatcgaggactccctggagtcccaggacagcatggaattctgataatctagagcggccgcggatccttaattaa

SEQ ID NO: 2 - protein, 1043 aa, Homo sapiens
MAASFPPTLGLSSAPDEIQHPHIKFSEWKFKLFRVRSFEKTPEEAQKEKKDSFEGKPSLEQSPAVLDKADGQKPVPTQPLLKAHPKFSKKFHDNEKARGKAIHQANLRHLCRICGNSFRADEHNRRYPVHGPVDGKTLGLLRKKEKRATSWPDLIAKVFRIDVKADVDSIHPTEFCHNCWSIMHRKFSSAPCEVYFPRNVTMEWHPHTPSCDICNTARRGLKRKSLQPNLQLSKKLKTVLDQARQARQRKRRAQARISSKDVMKKIANCSKIHLSTKLLAVDFPEHFVKSISCQICEHILADPVETNCKHVFCRVCILRCLKVMGSYCPSCRYPCFPTDLESPVKSFLSVLNSLMVKCPAKECNEEVSLEKYNHHISSHKESKEIFVHINKGGRPRQHLLSLTRRAQKHRLRELKLQVKAFADKEEGGDVKSVCMTLFLLALRARNEHRQADELEAIMQGKGSGLQPAVCLAIRVNTFLSCSQYHKMYRTVKAITGRQIFQPLHALRNAEKVLLPGYHHFEWQPPLKNVSSSTDVGIIDGLSGLSSSVDDYPVDTIAKRFRYDSALVSALMDMEEDILEGMRSQDLDDYLNGPFTVVVKESCDGMGDVSEKHGSGPVVPEKAVRFSFTIMKITIAHSSQNVKVFEEAKPNSELCCKPLCLMLADESDHETLTAILSPLIAEREAMKSSELMLELGGILRTFKFIFRGTGYDEKLVREVEGLEASGSVYICTLCDATRLEASQNLVFHSITRSHAENLERYEVWRSNPYHESVEELRDRVKGVSAKPFIETVPSIDALHCDIGNAAEFYKIFQLEIGEVYKNPNASKEERKRWQATLDKHLRKKMNLKPIMRMNGNFARKLMTKETVDAVCELIPSEERHEALRELMDLYLKMKPVWRSSCPAKECPESLCQYSFNSQRFAELLSTKFKYRYEGKITNYFHKTLAHVPEIIERDGSIGAWASEGNESGNKLFRRFRKMNARQSKCYEMEDVLKHHWLYTSKYLQKFMNAHNALKTSGFTMNPQASLGDPLGIEDSLESQDSMEF

SEQ ID NO: 3 - DNA, 1661 bp, Artificial Sequence
  Codon optimized sequence for translation into mammalian cells.
ggcgcgccgaattcgcggccgcggtaccgctagcaagcttgccgccaccatgagcctgcagatggtgaccgtgtccaacaatatcgccctgatccagcccggcttcagcctgatgaacttcgacggccaggtgttcttcttcggccagaagggctggcccaagcggagctgccccaccggcgtgttccacctggacgtgaagcacaaccacgtgaagctgaagcctaccatcttcagcaaggacagctgctacctgccccccctgcgctaccctgccacctgcaccttcaagggcagcctggagagcgagaagcaccagtacatcatccacggcggcaagacacccaacaacgaggtgtccgacaagatctacgtgatgagcatcgtgtgcaagaacaacaagaaggtgaccttccgctgcaccgagaaggacctggtgggagatgtgcccgaggccagatacggccactccatcaacgtggtgtacagccggggcaagagcatgggcgtgctgttcggcggcaggtcctacatgcccagcacccaccggaccaccgagaagtggaacagcgtggccgactgcctgccctgcgtgttcctggtggacttcgagttcggctgcgccacctcctacatcctgccagagctgcaggacggcctgtccttccacgtgtctatcgccaagaacgacaccatctacatcctgggcggccacagcctggccaacaacatcaggcccgccaacctgtaccggatcagggtggacctgcccctgggcagcccagccgtgaactgcaccgtgctgcctggcggcatcagcgtgtcctctgccatcctgacccagaccaacaacgacgagttcgtgatcgtgggcggctaccagctggagaaccagaaacggatgatctgcaacatcatcagcctggaggacaacaagatcgagatccgggagatggagacacccgactggacccctgacatcaagcacagcaagatctggttcggcagcaacatgggcaacggcaccgtgtttctgggcatccccggcgacaacaagcaggtggtgtccgagggcttctacttctacatgctgaagtgcgccgaggacgacaccaacgaggagcagaccaccttcaccaacagccagaccagcaccgaggaccccggcgactccacccccttcgaggacagcgaggagttttgcttcagcgccgaggccaacagcttcgacggcgacgacgagtttgacacctacaacgaggacgacgaggaggacgagtccgagacaggctactggatcacctgctgccctacctgcgacgtggatatcaacacctgggtgcccttctacagcaccgagctgaacaagcccgccatgatctactgcagccacggcgacggccactgggtgcacgcccagtgcatggacctggccgagcggaccctgatccacctgtccgccggctccaacaagtactactgcaacgagcacgtggagatcgccagggccctgcacaccccccagagagtgctgcctctgaaaaagccccctatgaagtccctgaggaagaagggctccggcaagatcctgacccccgccaagaagtcctttctgcggcggctgttcgactgagcggccgctctagactcgagttaattaa

SEQ ID NO: 4 - protein, 527 aa, Homo sapiens
MSLQMVTVSNNIALIQPGFSLMNFDGQVFFFGQKGWPKRSCPTGVFHLDVKHNHVKLKPTIFSKDSCYLPPLRYPATCTFKGSLESEKHQYIIHGGKTPNNEVSDKIYVMSIVCKNNKKVTFRCTEKDLVGDVPEARYGHSINVVYSRGKSMGVLFGGRSYMPSTHRTTEKWNSVADCLPCVFLVDFEFGCATSYILPELQDGLSFHVSIAKNDTIYILGGHSLANNIRPANLYRIRVDLPLGSPAVNCTVLPGGISVSSAILTQTNNDEFVIVGGYQLENQKRMICNIISLEDNKIEIREMETPDWTPDIKHSKIWFGSNMGNGTVFLGIPGDNKQVVSEGFYFYMLKCAEDDTNEEQTTFTNSQTSTEDPGDSTPFEDSEEFCFSAEANSFDGDDEFDTYNEDDEEDESETGYWITCCPTCDVDINTWVPFYSTELNKPAMIYCSHGDGHWVHAQCMDLAERTLIHLSAGSNKYYCNEHVEIARALHTPQRVLPLKKPPMKSLRKKGSGKILTPAKKSFLRRLFD

SEQ ID NO: 5 - DNA, 1551 bp, Artificial Sequence
  Codon optimized sequence for translation into mammalian cells.
aagcttgccgccaccatggacccccccagagccagccacctgagccccagaaagaagagacccagacagaccggcgccctgatggccagcagcccccaggacatcaagttccaggacctggtggtgttcatcctggagaagaagatgggcaccaccagaagagccttcctgatggagctggccagaagaaagggcttcagagtggagaacgagctgagcgacagcgtgacccacatcgtggccgagaacaacagcggcagcgacgtgctcgagtggctgcaggcccagaaggtgcaggtgagcagccagcccgagctgctggacgtgagctggctgatcgagtgcatcagagccggcaagcccgtggagatgaccggcaagcaccagctggtggtgagaagagactacagcgacagcaccaaccccggcccccccaagaccccccccatcgccgtgcagaagatcagccagtacgcctgccagagaagaaccaccctgaacaactgcaaccagattttcaccgacgccttcgacatcctggccgagaactgcgagttcagagagaacgaggacagctgcgtgaccttcatgagagccgccagcgtgctgaagagcctgcccttcaccatcatcagcatgaaggacaccgagggcatcccctgcctgggcagcaaggtgaagggcatcatcgaggagatcatcgaggacggcgagagcagcgaggtgaaggccgtgctgaacgacgagagataccagagcttcaagctgttcaccagcgtgttcggcgtgggcctgaagaccagcgagaagtggttcagaatgggcttcagaaccctgagcaaggtgagaagcgacaagagccttaagttcaccagaatgcagaaggccggcttcctgtactacgaagatctggtgagctgcgtgaccagagccgaggccgaggccgtgagcgtgctggtgaaggaggccgtgtgggccttcctgcccgacgccttcgtgaccatgaccggcggcttcagaagaggcaagaagatgggccacgacgtggacttcctgatcaccagccccggcagcaccgaggacgaggagcagctgctgcagaaggtgatgaacctgtgggagaagaagggcctgctgctgtactacgacctggtggagagcaccttcgagaagctgagactgcccagcagaaaggtggacgccctggaccacttccagaagtgcttcctgatcttcaagctgcccagacagagagtggacagcgaccagagcagctggcaggagggcaagacctggaaggccatcagagtggacctggtgctgtgcccctacgagagaagagccttcgccctgctgggctggaccggcagcagacagttcgagagagacctgagaagatacgccacccacgagagaaagatgatcctggacaaccacgccctgtacgacaagaccaagagaatcttcctgaaggccgagagcgaggaggaaatcttcgcccacctgggcctggactacatcgagccctgggagagaaacgcctgatctaga

SEQ ID NO: 6 - protein, 509 aa, Homo sapiens
MDPPRASHLSPRKKRPRQTGALMASSPQDIKFQDLVVFILEKKMGTTRRAFLMELARRKGFRVENELSDSVTHIVAENNSGSDVLEWLQAQKVQVSSQPELLDVSWLIECIRAGKPVEMTGKHQLVVRRDYSDSTNPGPPKTPPIAVQKISQYACQRRTTLNNCNQIFTDAFDILAENCEFRENEDSCVTFMRAASVLKSLPFTIISMKDTEGIPCLGSKVKGIIEEIIEDGESSEVKAVLNDERYQSFKLFTSVFGVGLKTSEKWFRMGFRTLSKVRSDKSLKFTRMQKAGFLYYEDLVSCVTRAEAEAVSVLVKEAVWAFLPDAFVTMTGGFRRGKKMGHDVDFLITSPGSTEDEEQLLQKVMNLWEKKGLLLYYDLVESTFEKLRLPSRKVDALDHFQKCFLIFKLPRQRVDSDQSSWQEGKTWKAIRVDLVLCPYERRAFALLGWTGSRQFERDLRRYATHERKMILDNHALYDKTKRIFLKAESEEEIFAHLGLDYIEPWERNA

SEQ ID NO: 7 - DNA, 3385 bp, Artificial Sequence
  LacZ recombination signal sequence
ttaattaagcttctgcacctcgaagggtacctactgtgcgagagacacagtgctccagggctgaacaaaaaccgaattctcacttctggcaccacaccagctgatagtggtatctgccggcggacagctgaaactcggcggacacgctgggggaccagctgtcgtcgccgccgatgcccatgtggaagccgtcgatgttcagccaggtgccctcctcggcgtgcagcaggtgccggtggcttgtctccatcagctgctgctgagagtaccggctgatgttgaactggaagtcgcccctccactggtgggggccgtagttcagctcccgggtgccgcatctcaggccattctcgctggggaacacgtagggggtgtacatgtcgctcagaggcaggtcccatctgtcgaagcaggcggcggtcagccggtcggggtagttctcctgggggcccaggcccagccagttcactctctcggccacctgggccagctgacagttcaggccgattctggcggggtgaggggtgtcggaggccacctccacgtccactgtgatggccatctggccgctgccgtcgatccggtaggtctttctggagatgaacagtgtcttgccctggtgctgccaagcgtgggcggtggtgatcagcacggcgtcggccagggtatcggcggtgcactgcagcagggcggcctcggcctggtagtgtccggcagccttccaccgctccacccaggcgttggggtcgatccgggtggcctcgctcacgccgatgtcgttgtccaggggggctctggtgaactggtcccgcaggggggtcagcagctgcttcttgtcgccgatccacatctgggacaggaagccgctctgccggttgaactgccaccgcttgttgcccagctcgatgcaaaagtccatctcggaggtggtcaggtgggggatggcgtggctggcggcaggcagggtcacggacaggttctcggccagccgccactgctgccaggcgctgatgtggccggcctcggaccaggcggtggcgttgggctgcaccacccgcacggtcagccacagctggccggcagactcaggctggggcagctcaggcagctcgatcagctgcttgccctggggggccacgtccagtggcacctcgccggaggccagaggcttgccgtccagggccaccatccagtgcagcagctcgttgtcgctgtgccggaacaggtactcgctggtcacctcgatggtctggccggacagccggaactggaagaactgctgctggtgcttggcttcggtcagggcagggtggggggtccggtcggcgaacaccaggccattcatgcagaactgccggtcattgggggtgtcgccgaagtcgccgccgtaggcgctccaagggttgccgttctcgtcgtacttgatcaggctctggtccacccagtcccacacaaagccgccctgcagccgggggtactgccggaaggcctgccagtacttggcgaagccgcccaggctgttgcccatggcgtgggcgtactcgcacaggatcaggggccgtgtctcgccgggcagggacagccacttcttgatgctccacttaggcacggcggggaagggctggtcctcgtccactctggcgtacatggggcagatgatgtcggtggcggtggtgtcggctcctccgccctcgtactgcacgggcctgctggggtccacgctcttgatccaccggtacagggcgtcgtggttggcgccgtggccgctctcgttgcccagggaccagatgatcacgctggggtggttccggtcccgctgcaccatccgggtcacgcgctcgctcatggcgggcagccatctggggtcgtcggtcagcctgttcatgggcaccatgccgtgtgtctcgatgttggcctcgtccaccacgtacaggccgtatctgtcgcacagggtgtaccacagagggtggttggggtagtggctgcaccgcacggcgttgaagttgttctgcttcatcagcaggatgtcctgcaccatggtctgctcgtccatcacctggccgtgcagggggtggtgctcgtgccggttcacgccccggatcagcaggggcttgccgttcagcagcagcaggccgttctcgatccgcacctcccggaagcccacgtcgcaggcctcggcctcgatcagggtgccgtcggcggtgtgcagctccaccacggcccggtacaggttggggatctcggcgctccacagcttggggttctccacgttcagccgcagggtcactctgtcggcgtagccgcccctctcgtcgatgatctcgccgccgaaaggggcggtgccgctggccacctgtgtctcgccctgccacagggacacggtcactctcaggtagtcccgcagctcgccgcacatctgcacctcggcctccagcacggccctgctgaagtcgtcgttgaaccgggtggccacgtggaagtcgctgatctgggtggtgggcttgtgcagcagggacacgtcccggaagatgccgctcatccgccacatgtcctggtcctccaggtagctgccgtcgctccaccgcagcaccatcacggccagcctgttctcgccggctctcaggaaggcgctcaggtcgaactcgctgggcagccggctatcctggccgtagcccacccatctgccgttgcaccacaggtggaaggcgctgttcacgccgtcgaagatgatcctggtctggccctcctgcagccaggactcgtccacgttgaaggtcaggctgtagcagccggtggggttctcggtgggcacgaagggggggttcacggtgatggggtaggtcacgttggtgtagatgggggcgtcgtagccgtgcatctgccagttgctgggcaccaccacggtgtcggcctcgggcaggtcgcactccagccagctctcgggcacggcctcgggggcagggaaccaggcgaaccgccactcgccgttcaggctccgcagctgctgggagggcctgtcggtccgggcctcctcgctgttccgccagctggcaaagggagggtgggcggccagccggttcagctgggtcacgccagggttctcccagtcccgccgctgcagcaccacggccaggctgtcggtgatcatggtggcggctctagactagatcttccggaacacactggcctcccacagtggtagtactccactgtctgggtgtacaaaaaccggatcctttaccagacatgataagatacattgatgagtttggacaaaccacaactagaatgcagtgaaaaaaatgctttatttgtgaaatttgtgatgctattgctttatttgtaaccattataagctgcaataaacaagttctcgaggcgcgcc

SEQ ID NO: 8 - protein, 1022 aa, Artificial Sequence
  LacZ recombination signal sequence
MITDSLAVVLQRRDWENPGVTQLNRLAAHPPFASWRNSEEARTDRPSQQLRSLNGEWRFAWFPAPEAVPESWLECDLPEADTVVVPSNWQMHGYDAPIYTNVTYPITVNPPFVPTENPTGCYSLTFNVDESWLQEGQTRIIFDGVNSAFHLWCNGRWVGYGQDSRLPSEFDLSAFLRAGENRLAVMVLRWSDGSYLEDQDMWRMSGIFRDVSLLHKPTTQISDFHVATRFNDDFSRAVLEAEVQMCGELRDYLRVTVSLWQGETQVASGTAPFGGEIIDERGGYADRVTLRLNVENPKLWSAEIPNLYRAVVELHTADGTLIEAEACDVGFREVRIENGLLLLNGKPLLIRGVNRHEHHPLHGQVMDEQTMVQDILLMKQNNFNAVRCSHYPNHPLWYTLCDRYGLYVVDEANIETHGMVPMNRLTDDPRWLPAMSERVTRMVQRDRNHPSVIIWSLGNESGHGANHDALYRWIKSVDPSRPVQYEGGGADTTATDIICPMYARVDEDQPFPAVPKWSIKKWLSLPGETRPLILCEYAHAMGNSLGGFAKYWQAFRQYPRLQGGFVWDWVDQSLIKYDENGNPWSAYGGDFGDTPNDRQFCMNGLVFADRTPHPALTEAKHQQQFFQFRLSGQTIEVTSEYLFRHSDNELLHWMVALDGKPLASGEVPLDVAPQGKQLIELPELPQPESAGQLWLTVRVVQPNATAWSEAGHISAWQQWRLAENLSVTLPAASHAIPHLTTSEMDFCIELGNKRWQFNRQSGFLSQMWIGDKKQLLTPLRDQFTRAPLDNDIGVSEATRIDPNAWVERWKAAGHYQAEAALLQCTADTLADAVLITTAHAWQHQGKTLFISRKTYRIDGSGQMAITVDVEVASDTPHPARIGLNCQLAQVAERVNWLGLGPQENYPDRLTAACFDRWDLPLSDMYTPYVFPSENGLRCGTRELNYGPHQWRGDFQFNISRYSQQQLMETSHRHLLHAEEGTWLNIDGFHMGIGGDDSWSPSVSAEFQLSAGRYHYQLVWCQK

SEQ ID NO: 9 - DNA, 889 bp, Artificial Sequence
  Gene optimized sequence for expression in mammalian cells
ggcgcgccaagcttgccgccaccatggacatgcgggtgcccgcccagctcctggggctcctgctactctggctccgaggtaaggatggagaacactaggaatttactcctcgagctcgcggccgcagccagtgtgctcagtactgactggaacttcagggaagttctctgataacatgattaatagtaagaatatttgtttttatgtttccaatctcaggtgccagatgtgacatccagatgacccagagccccagcagcctgagcgccagcgtgggcgacagagtgaccatcacctgccgggccagccagagcatcagcaactacctgaactggtatcagcagaagcccggcaaggcccccaagttcctgatctacggcgccagctccctggaaagcggcgtgcccagccggtttagcggcagcggctccggcaccgacttcaccctgaccatcagcagcctgcagcccgaggacttcgccacctactactgccagcagagctacagcaaccccctgacctttggcggcggaacaaaggtggagatcaagcggaccgtggccgctcccagcgtgttcatcttcccccccagcgacgagcagcttaagagcggtaccgctagcgtggtgtgcctgctgaacaacttctacccccgggaggccaaggtgcagtggaaggtggacaacgccctgcagagcggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgctaatctagattaattaa

SEQ ID NO: 10 - protein, 236 aa, Artificial Sequence
  Gene optimized sequence for expression in mammalian cells
MDMRVPAQLLGLLLLWLRGARCDIQMTQSPSSLSASVGDRVTITCRASQSISNYLNWYQQKPGKAPKFLIYGASSLESGVPSRFSGSGSGTDFTLTISSLQPEDFATYYCQQSYSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11 - DNA, 3134 bp, Artificial Sequence
  A heavy chain vector designed to express human IgG on the cell surface
ggcgcgccggatccactagccagtgtggtgcttaagtgcagatatcctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggagcggccgcgccgccaccatggggtcaaccgccatcctcgccctcctcctggctgttctccaaggagtctgtgccgaggtgcagctggtgcagtctggagcagaggtgaaaaagcccggggagtctctgaaaatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctccagtggagcagcctgaaggcctcggacaccgccatgtattactgtgcgagacaggacggcgacagctttgactactggggccagggaaccctggtcaccgtctcctcaggtgagtcctcacaacctctctcctgctttaactctgaagggttttgctgcatttctggggggaaataagggtgctgggtctcctgccaagagagcccctgcagagggccaccctaggcctctggggtccaatgcccaacaacccccgggccctccccgggctcagtctgagagggtcccagggacgtagcggggcgccggtttttgtacacccagacagtggagtactaccactgtgacaactggttcgacccctggggccagggaaccctggtcaccgtctcctcaggtgagtcctcaccaccccctctctgagtccacttagggagactcagcttgccagggtctcagggtcagagtcttggaggcattttggaggtcaggaaggaggccagcagagggttccatgagaagggcaggacagggccacggacagtcagcttccatgtgacgcccggagacagaaggtctctgggtggctggtttttgtacacccagacagtggagtactaccactgtgattactactactactactacatggacgtctggggcaaagggaccacggtcaccgtctcctcaggtaagaatggccactctagggcctttgttttctgctactgcctgtggggtttcctgagcattgcaggttggtcctcggggcatgttccgaggggacctgggcggacgctagcgaacctcgcggacagttaagaacccaggggcctctgcgccctgggcccagctctgtcccacaccgcggtcacatggcaccacctctcttgcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcataccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctctagaacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaaggtgggacccgtggggtgcgaataacttcgtataatgtatgctatacgaagttatgggccacatggaattcagaggccggctcggcccaccctctgccctgagagtgaccgctgtaccaacctctgtccctacagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggcaaagctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttaggttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgacgcgt

SEQ ID NO: 12 - protein, 515 aa, Artificial Sequence
  A heavy chain vector designed to express human IgG on the cell surface
MGSTAILALLLAVLQGVCAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQDGDSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKAVGQDTQEVIVVPHSLPFKVVVISAILALVVLTIISLIILIMLWQKKPR

SEQ ID NO: 13 - DNA, 11 bp, Artificial Sequence
  D segment encoding sequence
ctaactgggga

SEQ ID NO: 14 - DNA, 4193 bp, Artificial Sequence
  Nucleotide sequence variant of the V64 antibody generation vector
ggatccactagccagtgtggtgcttaagtgcagatatcgcggccgcctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggagccgccaccatggggtcaaccgccatcctcgccctcctcctggctgttctccaaggagtctgtgccgaggtgcagctggtgcagtctggagcagaggtgaaaaagcccggggagtctctgaaaatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctccagtggagcagcctgaaggcctcggacaccgccatgtattactgtgcgagacacacagtggtagtactccactgtctgggtgtacaaaaacctccacaccgcaggtgcagaaactagtctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggagccgccaccatggagtttgggctgagctgggttttccttgttgctattataaaaggtgtccagtgtcaggtacagctccagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctccagctgaactctgtgactcccgaggacacggctgtgtattactgtgcaagagacacagtggtagtactccactgtctgggtgtacaaaaacctccctgcacggatgctcaggtccggaccagtgggcaccctcttccaggacagtcctcagtgatatcacatcgggaacccacatctggatcaggacggcacccagaacacaagatggcccatggggacagccccacagcccagcccttcccagacccctaaaaggtgtcccaccccctgcacctaccccaggactaaaaatccaggaggcctgactcctgcacatgctctgaccggatgtcacctcggcccctcctggaggggacaggagccctggagggtgagtcagaccctcctgccctcgacggcaggcggggaagattcagaccggtctgagatccccaggatgcagcaccactgtcaatgggggccccagacgcctggaccagcacctgcgtgggaaatgcctctgggctcactgaggggctttttgtgaaggccctcctgctatgtgactatggtgctaactaccacagtgatgaacccagcagcaaaaactgaccggactcccagggtttatgcacacttctcggctcagagttctccaggataagaagagccaggcccaaggatttctgcccagaccctcggcctctagggacaccttggccatgaaagcccatgggctggtgccccacacttcatctgccttcaaacaagggcttcagagggctctgaggtgacctcactcatgaccacaggtgcctgccagctgcaccgaaccctgtcccaacagctgccacagttccaacagccaattcctagggccgggaattgctgtagacaccagccttgttccagcacctcctgccaattgcctggattcccatcctggctggaatcaagagggcagcatccgcaagcttatgctcccccgggaccccgggctgtggtttttgtacacccagacagtggagtactaccactgtggctgaatacttccagcactggggccagggcaccctggtcaccgtctcctcaggtgagtctgctgtctggggatagcggggagccaggtgtactgggccaggcaagggctttgggctccttctccggctgtttgggaccacgttcagcagaaggcctttctttgggaactgggactctgctgctggggggcttcagacttggggacaggtgctcagcaaaggaggtcggcaggagggcggagggtggtttttgtacacccagacagtggagtactaccactgtgctactggtacttcgatctctggggccgtggcaccctggtcactgtctcctcaggtgagtcccactgcacccccctcccagtcttctctgtccaggcaccaggccaggtatctggggtgtgcagccggcctgggtctggcctgaggccacaagcccgggggtctgtgtggctggggacagggacgccggctgcctctgctctgtgcttgggccatgtgacccattcgagtgtcctgcacgggcacaggtttttgtacacccagacagtggagtactaccactgtgtgatgcttttgatatctggggccaagggacaatggtcaccgtctcttcaggtaagatggctttccttctgcctcctttctctgggcccagcgtcctctgtcctggagctgggagataatgtccgggggctccttggtctgcgctgggcaaagggtgggcagagtcatgcttgtgctggggacaaaatgaccttgggacacggggctggctgccacggccggcccgggacagtcggagagtcaggtttttgtacacccagacagtggagtactaccactgtgactactttgactactggggccagggaaccctggtcaccgtctcctcaggtgagtcctcacaacctctctcctgctttaactctgaagggttttgctgcatttctggggggaaataagggtgctgggtctcctgccaagagagcccctgcagagggccaccctaggcctctggggtccaatgcccaacaacccccgggccctccccgggctcagtctgagagggtcccagggacgtagcggggcgccggtttttgtacacccagacagtggagtactaccactgtgacaactggttcgacccctggggccagggaaccctggtcaccgtctcctcaggtgagtcctcaccaccccctctctgagtccacttagggagactcagcttgccagggtctcagggtcagagtcttggaggcattttggaggtcaggaaggaggccagcagagggttccatgagaagggcaggacagggccacggacagtcagcttccatgtgacgcccggagacagaaggtctctgggtggctggtttttgtacacccagacagtggagtactaccactgtgattactactactactactacatggacgtctggggcaaagggaccacggtcaccgtctcctcaggtaagaatggccactctagggcctttgttttctgctactgcctgtggggtttcctgagcattgcaggttggtcctcggggcatgttccgaggggacctgggcggacgctagc

SEQ ID NO: 15 - DNA, 4205 bp, Artificial Sequence
  Nucleotide sequence variant of the V64 antibody generation vector
ggatccactagccagtgtggtgcttaagtgcagatatcgcggccgcctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggagccgccaccatggggtcaaccgccatcctcgccctcctcctggctgttctccaaggagtctgtgccgaggtgcagctggtgcagtctggagcagaggtgaaaaagcccggggagtctctgaaaatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctccagtggagcagcctgaaggcctcggacaccgccatgtattactgtgcgagacacacagtggtagtactccactgtctgggtgtacaaaaacctccacaccgcaggtgcagaaactagtctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggagccgccaccatggagtttgggctgagctgggttttccttgttgctattataaaaggtgtccagtgtcaggtacagctccagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctccagctgaactctgtgactcccgaggacacggctgtgtattactgtgcaagagacacagtggtagtactccactgtctgggtgtacaaaaacctccctgcacggatgctcaggtccggaccagtgggcaccttcttccaggacattcctcggtcgcatcacagcaggcacccacatctggatcaggacggcccccagaacacaagatggcccatggggacagccccacaacccaggccttcccagacccctaaaaggcgtcccaccccctgcacctgccccagggctaaaaatccaggaggcttgactcccgcataccctccagccagacatcacctcagccccctcctggaggggacaggagcccgggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgactaccacagtgatgaaactagcagcaaaaactggccggacacccagggaccatgcacacttctcagcttggagctctccaggaccagaagagtcaggtctgagggtttgtagccagaccctcggcctctagggacaccctggccatcacagcagatgggctggtgccccacatgccatctgctccaaacaggggcttcagagggctctgaggtgacttcactcatgaccacaggtgccctggccccttccccgccagctacaccgaaccctgtcccaacagctgccccagttccaacagccaattcctggggcccagaattgctgtagacaccagcctcgttccagcacctcctgccaattgcctggattcacatcctggctggaatcaagagggcagcatccgcaagcttatgctcccccgggaccccgggctgtggtttttgtacacccagacagtggagtactaccactgtggctgaatacttccagcactggggccagggcaccctggtcaccgtctcctcaggtgagtctgctgtctggggatagcggggagccaggtgtactgggccaggcaagggctttgggctccttctccggctgtttgggaccacgttcagcagaaggcctttctttgggaactgggactctgctgctggggggcttcagacttggggacaggtgctcagcaaaggaggtcggcaggagggcggagggtggtttttgtacacccagacagtggagtactaccactgtgctactggtacttcgatctctggggccgtggcaccctggtcactgtctcctcaggtgagtcccactgcacccccctcccagtcttctctgtccaggcaccaggccaggtatctggggtgtgcagccggcctgggtctggcctgaggccacaagcccgggggtctgtgtggctggggacagggacgccggctgcctctgctctgtgcttgggccatgtgacccattcgagtgtcctgcacgggcacaggtttttgtacacccagacagtggagtactaccactgtgtgatgcttttgatatctggggccaagggacaatggtcaccgtctcttcaggtaagatggctttccttctgcctcctttctctgggcccagcgtcctctgtcctggagctgggagataatgtccgggggctccttggtctgcgctgggcaaagggtgggcagagtcatgcttgtgctggggacaaaatgaccttgggacacggggctggctgccacggccggcccgggacagtcggagagtcaggtttttgtacacccagacagtggagtactaccactgtgactactttgactactggggccagggaaccctggtcaccgtctcctcaggtgagtcctcacaacctctctcctgctttaactctgaagggttttgctgcatttctggggggaaataagggtgctgggtctcctgccaagagagcccctgcagagggccaccctaggcctctggggtccaatgcccaacaacccccgggccctccccgggctcagtctgagagggtcccagggacgtagcggggcgccggtttttgtacacccagacagtggagtactaccactgtgacaactggttcgacccctggggccagggaaccctggtcaccgtctcctcaggtgagtcctcaccaccccctctctgagtccacttagggagactcagcttgccagggtctcagggtcagagtcttggaggcattttggaggtcaggaaggaggccagcagagggttccatgagaagggcaggacagggccacggacagtcagcttccatgtgacgcccggagacagaaggtctctgggtggctggtttttgtacacccagacagtggagtactaccactgtgattactactactactactacatggacgtctggggcaaagggaccacggtcaccgtctcctcaggtaagaatggccactctagggcctttgttttctgctactgcctgtggggtttcctgagcattgcaggttggtcctcggggcatgttccgaggggacctgggcggacgctagcc

SEQ ID NO: 16 - DNA, 3365 bp, Artificial Sequence
  V67 vector sequence
ggatccactagccagtgtggtgcttaagtgcagatatcgcggccgcctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggagccgccaccatggggtcaaccgccatcctcgccctcctcctggctgttctccaaggagtctgtgccgaggtgcagctggtgcagtctggagcagaggtgaaaaagcccggggagtctctgaaaatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctccagtggagcagcctgaaggcctcggacaccgccatgtattactgtgcgagacacacagtggtagtactccactgtctgggtgtacaaaaacctccacaccgcaggtgcagaaactagccggaccagtgggcaccctcttccaggacagtcctcagtgatatcacatcgggaacccacatctggatcaggacggcacccagaacacaagatggcccatggggacagccccacagcccagcccttcccagacccctaaaaggtgtcccaccccctgcacctaccccaggactaaaaatccaggaggcctgactcctgcacatgctctgaccggatgtcacctcggcccctcctggaggggacaggagccctggagggtgagtcagaccctcctgccctcgacggcaggcggggaagattcagaccggtctgagatccccaggatgcagcaccactgtcaatgggggccccagacgcctggaccagcacctgcgtgggaaatgcctctgggctcactgaggggctttttgtgaaggccctcctgctatgtgactatggtgctaactaccacagtgatgaacccagcagcaaaaactgaccggactcccagggtttatgcacacttctcggctcagagttctccaggataagaagagccaggcccaaggatttctgcccagaccctcggcctctagggacaccttggccatgaaagcccatgggctggtgccccacacttcatctgccttcaaacaagggcttcagagggctctgaggtgacctcactcatgaccacaggtgcctgccagctgcaccgaaccctgtcccaacagctgccacagttccaacagccaattcctagggccgggaattgctgtagacaccagccttgttccagcacctcctgccaattgcctggattcccatcctggctggaatcaagagggcagcatccgcaagcttatgctcccccgggaccccgggctgtggtttttgtacacccagacagtggagtactaccactgtggctgaatacttccagcactggggccagggcaccctggtcaccgtctcctcaggtgagtctgctgtctggggatagcggggagccaggtgtactgggccaggcaagggctttgggctccttctccggctgtttgggaccacgttcagcagaaggcctttctttgggaactgggactctgctgctggggggcttcagacttggggacaggtgctcagcaaaggaggtcggcaggagggcggagggtggtttttgtacacccagacagtggagtactaccactgtgctactggtacttcgatctctggggccgtggcaccctggtcactgtctcctcaggtgagtcccactgcacccccctcccagtcttctctgtccaggcaccaggccaggtatctggggtgtgcagccggcctgggtctggcctgaggccacaagcccgggggtctgtgtggctggggacagggacgccggctgcctctgctctgtgcttgggccatgtgacccattcgagtgtcctgcacgggcacaggtttttgtacacccagacagtggagtactaccactgtgtgatgcttttgatatctggggccaagggacaatggtcaccgtctcttcaggtaagatggctttccttctgcctcctttctctgggcccagcgtcctctgtcctggagctgggagataatgtccgggggctccttggtctgcgctgggcaaagggtgggcagagtcatgcttgtgctggggacaaaatgaccttgggacacggggctggctgccacggccggcccgggacagtcggagagtcaggtttttgtacacccagacagtggagtactaccactgtgactactttgactactggggccagggaaccctggtcaccgtctcctcaggtgagtcctcacaacctctctcctgctttaactctgaagggttttgctgcatttctggggggaaataagggtgctgggtctcctgccaagagagcccctgcagagggccaccctaggcctctggggtccaatgcccaacaacccccgggccctccccgggctcagtctgagagggtcccagggacgtagcggggcgccggtttttgtacacccagacagtggagtactaccactgtgacaactggttcgacccctggggccagggaaccctggtcaccgtctcctcaggtgagtcctcaccaccccctctctgagtccacttagggagactcagcttgccagggtctcagggtcagagtcttggaggcattttggaggtcaggaaggaggccagcagagggttccatgagaagggcaggacagggccacggacagtcagcttccatgtgacgcccggagacagaaggtctctgggtggctggtttttgtacacccagacagtggagtactaccactgtgattactactactactactacatggacgtctggggcaaagggaccacggtcaccgtctcctcaggtaagaatggccactctagggcctttgttttctgctactgcctgtggggtttcctgagcattgcaggttggtcctcggggcatgttccgaggggacctgggcggacgctagc

SEQ ID NO: 17 - DNA, 2158 bp, Artificial Sequence
  V86 antibody generating substrate sequence
ggatccactagccagtgtggtgcttaagtgcagatatcgcggccgcctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggagccgccaccatggggtcaaccgccatcctcgccctcctcctggctgttctccaaggagtctgtgccgaggtgcagctggtgcagtctggagcagaggtgaaaaagcccggggagtctctgaaaatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctccagtggagcagcctgaaggcctcggacaccgccatgtattactgtgcgagacacacagtggtagtactccactgtctgggtgtacaaaaacctccacaccgcaggtgcagaaactagccggaccagtgggcaccctcttccaggacagtcctcagtgatatcacatcgggaacccacatctggatcaggacggcacccagaacacaagatggcccatggggacagccccacagcccagcccttcccagacccctaaaaggtgtcccaccccctgcacctaccccaggactaaaaatccaggaggcctgactcctgcacatgctctgaccggatgtcacctcggcccctcctggaggggacaggagccctggagggtgagtcagaccctcctgccctcgacggcaggcggggaagattcagaccggtctgagatccccaggatgcagcaccactgtcaatgggggccccagacgcctggaccagcacctgcgtgggaaatgcctctgggctcactgaggggctttttgtgaaggccctcctgctatgtgactatggtgctaactaccacagtgatgaacccagcagcaaaaactgaccggactcccagggtttatgcacacttctcggctcagagttctccaggataagaagagccaggcccaaggatttctgcccagaccctcggcctctagggacaccttggccatgaaagcccatgggctggtgccccacacttcatctgccttcaaacaagggcttcagagggctctgaggtgacctcactcatgaccacaggtgcctgccagctgcaccgaaccctgtcccaacagctgccacagttccaacagccaattcctagggccgggaattgctgtagacaccagccttgttccagcacctcctgccaattgcctggattcccatcctggctggaatcaagagggcagcatccgcaagcttctgcctcctttctctgggcccagcgtcctctgtcctggagctgggagataatgtccgggggctccttggtctgcgctgggcaaagggtgggcagagtcatgcttgtgctggggacaaaatgaccttgggacacggggctggctgccacggccggcccgggacagtcggagagtcaggtttttgtacacccagacagtggagtactaccactgtgactactttgactactggggccagggaaccctggtcaccgtctcctcaggtgagtcctcacaacctctctcctgctttaactctgaagggttttgctgcatttctggggggaaataagggtgctgggtctcctgccaagagagcccctgcagagggccaccctaggcctctggggtccaatgcccaacaacccccgggccctccccgggctcagtctgagagggtcccgctagc

SEQ ID NO: 18 - DNA, 28 bp, Artificial Sequence
  Recombination signal sequence
cacagtgctccagggctgaacaaaaacc

SEQ ID NO: 19 - DNA, 39 bp, Artificial Sequence
  Recombination signal sequence
cacagtggtagtactccactgtctgggtgtacaaaaacc

SEQ ID NO: 20 - DNA, 28 bp, `Artificial Sequence
  Recombination signal sequence
cacagtggtacagaccaatacaaaaacc

SEQ ID NO: 21 - DNA, 29 bp, Artificial Sequence
  Recombination signal sequence
cacatagcaggagggccttcacaaaaagc

SEQ ID NO: 22 - DNA, 28 bp, Artificial Sequence
  Recombination signal sequence
cacagtgatgaacccagcagcaaaaact

SEQ ID NO: 23 - DNA, 28 bp, Artificial Sequence
  Recombination signal sequence
cacagtaggaggggccttcacaaaaagc

SEQ ID NO: 24 - DNA, 28 bp, Artificial Sequence
  Recombination signal sequence
cacagtgatgaaactagcagcaaaaact

SEQ ID NO: 25 - DNA, 29 bp, Artificial Sequence
  Recombination signal sequence
cacatagcaggagggccttcacaaaaagc

SEQ ID NO: 26 - DNA, 28 bp, Artificial Sequence
  Recombination signal sequence
cacagtgatgaacccagcagcaaaaact

SEQ ID NO: 27 - DNA, 29 bp, Artificial Sequence
  Recombination signal sequence
cacatagcaggagggccttcacaaaaagc

SEQ ID NO: 28 - DNA, 28 bp, Artificial Sequence
  Recombination signal sequence
cacagtgatgaacccagcagcaaaaact

SEQ ID NO: 29 - DNA, 28 bp, Artificial Sequence
  Recombination signal sequence
cacagtgatacagaccttaacaaaaacc

SEQ ID NO: 30 - DNA, 39 bp, Artificial Sequence
  Recombination signal sequence
cacagtggtagtactccactgtctggctgtacaaaaacc

SEQ ID NO: 31 - DNA, 28 bp, Artificial Sequence
  Recombination signal sequence
cacagtgctacagactggaacaaaaacc

SEQ ID NO: 32 - DNA, 39 bp, Artificial Sequence; identical to SEQ ID NO: 30
  Recombination signal sequence

SEQ ID NO: 33 - DNA, 28 bp, Artificial Sequence
  Recombination signal sequence
cacagtgctccagggctgaacaaaaacc

SEQ ID NO: 34 - DNA, 39 bp, Artificial Sequence; identical to SEQ ID NO: 19
  Recombination signal sequence

SEQ ID NO: 35 - DNA, 28 bp, Artificial Sequence
  Recombination signal sequence
cacagtgctacagactggaacaaaaacc

SEQ ID NO: 36 - DNA, 39 bp, Artificial Sequence
  Recombination signal sequence
cacagtgttgcaaccacatcctgagtgtgtacaaaaacc

SEQ ID NO: 37 - DNA, 28 bp, Artificial Sequence
  Recombination signal sequence
cacagtgctacagactggaacaaaaacc

SEQ ID NO: 38 - DNA, 39 bp, Artificial Sequence; identical to SEQ ID NO: 30
  Recombination signal sequence

SEQ ID NO: 39 - DNA, 28 bp, Artificial Sequence
  Recombination signal sequence
cacagtgctacagactggaacaaaaacc

SEQ ID NO: 40 - DNA, 39 bp, Artificial Sequence
  Recombination signal sequence
cacagtgacggagataaaggaggaagcaggacaaaaacc

SEQ ID NO: 41 - DNA, 28 bp, Artificial Sequence
  Recombination signal sequence
cacagtggtacagaccaatacagaaacc

SEQ ID NO: 42 - DNA, 39 bp, Artificial Sequence
  Recombination signal sequence
cacagtggccgggccccgcggcccggcggcacaaaaacc

SEQ ID NO: 43 - DNA, 28 bp, Artificial Sequence
  Recombination signal sequence
cacggtgctacagactggaacaaaaacc

SEQ ID NO: 44 - DNA, 39 bp, Artificial Sequence; identical to SEQ ID NO: 30
  Recombination signal sequence

SEQ ID NO: 45 - DNA, 28 bp, Artificial Sequence
  Recombination signal sequence
cacaatgctacagactggaacaaaaacc

SEQ ID NO: 46 - DNA, 39 bp, Artificial Sequence; identical to SEQ ID NO: 30
  Recombination signal sequence

SEQ ID NO: 47 - DNA, 28 bp, Artificial Sequence
  Recombination signal sequence
cacagcgctacagactggaacaaaaacc

SEQ ID NO: 48 - DNA, 39 bp, Artificial Sequence; identical to SEQ ID NO: 30
  Recombination signal sequence

SEQ ID NO: 49 - DNA, 28 bp, Artificial Sequence
  Recombination signal sequence
cacagtgctacagactggaacaaaaacc

SEQ ID NO: 50 - DNA, 39 bp, Artificial Sequence
  Recombination signal sequence
cacaatggtagtactccactgtctggctgtacaaaaacc

SEQ ID NO: 51 - DNA, 28 bp, Artificial Sequence
  Recombination signal sequence
cacagtgctacagactggaacaaaaacc

SEQ ID NO: 52 - DNA, 39 bp, Artificial Sequence
  Recombination signal sequence
cacagcggtagtactccactgtctggctgtacaaaaacc

SEQ ID NO: 53 - DNA, 28 bp, Artificial Sequence
  Recombination signal sequence
cacagtgctacagactggaacaaaaacc

SEQ ID NO: 54 - DNA, 39 bp, Artificial Sequence
  Recombination signal sequence
cacagtagtagtactccactgtctggctgtacaaaaacc

SEQ ID NO: 55 - DNA, 28 bp, Artificial Sequence
  Recombination signal sequence
cacagtgctacagactggaacaaaaacc

SEQ ID NO: 56 - DNA, 39 bp, Artificial Sequence
  Recombination signal sequence
cacagtggtagtactccactgtctggctgtacaataacc

SEQ ID NO: 57 - DNA, 28 bp, Artificial Sequence
  Recombination signal sequence
cacagtgctacagactggaacaaaaacc

SEQ ID NO: 58 - DNA, 39 bp, Artificial Sequence
  Recombination signal sequence
cacagtggtagtactccactgtctggctgtacaagaacc

SEQ ID NO: 59 - DNA, 28 bp, Artificial Sequence
  Recombination signal sequence
cacagtgctacagactggaacaaaaacc

SEQ ID NO: 60 - DNA, 39 bp, Artificial Sequence
  Recombination signal sequence
cacagtggtagtactccactgtctggctgtacacgaacc

SEQ ID NO: 61 - DNA, 28 bp, Artificial Sequence
  Recombination signal sequence
cacagtgctacagactggacaaaaaccc

SEQ ID NO: 62 - DNA, 39 bp, Artificial Sequence; identical to SEQ ID NO: 30
  Recombination signal sequence

SEQ ID NO: 63 - DNA, 28 bp, Artificial Sequence
  Recombination signal sequence
cacagtgctacagactggaacaaaaacc

SEQ ID NO: 64 - DNA, 39 bp, Artificial Sequence; identical to SEQ ID NO: 60
  Recombination signal sequence

SEQ ID NO: 65 - DNA, 28 bp, Artificial Sequence
  Recombination signal sequence
cacaatgctacagactggaacaaaaacc

SEQ ID NO: 66 - DNA, 39 bp, Artificial Sequence; identical to SEQ ID NO: 50
  Recombination signal sequence

SEQ ID NO: 67 - DNA, 28 bp, Artificial Sequence
  Recombination signal sequence
cacagcgctacagactggaacaaaaacc

SEQ ID NO: 68 - DNA, 39 bp, Artificial Sequence; identical to SEQ ID NO: 52
  Recombination signal sequence

SEQ ID NO: 69 - DNA, 28 bp, Artificial Sequence
  Recombination signal sequence
tacagtgctacagactggaacaaaaacc

SEQ ID NO: 70 - DNA, 39 bp, Artificial Sequence; identical to SEQ ID NO: 54
  Recombination signal sequence

SEQ ID NO: 71 - DNA, 28 bp, Artificial Sequence
  Recombination signal sequence
gacagtgctacagactggaacaaaaacc

SEQ ID NO: 72 - DNA, 39 bp, Artificial Sequence; identical to SEQ ID NO: 30
  Recombination signal sequence

SEQ ID NO: 73 - DNA, 28 bp, Artificial Sequence
  Recombination signal sequence
catagtgctacagactggaacaaaaacc

SEQ ID NO: 74 - DNA, 39 bp, Artificial Sequence; identical to SEQ ID NO: 50
  Recombination signal sequence

SEQ ID NO: 75 - DNA, 28 bp, Artificial Sequence
  Recombination signal sequence
cacaatgctacagactggaacaaaaacc

SEQ ID NO: 76 - DNA, 39 bp, Artificial Sequence
  Recombination signal sequence
catagtggtagtactccactgtctggctgtacaaaaacc

SEQ ID NO: 77 - DNA, 28 bp, Artificial Sequence
  Recombination signal sequence
cacagtgctacagactggaacaaaaacc

SEQ ID NO: 78 - DNA, 39 bp, Artificial Sequence
  Recombination signal sequence
cacagtggtagtactccactgtctggctgttgtctctga

SEQ ID NO: 79 - DNA, 28 bp, Artificial Sequence
  Recombination signal sequence
cagagtgctccagggctgaacaaaaacc

SEQ ID NO: 80 - DNA, 39 bp, Artificial Sequence; identical to SEQ ID NO: 19
  Recombination signal sequence

SEQ ID NO: 81 - DNA, 28 bp, Artificial Sequence
  Recombination signal sequence
cacagtgctccagggctgaaaaaaaacc

SEQ ID NO: 82 - DNA, 39 bp, Artificial Sequence; identical to SEQ ID NO: 19
  Recombination signal sequence

SEQ ID NO: 83 - DNA, 28 bp, Artificial Sequence
  Recombination signal sequence
ctcagtgctccagggctgaacaaaaacc

SEQ ID NO: 84 - DNA, 39 bp, Artificial Sequence; identical to SEQ ID NO: 19
  Recombination signal sequence

SEQ ID NO: 85 - DNA, 17 bp, Artificial Sequence
  D segment encoding sequence
ggtacaactggaacgac

SEQ ID NO: 86 - DNA, 17 bp, Artificial Sequence
  D segment encoding sequence
ggtataactggaactac

SEQ ID NO: 87 - DNA, 17 bp, Artificial Sequence
  D segment encoding sequence
ggtataactggaacgac

SEQ ID NO: 88 - DNA, 20 bp, Artificial Sequence
  D segment encoding sequence
ggtatagtgggagctactac

SEQ ID NO: 89 - DNA, 31 bp, Artificial Sequence
  D segment encoding sequence
aggatattgtagtagtaccagctgctatacc

SEQ ID NO: 90 - DNA, 31 bp, Artificial Sequence
  D segment encoding sequence
aggatattgtactaatggtgtatgctatacc

SEQ ID NO: 91 - DNA, 31 bp, Artificial Sequence
  D segment encoding sequence
aggatattgtagtggtggtagctgctactcc

SEQ ID NO: 92 - DNA, 28 bp, Artificial Sequence
  D segment encoding sequence
agcatattgtggtggtgactgctattcc

SEQ ID NO: 93 - DNA, 31 bp, Artificial Sequence
  D segment encoding sequence
gtattacgatttttggagtggttattatacc

SEQ ID NO: 94 - DNA, 31 bp, Artificial Sequence
  D segment encoding sequence
gtattacgatattttgactggttattataac

SEQ ID NO: 95 - DNA, 31 bp, Artificial Sequence
  D segment encoding sequence
gtattactatggttcggggagttattataac

SEQ ID NO: 96 - DNA, 37 bp, Artificial Sequence
  D segment encoding sequence
gtattatgattacgtttgggggagttatcgttatacc

SEQ ID NO: 97 - DNA, 31 bp, Artificial Sequence
  D segment encoding sequence
gtattactatgatagtagtggttattactac

SEQ ID NO: 98 - DNA, 16 bp, Artificial Sequence
  D segment encoding sequence
tgactacagtaactac

SEQ ID NO: 99 - DNA, 16 bp, Artificial Sequence
  D segment encoding sequence
tgactacagtaactac

SEQ ID NO: 100 - DNA, 16 bp, Artificial Sequence
  D segment encoding sequence
tgactacggtgactac

SEQ ID NO: 101 - DNA, 19 bp, Artificial Sequence
  D segment encoding sequence
tgactacggtggtaactcc

SEQ ID NO: 102 - DNA, 20 bp, Artificial Sequence
  D segment encoding sequence
gtggatacagctatggttac

SEQ ID NO: 103 - DNA, 23 bp, Artificial Sequence
  D segment encoding sequence
gtggatatagtggctacgattac

SEQ ID NO: 104 - DNA, 20 bp, Artificial Sequence
  D segment encoding sequence
gtggatacagctatggttac

SEQ ID NO: 105 - DNA, 20 bp, Artificial Sequence
  D segment encoding sequence
gtagagatggctacaattac

SEQ ID NO: 106 - DNA, 18 bp, Artificial Sequence
  D segment encoding sequence
gagtatagcagctcgtcc

SEQ ID NO: 107 - DNA, 21 bp, Artificial Sequence
  D segment encoding sequence
gggtatagcagcagctggtac

SEQ ID NO: 108 - DNA, 21 bp, Artificial Sequence
  D segment encoding sequence
gggtatagcagtggctggtac

SEQ ID NO: 109 - DNA, 11 bp, Artificial Sequence
  D segment encoding sequence
ctaactgggga

SEQ ID NO: 110 - DNA, 1279711 bp, Homo sapiens
aagcttaaatagtgttgcaagttttaatatgcctacttttcaatttttcaatactatttttactccaaagccatggtgacccacgctcgggtgggtcctgaggagaacaaagctctggttctgatcctaaccctaaccctgtcccaagactttgaccctgaacctaaatcctgatccctaccctggtccctaattctgacccttactttgaccctgactttgagcttgaccttgaccatgaccccacctctaaccatacttcccgccctgactctgaaccagatcctaatcctatccctaaccctattattatatttacaatctatgtctaatctaaccgtctagtgctaaatagctgtacccaaaggcacttttaaattatttaacttcttttccttgaattctctaaggacatcctaaaggagatgtcattatgtattttgcattccctctgagtggtatggcttcagatatgaacttctaatactttgcaagacataaaaagtttggagggtaacagcactgggttgttagggatgtatgttggcattcatggtagtcattggtgctgttctccaaatattttcagttcattttttatgaatgcattctgactcttccatcccacctacttaaattttctaatggccacatgagttttttttgttttgttttttttgccaatggaggtgagaagaaataacatgtgactttttcaggagaaatctccaagaaacagagttctattctgcatgcttttttctcttttctatagcaatggggatcttattgatggtccctccttccgtctggattcctgtgttaggatgacacagcacagagctacctctcacctgacccgtgatgagatgttttgtggcaacatgatctcaagataatgataattataaaaccctttactgacaaaatgtagatctccattttttcattgtaatttaactttgccttactttaagaacagtagtttgcagctccaaatgcactgattaaagacagacgtccattttctctggaaatgtatttttatgttcttactggatgtatttgctgttaatgtttgctactatgaagatacctgaacagtgtccacattagagaataagagaaagtaatgggcagattaaccctgtgcatctagacccgggaatcctttgaccctaccctccctgaaatggagacacagaggatggatgagaaaaactgagcagtgcacccatgatcacaaaaagaatgacatggaaatgtgcctcttcccatctcatgaaacgcagctcatcctctgttctttcaggcccttggtgaagagccaccccatgtctgtcccttcctcagtgtccacaccatgaggtctgcactgatctgggcttcccttctcatcactctcagtattagtgtgcattgtgaatcaggtccagctgtggctgctctgcatggggctgcagtcagtacgtttcctctgtgttcatgtaagtcctgttgaagcttactgatggagtcagagggggaaacattgtacagcccagcggttctcacagactctcctgcaaagcctctgatttcacttgtactggctacagcatgagcttggtccagcaggcttcatgacagggatttgtgtgggtggcaacagtgagttatcagggttactctccatgagtacaagtaaattaacagtcccaagcaacaccctttcaagtgcagtctaccttaaaatgaccaatgtgaaagccaaggacaagaccttgtattactgtgagtgacataggagcaggaacatctgcgtgagcccagacacaaaatcctctgcagggagacaggagggaatcgcatggtagatgctgattggaactaccatgtgtcgctcagaactaccaggaggtactcagaaccactagggggcgctcaggacaccaggggacgctcaggacaaccagggggtgttcaggacaccagggggtggtccgagccaccagggggcactcaggacaccaggggacgctcagaaccattaattccttgtaaatccatgatttttttacaaatgttacttccaaaacattaacttagaaccgggaattttttttttttgacaaagtctccctcttgtcgcacaggctggagtgcagtggcatgatcttggctcatggcaacctccaactcccgggttcaagcaattctcctgcctcatacttctgagtagctgccaccacgtgcctgccaccatgcctggctaatgtttgtacttttagtagagacggggtttcaccatgttgaccaggctagtctcgaattcatgacctcaggtgatctgccccgctaggcttcccaaagtgctgggattacaggcgtgagccaccatgcccagcctatttgaagttttaatgctgcgtgttttctgagtaacgctagcaatgatctgtcagaacaatttttaaaataggttatttatatattttattaaaatactattattaaaagagtaaaattgtaaaaattgcacctgcaatctcagcactttgggaggttgaggcaggcagatcacttgagctcaggagttttagaacagcctggcaacacaatgaaatcctttctatacaaaaaaaatagctgggtgtgatgctgcctgtggtcccagatacttggaaggctgaggtggggggatcccttaatcctgggaggttgaggctgtagtgagatgtgattgtaccactgcactccagcctggttgacagagtgagaccctgtcttaaaaaatgtgtatccttgatacacattgtttccatgaatagagtttagtgtttttgtgctgtgatactcaaacaattatatatgttttctaacattaactcaccatatgcatggtgttttgtttctttttctttcatcagctgaaagtggaatggaaattaaacaccactttaaaggctcttgttctccactttggttggctcctggtgtcctgtttttcagactatttctccatcttcccttttactttaaaagtcttttatcttcctcagtctccatgcaggaaataaaaattccctttactttctgtcctccaagtctggtgaacagtttccttctcttcataataactgaagccaaccaagtttaggaggataacagttctccttagaatatgctcatctacctgcagactctctgccctcctcacccttttctaaggtcctgcagacatcaccctcattccattccctcccttccctaagtacgacagagtgggctctgcagctcctgctgccttctgtgtgctcagccctggggctccctagtgcttttgttgcaggacgatcaaagatgggagagaccaaacagagttcaggagagtcctttattaaaaggtgatcacctggctcagttggactagcatccaggaaagtctgagccctggacaaagaaagcagccaccttttacacagtcagtggctgggagctacatgatgcaggaagcgtaattacagaacagagaacaaaggcagttatttgttacttcatgtcttacatccttgggaatacatggttctgtaacatatacttaacaatcttatgaccttgcagctgtgctggggaggtaagcaagaaccctctgagcctcaaggaatgtgaaaccaatgagaacagataaggctcactgagcacagaaggaaaaacaggcagttagtattctctaacttagactacgggggaggggctacacactacagtaagccctgaggggaaagttaattttctggctttacatattgtaaaattcataaattacttcttcactttgatgatgaagcccaaatccccatgtgcttacactctctcagaccaccctctaggaagctgccattgtgagtgagccctaaaaagcatgggctgggtttagcttcatattgctggatgttctctattataaaggcatgttggcaaataaagactacagtttgtattgaatattcatgccaaagaagtttttttcaaaacttttcaagtaaaaaattttatcttgcctagtttgaaaattaccatctaaattcaacaaataaggtaatacagttttaaaagtgatgcttgtcttattagttattcaatttattaacaacagactgatatttaaaataaataccattgcacatttaagtgccatactgttctgggattttttaaggaatcagagagaccgactctgttcaggaggatatttattatttaggttcaggaggatatttattatttaggtgcaccggccaagtcgaattaacatccaaaggactgagcccagaacagagttcagttaccttttaagcattttgtggggtgggagaggggacatctgtgcagggtgaagcatactacagaagtgagaaacaaagacagttattcaattgaaacatgtattacatcatttcttccttttcaaggaaaaacatgttttgcgacttgagtttatctttctagtgaccttgcagctacactgctagggaatcagggtcttcaaaatgcctgagaagggaggagaggtaaggctcattagccacagaaaaacaggcagttagtattttaaaggactccagctctttctctttttcagggagaattgggttttcttacatacaactgagtttctgcttacacattctttaatttcttttaattcctgtttcaatacttgacaagaatggcatttacatacagttttaccaaaacatgtatttaaatatatttgtctttttaatattggaataggcagacatacacgtagatcagcattattttgtactaaaatctcaaactgcaaacacaatttaaattcaattaaataattagaataatatgaaacaaatgggtgtgttgttttggtgtttacgtatgcattcacttttgcatgggcacatgtatgagtctttgctgggctgttgtgcacgtatgtgtgtttgtatgaccaggaggttttcaaatacatcattaaattacatagttatattaatcttggcaaggcacttgtattctgttttctttaattctgtttgcagaaagtagacacatattcagtcttagttccagtgtagggagtgcttttcatgagaaaaataccagaaaaaagggcaaacatggggcccactaatgtaaaaattagccacaatgtgtatgtgtgtgtgtgtgtgtgtgtgtgtgtgtctgagttgaatagtagagttggagtgggcttctatccacatgcacctgcgcctacaggtattatcaggtacaataatcaactgcagaaccctaaaggaaataagagtccccccaaacccctgaagagtgtttgggttcaccatgtgtccaatgattcagtgcctctcgagctccaggaaacggctccctggtgatgcgtgagatcttttcttggggtgtccctgcagagttcgctgggtttcctaaggctgattcactatttcaaaagatggtgtgagaagcatatggtgtaaataaagcagaattctgagccagggcacagccactttatactgggctagagacactggtaggaatatactctgtcagctcagatagaaacctccctgcagggtgggggcagggctgcagggggcgctcaggacacatcgagcacagtcttctgccccagagcaggtgcacatgaggctggggagaggttcctctcagggcctgggacttcctttaaaaatatctaaaataagtatttcacaaggactgctgatgtttgtataaatatcctattcaattgtgagcatttatcaaactggatgttgtaatgagaaccacttttataatggcgatttcaaactctgctagttatcttaataatagcagctggaggtcaggaagagattattacttataaataagtgcaatttttggagagacacactcattcccaaaataacacattcacatattaaggtctagaaatggttcacgttgcccctgagacattcaaatgtgggttcaaagtgaggtgctgtcctcggggagttgttccccagtggaggaagcgctatcaacacagagttcagggatgggtaggggatgcgtggcctctaacaggattacgactcgaaccctcagctcctataattgtgtcgtccgtgtgtcatggatttctctttctcatactgggtcaggaattggtctattaaatagcatccttcatgaatatgcaaataactgaggggaatatagtatctctgtaccctgaaagcatcacccaacaacaacatccctccttgggagaatcccctagagcacagctcctcaccatggactggacctggagcatcctcttcttggtggcagcagcaacaggtaaggggctccccagtctcggggttgaggcagaaaccaggccactcaagtgaggctttacccacccctgtgtcctctccacaggtacctactcccaggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctccatggacacctctgccagcacagcatacctgcagatcagcagcctaaaggctgaggacatggccatgtattactgtgcgagatacaccatgtggaaacccacatcctgagagtgtcagaaatcctgatgtgggaggcagctgtgctgagctgaggcagtgatgcagcagtttccttaacttccatcttatctcattttgcatcgacatccacctttatattagccaagaatgtggaatagacgggtgctcataagagatccttaacttgcccattttaatgggttttccagaagatgtgagaagccactttgttagcaaagcatgccaaagccatgccctgctccagacacatgtgagcccatttcctgctctttgcttaactgacaagctctcatcagtgcacctgggctaatttcacatcaggtacaggaatatgttctaaaggaaagctaattttataatagcaattcctgcttaataaccttcagcttcattgtttttgtgtaatctatcaacaaattatgttagttcaaggttctcaatgggagtttctaataaatagaagggatgtatagaagttcccctaattaaaacaattgtgaacacaatcttggtattcagctgtgtctccacccttcttaccattcaccacaaagtaattctcacttctggaagctgggttcattttcaaattagttttttttttcattttaatatctcaaggttattgtatgtgactattttagcagaaattgaattttgggaaattgaactaaccaactgaaaataaattcacaactaaataacaagatgccagaatataattggctccaggctttgttaattcagcagtttatctacctaggcattatatttacacatcttcatgctatttttacagtcaactcccattatgtaagaaatggtcatacaccatttcttacatatggtaagatatctacgatggatattcagaactacgataaacattggatgcatccaggtttgtctgaactcactgagattattacactcagctgctgtttcaatgtgtctgaaggtataaatgacaattcgaatgacttgggtgtgtggatggttttacatgagtctttaagtgtagaacaatattgaccctgttccaaaatctgtccttgatccatgatcacactcatctcccagaacagctccttcaacacatttcctatctggatgaagaggactctgtgcttggtgaggggaggccacaggtagagaactgagttctcagagggcacagccagcatcctcctcccagggtgaacccgaaagactgcggcctccctcatcccttttcatctctccatacaaaggcaccacccacatgcaaatcctcacttaagcgcccacagggaaaccaccacacatttccttaaattcggcgttctgcttacacgggaaatgctttctgagagtcatggacctcgtgtgaaaagaacatgaaaaacctgtggttcttcctccccctggtggcagctcccagaagtgagtgtctccaggatgcagatatgaagatatgggaggctgcatctgagcccagggctcacagtgggtctctgtgttcacaggggtcctgtcccagtgcagctgcaggagtggggcccaggactggtgaagcttcggagaccctgtccctcacatgcgctgtctctggtgactccatcagcagtggtaactggtggagctggtccgccagtccccagggaaggggctggaatggattggatacatctattatagtgggaggagctactacaccccgtccctcaggagttgagtcaccatgtcaatagaaacgtccaagaaccagttttccctgaagctgagctctgtgaccgcagggaggcggagggggcgggcgcaggtgccgctcaggaccagcagggggcgcgcggggcccacagagcaggaggccgggtcaggagcaggtgcagggagggcggggcttcctcatctgctcagggctctccctcctcgccagcacctcagctgtctccagggctcctctttctttcttatctgtggttctgcttcctcacatccttgtggcaggcaagaaaggaggacgacaggcctggtgcggtggtgtatgcctgtaatccccgcactttgggaggccgaggcgggtggatcacctgacgtctggagttcgagaccagcctgaccaacatggagaaaccccgtctctactaaaagtacaaaattagccaggcgtggtggcgcatgcctgtaatcccagctactccggaggatgaggcaggagaacggcttgaacctggggggcggaggttgctgtgagccgagatcgtgccattgcactccagcctgggcaacaagagcaaaactccgtctaaaaaaaaataaaaggaagaagacaaattttcctcttacagtcgaagtatcaacaatactaggaactttcctacgagttcctgaatggccccttttttccttcttgattaaaaaaaagttctaatgcttctcaccatctctttatttgtgtcgtcaattgaattgtgccctctttgaaattcatatactgaaatcttgaatccagtggatctatattggaattttaagtatataattaaggttaaatgtggtcatacgtgtgagaccctaaagcaatagacatgttgtctttataagaagaggaagagacaccagagacctctcacttttcacgtgcacatagaaaggaggccatgtggacacacagtggactagaaggtggccctgggcaagccaggaagaagccgcaccaagaaccaccctgccagcaccgtgatcttggacattcagactgcagaattgtaagaaagtcagtatttgttgtttatgccacccactcctgttgtcttcttgtgaagacccacacagactaatactacataactctgttagctttgtctcctagaaggagaagcaggcccctgaggctgggcacatctcagatttccatataaagtaggcaaaaatagtaactcttataaaaaaatgtgtcaaggccctttctttcttttttttctttgagacagagtctcgctctgtcaccaggctggagtgcagtggcacgatctcggctcactacaacctccacctccagggttcaagtgattctccttcctcagcctcccaagtacctgggactacaggcacccgccaccaaccctggctaattttttgtatttttagtagagatggggtttcaccatgttagcaaggatggtctcgatctcctgacctcgtgatcctcccgcctcacctcccaaagtgctgggattacaggtgtgagccaccattggccatttttggtggaaaggtctctgaaaccaaccctggtgtctgtgccacaaaagttgtcttttatcttttatttggacataacaaatggacagtgagtaccacctggatggagactgaccactgaccatcttctgctgtctcctaagtatgtcaaagaaaaccacatcgacatcactatttttcttcaacctcctcgaatgaactatagaaatgatccctgaaagtatagtctattccttcaaccttctaaatttgcactaaatctcttcctaaatgagagctacagggggtctgagttttattcccttctttccagttttccccaagtacaaagagcagaatagactttcagtgaaatttggctgacaatgcccctaacaccacatcactttctaaaacccatatcctgcctccatccttctctggacacccctcatcgggctacccaggaatggccagaagctggcatcagcttctgggctgaggccacgagctatacacacatgtgatttcagttacacagactctactgcaggaccacacctgtgttctgaggcactcaggcacctgctgatctcagtcattctctaataaattacacacctcttattaataaaggtccaaatggtcccatcagctgcagagcagtggagtaaagctcatgggtgggtccgtcaggcagaagtcagacaatgggatgggtaggttggtcacctccattgtcactgaggttcccagtggattttaacagaataaaacaatattaacaacaaagggatcttgaaagtatttaaggtccaggaattttgtttggggggctagagaaagacatttttaaacagaaagccctaaagcacatacagcagctgacagagtggccactgtgcacatgacggctgaggagacagatggtaggggacattcccccaagatgtccctgggtgtgtgatggttggactcctcatgcatatgaaaataagagctggactcaggtagaaacaagggccataccccataggaaaggaagaaaaaaacagatgggcaaccctggagagagctcattagatttggtaggtttgagatgaaaattacttccatggattttaatgttctaagctaagtaagaatctcttcaataaagtgagaattaaaaggagaatggagctaggagttgagagaggcaacaaataatgagagagcagaaagcaaatccacaaaaaactgtcacatgacagaggccagaatggagctgatgcagctgcgtcatttcctacagacctagttgaccatgtggagaagaggcttgaacaaatggggacgttctccaaccttccaaatcagccttcttcttaggcttgagtagtaatcatggttctgagggtgaccttccaaattttcctgtctgtacctcttccaccaggggtagagtgtcttcccaaccataatggtttctctccagtgtcctcagcttctcctcctttgtacttaccctgcagattaaggatttcttctagatggagtttcctgggaatcctctgttttcttttgtttctgttgactccaccacaccccataggtcacaggtttgattggatttcccctggagacagtggaggtggatccaggcgttcaacagtcctcgctgttcttcccttcctgtcagcaccacaggacagcagataagggagttgactgtggatttttcaaattcctgggaaaagcctgcaaggactagtagattcacactctaataccattagcacatgcatccaaaaaaaatcctcactaaatatttccaggttagcctgttcctctctcaatgccatccagtggcacctgccctgggttcactaacatgtgggccccagtcctctctgcaggcctctctctcctcacatttcagtcttcttgctttctctgtgaaactaactcacaaatgttacaggtttttcttcttcctttattcacagtttttcaggtttgttgttaatgaggacagaataagatcatagtttcctcatttttcacattcccacactgagtagatttctatataaaagccagaaactaagagaacaaatcaaatatccatatccattacaggtgaatgttaaacaatttgacataagattatgaagtaaagtacaatgcagcattagaatcaaggcatcctcattcacataaagtcatggctacattcacaaataactgcgctgagtggaagtagctaaagtattaacagtgcacttcataaacttctatttgtataaactgtagaaggtaaaactattctaaagtaacagagaagagaatttggtgagaattgggtgttgaaagtaatggggtgttgagatgaaattacagagaagtgacagaaagatttagaggttaacttaattgcacacgacttaattgaaaccctgattaaagggttgcacacatacattaacatattccaaattgtgcagtatatatttgaattaattatttgttaattttgtacttaaaaaagcagtaacaaagaaacaaatgaatgtgttggttgaggaggagcaaaaaatagatggctattaacacttgaaacatcgctgacttttgaaagtacacatgtatgaacactggttctctctatatatatttcagataaacaacagaatacactaaaagaaaacagagatatcctggcaggggtggaatcctgcaaacctcactaggcatgtcccacactgccctggagttgtctcaggggagcagtcttctctagtggtcagaggcacaggcatggataatgggactaattctgtccagctgtgtgatcttgaccatattgtacagccactctgttctgtgtgtaatgtaaattccttaaaatgtaacattgacacttgcattaaatgtattctgcaaatatgtagaaatgaaataagatgatgactgctaaatagttatcaaggcatgatcacataatataaaatgatattttcctgagtgataagatgactaccaatctcccccaaggcactttgtctgctctgacccctgcccctcctcaggattcccatcccagagcttgctatacagtaggagacatgcaaacaggtttctccctttgttgatgaaaaccagcccagtcctgaccccgtaggtttgggagagaagccccagccctgggattcccaggggtttccgttttgtgatcaggactaaagacagaggacccatcatggagtctgggctgagctgggtttcacagttgttattttaaaaggtaaaccagagaaatagagtgtgagtgaatatatttgagagaaacagtggatatgtcaggcagtttctcaccaggatctctacgagtttacgggtgtccagtgtgaggtacagctggtggagtctggagaggacccaagacaacctgggttccctgagactctcctgtgcagcctctggattaaccttcagtagctactgaatgagctcggtttcccaggctccagggaaggggctggagtgagtagtagatatacagtgtgatggaagtcagatatgttatgcacaatctgtgacgagcagattcaccgtctccaaagaaaatgccaagaactcactgtatttgcaaatgaacagtctgagagcagagggcacagctgtgtgttactgtatgtgaggcaccaggtaagaagacatcagtgtgaacacagacacagaggttcctgtaatgataagggaggaggctgggataaagggagcactcaagacccacagaaaacaggggaagctctagggcaggtgcagacggtcgtcatgggctactttccttcagggtctgtggctttctctgcatccaacagttcccctgggagcctcttgacatttatgtttctgtgcccatccctgaggtctctggattagaaaaatttattataagaagtggaaacattctcatttgtcccaaaggcagatgtaagtaatggaggcataaaaatgcacaggaggccagggaggctgtagacactgccaccccagaatgtcaatctcaccactagtgctggagaagagtgggagtttgatggagcttacctaaataccctgggtccaagctaagttcagcgaggccactggtgcctcccagagctcagttgtccatcaggaatctcccatgtgtcccagcagcagccatgcctcagtacttccgctgtgcacagccattgtctgggaggagctcccaggttgggtgtctttggcacacaccaggtgacaggtgttagagtgcagtgcagcagctggctgcctggtctattgggctccctgatgttggagagatgggaggtggattctcagggccagcacccagtttgtgaatttttatataaaaaccatgattttacttcattttctcagatgacatagataattaagaacagagtctggtccggacgtggtggctgatgcctgtaatcccagcactttgggaggccaaggcgggcagatcacctgaggtcgagagttcgagaccagcctgaccaatatggaaaaatccatgtctactaacaatacaaaattagccaggcatggtagcatatgcctgtaatcccagctactagggaggctgaggcaggagaatcgcttgaacccgggaggtgaaggttgtggtgagccaagatcacaccattacactccagcctgggcaacaagagagagaatccatcaaaaaaaaaaacaacaaaaaaaaacagactttgcaaaataatgttcaaccttatcccaaattcattgtttcttaattctgtgcagcatccagacatattattaccttcctcatgatgaattgttctgtttaaactgagatcagttttttctcatattctttggtttctgtctaagaacagagatcttgattacagtaaggttggttctttcctcatactaaccctcacctcccccagagaaagagcagagattgtcctcactctgagtctgagggaggagctgttcctgtacaactcagagcctgcagagacccccaggtgcagcttcagtgagtcagacatttctccatgtgggtgacctccactgccagtgattgctgctgaggtctaattgtgggttaataattaggacacccttcaggttgtcacatcccaatcctattctgaacatcaccattatcatagacagagatagttcaatgcccattctactgacataagtttctctttataatttggttccaactatggagaaaaacgtgaccctatatttgtctgaatctaacctcagaatctgctgcattgctctaggagattcacaaattgaacacaagtgagctgtttattctcataaaaatgtacatatttgagaatttcaatgtattgcccagaacctgtgcatgccaacaactgtgtttctcagcgcactcttggcctggtgaagccctcacagaccctctcccttacctgcgctgtgtctgtgttccccgtgataacgaggtcttcctgctgaagctggatccatcagccccccagggaagggaatggagtggattgggtgcataggtcatgaagggagcacacattaccacccactcctcaagtgtccagtcaccatccccagatccgtgtccaaaaaagcagttcttcctacagctgagctacatgagcaacaagcacatagccatgtatttttaagccaaagacacagtgagggaatcacagtgtgagctcacacccaaacctccctgtgggggtgcataggacagaaggggttgctcaggtccccagggggctctcaggacaccaaggggcactcaagaccattgtagaggcacgcaggtcagccgggggctctcaggaaccatcgaggaaaatcaggacaccagagggtgctcggtacagcagggggctcaggaccattgtgaggactcagaaagagcaggttcaaggctcagccttagggcaggtgaagctgggatgaaaaggggctggatgaggggttttgtgtcaccatcatatttcaccactagacaccctccactacatctgttctaatgcatgttctaacacatgtgagtgtttgtatgactagaaaatgatattttggggccaggtgcagtgactcatgcctgtaatcccagcactttgggaggctgaggcgggcagatcacctgaggtcaggagttcaagactagcctggccaacatgatgaaactccgtttctactaaaaatacaaatattagccaggcccagtggcacacgcctgtaatcccagctactcgggaggctgaggcaggagaatcgcttgaacctgggaggcagaggttgcgttgagccaagatgtgccactgcactccagcctgggcaacagagcaagactccattaaaaaaaagagagaaaaaaagaaaatgatatttatatcaatatataaccatagctaggtgtgtcaagttgtcctctccatctatgtcagccttgtccataaggactaattccctgtaatttcttgaggacctcataaactgtggtcaattatgtaatattcctctcttttttctgccttccttcctgccttctctctctcacacagaaactgacgtacacccaccccacaacacacataaatctataccttttattacctgatgtatttaataaacttgattaatgtgcagcttttcaagcttagttgcttgtgaggttgtaagaataagaaccattttttcaaagggaatgcttccagtttttgcccattcagtatgatattggctgtgggtttgtcatagatagctcttattattttgaaatacgtcccatcgatacttaatttattgagagtttttagcatgaagggttgttgaattttgtcaaaggctttttctgcatctattgagataatcatgtggtttttgtctttggctttgtttatatgctggattacatttattgatttgcgtatattgaaccagccttgcatcccagggatgaagcccacttgatcctggtggataagtttttgatgtgctgctggattcgttttgccagtattttattgaggttttttgcatcaatgttcatttgacaaagggctaatatccagaatttacaatgaactccaacaaatttacaaggaaaaaaaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagttaggaaacaacaggtgctggagaggatgtggagaaataggaacatttttacactgttggtgggactgtaaactagttcaaccattatggaagtcagtgtggcaattcctcagggatctggaactggaaataccatttgacccagccatcccattactgggtatatacccaaaggactataaatcatgctgctataaagacacatgcacacgtatgttatattgcggcattattcacaatagcaagacttggaaccaacccaaatgtccaaaaatgatagactggattaagaaaatgtggcacatatacaccatggaatactatgcagccataaaaaatgatgagttcatgtcctttgtagggacatgggtgaaattggaaatcatcattctcagtaaactatcgcaagaacaaaaaaccaaacaccgcatattctccctcataggtgggaattgaacaatgagatcacatggacacaggaaggggaatatcacactctggggactgttgtggggtggggggaggggggagagatagcatcgggagatatacctaatgctagatgacgagttagtgggtgcagcacaccagcatggcacatgtatacatatgtaactaacctgcacaatgtgcacatgtaccctaaaacttaaagtataataaacaaaaaaagaaaggtgagggagatactgtgagtaaagagctcgcttggggtctgcaatgtagtatggcttagtcagtgtgttagtgctctgtcctcttctttctgaaatcacagttcaccatcacctccttattttctagaaacacctggaaatagtgaaacttttttacttcccttatatttcatattagtgctatacccagggatcatcagttaaccacaatgacagtgacaaaaagctgccttcatattttctcccaggagaattttggctccaagaatcaaggctttaataggattcaggagaagtcagtgatcacagggcagatgcctcaggtttaaagtcacatcaaaccgagtgtgaaccttctgtaactcgcaactgtgctaacttttggaggtttcttgaaaaattctagtcagtttgggttaaagaatggtttcagtaatgtcacactcagggtcatgactgctcaactggtcattagccctgggaagtaacttccgctaacattggcttacctcataggagcttataaattgccatcatattgattatctcattaggtcatcaggatcctgagagaatgatcttttaagaaaacaatctttttatcaggcttatttatcattgcttctatatgctgctcttgtcctgcagaggaggcagcctggggtcaatcaagatactgggtatttgggttcatactttaagccccccactctctcatggtctaacttcagacaagtcacctctgctttttgagcttcacttttctcagccaccaaatggatgtagagataatatttgcttgcccaattttgaaatgtaggacggggcatcattaattaattagttcttttgtccacaaacatttacccagctccagcatgagcccagcctatgcttggtcttctgcagaacagagaaatgccttagaaggagattctgactctagtcatccacgctgtagttaaagaactgtgagctgggagggtggggcaggcgagggggccttctgatatttatgtctcatctttccctgaaaaaatactgtgtttctactttgctgcttgtattcattcccaacctattactgttcataaaatgcataaggtttactttgactccaagtttatttttattaattaaaatattccatgtttatcataatgagggtgattctcattaaaactcttttcattgccttcctgactaaaagcaagtacatttttattttaataaacataagtaacacaataaaaaaaaaagaaccatgtgtttcccagctgtgtacctctctaagctgagtagcatcagcttataatacccagcatgaaaaacaactcaaatgtcagtcatcagcttaattggtaaagaaattgaggaaaactcatccattggcatattacccactactacaagcaactaatgttggctactgtcaacagcatggcaaaattcacaagtagttctcataagtaaaatgagccaaacaaataaaagtacttacataagatacaacttttataaatttcataaaatgaaaagtaatctaaacttacacaaaaatcagtagctcactgtgaatattgtaggaaaagggaaggtctaggaaggagaaattacagaacaagagaaaattttaaggaaattgacttgttatctacgttgataatgattatgtttgggacaatattagtaaaattgaacacttcataaagatattttttaatttaacctaattaaagatagcactaattataacatgtattatttggtagaaaaggagttagacagagataaataaaatacatgaaatgtcagagacacctgaaatacacagcaacgagccctaggcatctctgtatttttagagaaacattagaatacagcaaaataatggactaattctacgacattaagaaagtttatcaaacccaccaggcatgttgtattagttcatcttcacactcctataaagaactacgtgagactgggtagtttatgaaaaaagaggtttagttgactcacagttctgcacagctggggaagtcacaggaaacttacaatcatggtggaaggtgaaggggaagcaaggcacgtctcagatggcagcaggtgagagagagagagagagaagtgacatacacttttaaaccctcaggtcttgtgagaactcactatcatgagaacaacatggggaagctgcccccgtgatccaatcacctctcacttggtccctcccttgacatgtggggattacaatttgagatgatatttaggtggggacacaaagccaatgcatatcatatgtccagctctatcctggagttgtttcaggaatccagtgtgtcctgttgatagaaaccgtgacactgagctcacagcatcagtagtatttgacaccatgcaaagtcaagagatctcaactgagatttagtgtggatgttttgtctgatgaagtcgtacactcagagcaagtgaatatggagaggtttattatctgcactgtagaggtgtctgctgagagcagggcagttctctcaggactgtctaaaatggcttggtaaaggaggaatggagactgactcagggtttttataatggtttggtggtgggggcagagtgaggcttcccactcacagaaaggggtttatagggtttgaaactcccaatggcatcacatgaagaagctcctgtgattgcaaactagattcaccttgtttgacaaaagaggagatgatagaggagtgagccttaagtcctcagcagtcatgcatcaaaaatattgtgacaacttattctatgtagcaagaataaaaataatgaataagcaaaaagataagggttcaatgcaggtggacaacatggaggtctacaggaatgcaatgactttataaatataagcaaataatattgagaaaaaggaggaggggttggggaattagagaggggtcctggtctaatgtcttgggtagaagcttctcacaacaaaggactatcagcttattctgcaggtcttaggccagctatctgcttaaaaacatccaaaaccccagagaatctataaggatgctcagtttaatatctcctatttgagtagctttacagttgtgtggaattctttattgattcttttttatttgtttttagagacaggctctcaccctgttgcacagtttgaagaacagttgtatgatcaaagctcactgtaattttgaacacctggctcacataatcttcccatctttgcttcctgagtatctagaagtagaggggaacgccacccctcacctgcttattctttaaaatattttttcagagaaatagcatctctttatgttgctcaggttggcttcgattgcctcgtctcacgggatttccctcatttttgcttctgaaagtggtgtgattatagcgatgatccactgcatctggcctgaatttattctttagttgtaaaacatgaacccaacaattaactgcctgaatattttctgcagcgagttagttaaaagtatctgataagattccttccaatatgattcaagaggagtattttctgctgatgttccttccaatttccttgctgaagatcacaagagtctgtggaaaagatgtaacaaaaaggcagcctcaaactcttcatgattggagtggatatcacacaggaatcactttcagtattttgtaacacatgcatgcaataggacaaagatgatctctgggggtaaactctataaacgtatgggccttttagctgccaagtcatagggtaataactgatgcaccctgaggagtggaacatgattccatagtgctagtgggagaacctttggccaagggagttttacattttattaaagatttgatcatttttatgtagagatgccatttttaaaacattcctagaagattgttgagtaggattcattctgtcttatatgaacaatgataatgctctccatggttagataatattataaactagattgagctagagcgtttggtgtatttaatcactttttttagcttccattagcatttggattaaatgaaaatcataacaaacagtctctcagaccacagtgcgatcaaattagaactcagaattaagaaactcattcaaaaccacacaactacatggaaactgaacaacctgcttctgaatgactactgggtaaataatgaaattaaggcagaaataaacaagttctttgaaaccaatgagaacaaagacacaacataccagaatctctcggacacagctaaagcagtgtttagagggaaacttataggactaaatgctcatgagagaaagcaagaaagatctgaaatcgacaccctaacatcacagttaatagaactagagaagcaagagcaaaccaattcaaaaactagcagaagacaagaaataacgaagatcagagcagaactgaaggagatagagacaggaaaaacccttcaaaaatcaatgaatccaggagatagttttttgaaaagattaacaaaatagatagactgctagccatactaataaagaagaaatgagagaagaatcaaatggacacaataaaaaaatgataaagaggacatcaccactgatcccactgaaatacaaactaccatcagggaatactataaacacctctatgcatataaactagaaaatctagaagaaatggataaatttttggacacatacaccctcccaagactaaaccaggaagaaatagaatccctgaatagatgaataacaagttctgaaattaagtcagtaattaataatagcctactaataatattattaatagtaattaataatagccaactaaaaaaagaccactaccaggtggattcacagctgaattctaccaggggtacaaagaggagctggtaccattcctcctgaaactattcctaacaatagaaaaagagggactcctccctaactcattttatgaggccagcatcaccctgataccaaaacctgtcagagacacaacaaaaaaagaaaatttcaggccaatatccctgaagaacatcgatgcaaaaatcctcaataaaatactggcaaaccgaacccagaagcacatcaaaaagctcatccaacaggatcaagtcggcttcatccctgggatacaagggtggtttgacatatgcaaaacaataaacataatccatcacgtaaacagaaccaatgacaaaaaccacatgattatctcaatagatgcagaaaaggcctttgataaaatccaacaccacttcatgctaaaacctctgaataaaccaggtattgatggaaagtatctcaaaataataagagctatttatgacaaacccacagccaatatcatactgaacaggcaaaagctggaagcattccctttgaaaactggcacaagacaagggtgctctctctcaccactcctattcaacatagtattggaagttctggccagggcaatcaggcaagagaaagaaataaagggtactcaaaataggaaaagaggaagtcatattgtctctgtttgcagatgacatgattttatatttagaaaaccccatcgtctcagcccaaaaactccttaagctgataagcaacttcagcaaagtcccaggatataaagtcaatgtgcaaaaatcacaagcattcctatacaccaataatagacaaaaagagagccaaatcatgagtgaactcccattcaaaattgctacaaagagaataaaatacctgggaatacaacttacaagggatgtgaagaaccccttcaaggagaactacaaaccactgctcaacaaaataagagaggacatgaacaaatggaaaaacattccatgctcatgaataggaagaatcaatattgccaaatggccatacggcccaaagtaatttatagattcaatgctattcccatcaagctaccattgacttccttcacagaattaggaaaagctacttaaatttcatatgggaccaaaaaagatcccgtatagccaagacaatcctgagcaaaaagaacaaaactggaggcatcacgctacctgacttcaaactatactacaaggctacagtaaccaaaacagcatggtacttgtaccaaaacagacatatagaccaatagaacagaacagaggcctcagaaataacatcacacagctacaaccatctgatctttgaaaaacctgacaaaaacagcaatggggaaaggattccctattttataaacagtgctgggaaaactggctagccatatgtagaaagttaaaactggatcccttccttagaccttatataaaaattaactcaagatggattaaagacttaaacataagacctaaaaccatacaaaccctagaagaaaacctaggcagtaccattcaggacataggcatgggcaaagacttcatgactaaaacatcaaaggcaatggcaacaaaagccaaaattgacaaatgggatctaattaaactaaggagcttctgcacagcaaaagaaactaccatcagagtgaacaggcaacctacagactgggagaatgtttgtgcaatctatctatctgacaaaagggctaatatccagaatctacaaagaacttaaatttacaaggaaaagacaaacaatcccatcaaaaagtgggcgaaacatatgaacacttgcttctcaaaagaagacacatgaaaaaaaaagctcatccttactggtcattagaggaatgcaaatcaaaaccacaatgagataccatctcacaccagttagaatggccatcattaaaaagtcaggaaacaacagatgctggaaaggatgtggagaaataggaacgcttttacactgttggtgggagtgtaaattggttcaactattgtggaagacagtgtggcgattcctcaagcatcaagaaccagaaattccatttgacccagcaatcccattactgggtatatcagcaaaggattataaatcattctactgtgtcttacgtgacacatgaacacatatgtttattgcagcactgttcataattgcaaagacttggaaacaacccttatgcccatcagtgatagactggataaagaaaatgtggaaaatatacaccatggaatactctgcagccataaaaaggatgagttcatgtcattttcagggacatggataaagctggaaaccgtcattctcagcaaactaacacaagaacagaaaatcaaacactgtatgttctcactcaaaagtgggaattgaacaatgagaacacatggacacagggaggggaacatcacacacaggggcctgtcacggggtggggaagctaggggagggatagcattaggagaaataccaaatgtagatgatgggttgatgagtgcagcaaaccaccatggcacatatatacctatgtaacaaacctgtacattctgcacatgtatcccataacttaaagtataataaaaaatagtaactcaaaaaattatgttaatcagttctctagtaggtagaaattcatctgggagtttcttctcttgtccattttgataggatctgcagaagacataagaaccctctctgttaaaaatattcctaagttgtacaccatctagaaacatatatacttaattataatttttaatttattaaaaagctttaataagtgcaatgttttctgccttctgagttgatttcataacacatagaaggatatatcctgaatgaaactttgtactagtaatacaaattaaaggttaataacctctacttttattattgaggtattacccaccaatatataatcttaaatcagtgctctcaatggggcttttacctaaataatataaaaaatattttcctgatcttgacacaaaatagatgtgaacacattcttcatattcagccatgtctcctgtctattacattatgaaccacatgctaactttgatttacttgggacttgttctaatttcaaactagttattttttatcttcatgcagctagattattatgtgtgagtattttatcagagagtgataaagataatttaaacaagtaattgtgtgtctcaggactcttcttgggttctgagacaagaaatgccattactacctgaaggattgagacaactttgaaaatgtcagaggaatcatctctaattgcttctaaatttcagttttatcaattcttatgctttctgaattatttttgattttagttattaaaggattctttctttttctcttaatctagctaagaatttgtccttttttaagaaaaaactcttaggtttgttgatttttctattgcttgtaaagtcttttttcacttatttcatttactctaaagcctcataaacacattggtgacaggtagatggagaacttgattgtaaatgccctgtttttgttagacccagctgatcatgtcaggaagccccctgaggggtctaggagctgactgtggctcccaccactggacaaggatgagaacctccatgctttggggatgggaggacatgcagggcagtgtgaggggaggagggttgctggcaggtccagcattgcttcccctggctgcaccactcatgtccttcctcactcagagattcagtcatttcttcccaggtggaaaaatcagttaactttatctttgatatatggatgggagcccaagatagaggcttgtcagtcattatttctgtgcctgctgccttgggaatgtctgaatttctcatgctctgtcctgggtctataccccagtggctcccctactccatggcacccacctgtgcctgtgcatggcccctgatcacagcctccgtgaaacatctggtttggctcaggaagaaccctccctgccttgttttcctgctgtccctggtccacatccttctccatccacaggctctcagtggtgcctcccatccacactgaccctacgtgggttcatatcttgtccaccacttcctctctcttttcttctgcatcttgctttttattccaacagcctgtttccacctcacctggacttatgtacaggaaagtgtttactgagcaggcttgtgttgtgcaaaccctgaagattactgaaaaagtgctttctcaagccacatccatattcagctcctgggagatgatatctgcttttttggcatactcctcctggaaatatttttaaaccattttattaaggtaaggattacatctataagactatacgttatttaacatacttaattcattgagttaagtatgcaaagttaccatcaccatcaaggtcataaacatagcaatgacttccaaaacattcctctttattctttttattcttagtattatgattattattattagttgaaatgtatttttgcttgtgtgtctctgtctctgtgtgtgtagcctgggtgcacactatgctagctgtttccataatgacttatggggaatgcctattattgctgaaggggccagcgtctgagcactggaggtcagttatgcaggtgccacacacatctgtgatgggccccaataaacagcactgggcaccagcactcaggtgagcttccctggtggacaatgcttcacacgtattgtcatgcatcactgctgggagaactggggacaagagacttctcagggaaagaacacctgggagcttgtgcctggattctcagggccttcccactggttcctttgctcattttaattcatattcatttgctataataaagctgcacccacgagaataacagcttgtcttgagtcctttatttgtactgattatggggcctgaggatggtcttgggacactcaacacaattacatcagaggtgtaaattgctagaaagaccctgactactgacacatgtctatagcatttataatatcaaaggatgagaaagtgtaggataaaagacattcagtgcctggatggctatagaatcacatggcatgagatgatgtgtgcactccaataaggagcaggaagtgaaagtaatccatggaatttagaaacgacggacacagctccctaggagttgttccctgaacaagaacaagtaaaaataatgaagaacaacctgagtatgcaactcatatctgtgatagctaaaataatagtaaaaagatgcacatccagccctgcagtgtgccctgtgagccaaggctgctagactcccattcactgccaaagggtacagttgtccagaaacaacacacaacacacaagagctacacagatggtagcccagggtttggactggggaggggaatccacttgacaactagaacagggaggatagtgtggaaagtggcatcattttgtgatatgaatgatatcattaatagatatcatcagatcgtgaacaacattagccaatggactaggagactgactgatgtagcagattctctttggcttcatgtgttgcataagggaggagcatgtttgggaagatgctggacccacagctcacaatagacacatcacagatggctctagctgatcccaacctcaagtaggatgcttctgatgggacagctttcctcaagcactggatcccgatcatgtaaagtttctctaccctgagaatgagactgccctttctctctttaaaatgcaaagtgggctctccagatgaggagcccaatgctgtatatggaagccatagtgctatgtgtttatgttgataccgacggtcattgcttagcatgcatcttatccaggtcctgctgctgtgtgtttctgttgatgctgctggacattgcttcgcatgcaccttacctaggtcatggcctgtgctgtgataaagagaagtccttttgcttctgcaccccaggtacaactcctgtgagcaatctggcaaatattttagaaactgtgtagtttgtattgccttgtcttttcatttgaatcttttagatgataaggaaatgagagtggttcacaagataatggggcagacacaggggatagttaagggcctcctccaagcaatgtggatatcataaaatgaatgttaaaaaatgaaagaactaaacaagaaggtgctggggttgacacaaaggacttaaaacagaactaccaggagttgggtgcagcaatggcaatcccttcagttccatcagcaattcagagacctaaacaaatattccctatttatgttgaattggcagactgtagaaatgtagaagacaaaatgaccagaaaaaatgtgtgatttggcatgggtgaaggtctggcaagttaatcaagttgaggactgttgaagccctagggtggtcctgcctttgctgggtgcccagaccataatggcactcatgggaaattgccagcaagtagaaactaggtgttttttttttttttgtagttcttattatcaggcatatgtgcatttgaattttgtcttcatagcatttcctggttctatttctcattttttaaaacacacgtgatttcatctagatttatcaccttcacagggtcacagagaagggtaggaagaagggaggccctggtttgggtcttgtaggaccatggacaagagtgcggagggacaacagggggttgtaagacattattaagaccttattctgcctctcccaagaggctcagttcagccgtttttctgcagttgcggttctgggttataaaccttgtagactcttcccttcaggccagggcggcaactatgcaaattcaagtgggggcctccccacttaaacccagggctctcctccacagtgagtctccttcaccacccagctgggatctcagtgctttcttttctgtcctcctccaggatggggtcaaccgtcatcctttccctcgtcctggctgttctccaaggtcagtcctgcccagggtttgaggtcacagagaagaatgggcagaagggagcccctgatgcaaattttgtgtctcccacacaggtgtctttgccgaggtgcagctgttgcagtctgcagcagaggtgaaaagacccggggagtctctgaggatctcctgtaagacttctggatacagctttaccagctactggatccactgggtgcgccagatgcccgggaaagaactggagtggatggggagcatctatcctgggaactctgataccagatacagcccatccttccaaggccacgtcaccatctcagccgacagctccagcagcaccgcctacctgcagtggagcagcctgaaggcctcggacgccgccatgtattattgtgtgagagggaccatctaaaaccttccgcggtgcaggtgcagagtgagctgccagacacaccctccccaggggcctctctattcatccggggaggaaacactggctgtttgtgtcctcaggagcaaaaaccagagaacaacatgggagcgttcctaacccctaaggcaactggatgggagacctgacccatccagttctctgagggggctcttgtgtgttctacaaggttgttcatggtgtatattacatggttaacatcaaaaggctgcctaataggcacctcttcaatataatagtcttttaattagtgaaaattttacacagttcatcattgcttgcttgccttcctcccttctgtccgctcttactccctccttcttttattttctacttacttttccaaaatcatttaacccctttttgtaccattaataagttatcttgtttttgttgttgttttccttttaacaatatgcactgaataattcatctttgtgccaattcgtaaatattttgatataacaaagacttctgtcataaatagatttcctgtgagtaatcttgcaaatattttagaacctgtttggttaagaataaattaaaataaatagacaaatttttaaagacatacaacctatcaaaactgaaccaccaagaaataaaaaatctgggctgggcgtggttgctcatatgtgtattctcagcactttgggagaccgatgcgggtggatcacctcaggtcaggagttcaagatcagcctggccaacatggcaaaaccccgtctctactaaaaatacacagattagctgggtgtggtggtgttcacccgcagtcccatagtcccggctactcgggaggctgaggtaggagaatgacttgaacctgggaggcagaggttgcagaaagccaaaatcgagccactgcactccagactgagcaacagagtgagactccaattaaaaaaaatctgaacagaccaatgagtaaagagatcgagtcagtgatttttccaacatctcgaatcaaagtccagaacttcatggcttcactactgaattttatcaaaaattaaaaaaaacctagaatctctactcaaatttccaacaaaataaagagaaagaaatatatccaagcttattttggaaggccctatttccaaagcaaggaaaagacactacaagtaaataaaactacaggccaatatccctgattatcatagtttcaaaaactctcaagagtgatgagatgacaaacaaaattaaacagcagattaagaatagaattcaccattatctgtgtctcccatacccagagaggctgctgcttgccctgcacaaggatactctgagcagaaacctacctggcccagccctcaccttgctttatgcagccatctgccctggcagcttaacacaaaggacagcatcttttgggagatacatggccacacccactgcctgagaatccacagtagcccctattcctgggcaacataagccaagcaaaaaccccactgttaatactgtagctggtgctctttggaaagcaccatctccaagcaggaagccaataaacagtccatcacagtatctcctggtagactatcactgcacccagaaaggagaaaatgactgtgtgatctcagctatgaccagtgcctgcaccactctggatgaccaggaggtcctgagtctgtccatgtgaacagttcattaccgctataaccagcattcaagaaagccagtacacaaaggctatcaatatctaaggaatttcagtctccatcactcccctgctgcttccatcagacctggttcactgctcactgctgaaaaattgaggacacatcacaccaccggatccctcacatacattccccaacaccagcctgaagtgtgtcaacttcactgggcggctagacctagagaagcaacaacactcacagtagtatggctcccaggttctcctgctcctaggggaagggagtgcaccacattgagggaacaccctgtgggacaggagaatctggatggcaggccttgaacatcaatcagatccctccattggtgggaaacttcttttagtagaggcagttacagtgctgagctcagcagagaaagtcttcagctctgtctcaacagtcagatatccctggtgcatgtgaaaaacttgaagaagaggaagtctttcccccttgtacaccactgcaggcacacttggggtctctcccataagagctcagtacgggtgcaactatagacagcatttctggaacacatcatgttgactgcatcccccagaaagagcactctccaggttcaggttttggccagacacagagtcacaattcctctgtatttaacacttcaacttttgtacagaggaaaagacatgcctgtctgatctgaatagctggaatcctgggatacgggagtgtcttagaggtgcataactttcctacagacctggcaagacagctgaggtggctccaacccttcccccagataagacctcagtgtgactcactaaaagctcctccagccaactctgtcaaggctgggacttcatttaccacctgatttagccacagctggtttctatccagggacaagccccctactggtctgaagcctgaaccatcaaactagcaaataaatcactgggggaaaataaataaatacgtgcatgccacagaggaatgaactaaggtttaatagacctcaaccattctaaccccatagaagacagtgaacttgctcacatactgagcagatttctactgcaatcaacacataggaaagccatcatacaaagattctccataaccacggaactcttacagagtcttcacccctctaaggaccaaaaaccaaattagactgtaattaattataaccattaaagtctcattcttaagggaaaaaataaatttaaaaacaaacaaaagaaacagttaaaacaaacataatttcaatactagttagaagaaatagtctaccaaaataagaggaaatgagaaaaataactcaagtaatatgacaaaacagggtgctataacatcccaaaaaggtcacactaggtctccagcaataaactttaaccaaaatgaagtctttaaaataccagataagaaattcagaatgttgattattaagctactcaagaagatataataagaaggtgaatatcatcataaacaaatgtataaaagcagttcagaatataaatacaaatttttatagagagatagatatcataaagagaaaccaatcagaacttctgaaaataaaagacaaaatgcagggaaatagtaagggaattacaaaatgccatggaaagttttaaaaatagactagaaaaaagtagaagaaaaaataaacaagagactagaaaaagtacaaaataaaaagttgaagtaaaaaattagatgaaaaaagaagaagaataaagtagaaataagaaaaaagaagaaataaaaaagactatttttgaaataatcaaatcagagaaaaataaatttagaaagaaccaaaagaagtaaacacagtctccaggaaatatgggattatgtaaaatgaccaaacctcagcataattggtgttcctgaagaagaaaaaaaataatatgtttggaaaacttatttgagagaaaaattgagaaatacattcctggcctgcctagagacctagatatccaaatccaagaagttcaaagaactcctgggaaatgtattgcaaaactgccttcaccaagcttatagtcatcaggctaccgaaagttaacatgaaggaaataattctaagagcagcaatacaaaacaaaacaaaaaacccatcagactaatggcagacttctcagcagaaacttcaccagccagatggattaagcttctatcttcaaattccttaaatagaacaactttcaatcaagaattttgtatcctgccaaactgtttgataaatgaaaaagaagtaaagtcattttcagaatcaccagtgctcagggaattcgtcactaccaaaccagcagtacaagaaatgctaaaaggagttgcaaaccttgaaacaaaagcccagtaagcacataaagggaacctcttaagagcctgaaactcacaggcctataaaacaataacacagtgaaaaaaaaaaactaggtaagaattaacatggcaaagaaaacagtaactcatatctaaatattcacattgaatgtaaatggcctaaatgctccatataaaagatacacaatggcagaatagattaaaaaatcacaatggaaatatctgatgtctctaaaagatccccctaacacacaaagatttacataaactcaaggtaaaaggttggaagaaggtatttcacaaaaatggaaaccaagagtgagcaggagtagctattttgatatcagacaaaatggacttcaaagcaacaacagtaaaaaaaagacatagatgatcactatacaattacaaaaggatcaattcaataagaaaatactacaattctaaatttataggcaccaaacaccagaggaactagattcataaaacaagtactattagagatttaaaaaaatgagagcgaaacaatcagagtgggagactttaatacaatcataacagcactagacagatcttcgagactgaaagtcaacagagaaaaaatgcacttaaataactcactgaaacaaatggatgtagcagatgtgtacagaacattctgtccaagatctgcagaataaacattcttgtaatcagtacatgcaacattctacaagatagaacatataataggtcacaaaacaagtctcaatgaatttttaaaacagtgaaatcatatcaagtatcttctcagaccacaggagaataaaactaaaaatgaactctcaaagaaacccttacaactgaacaaatacatagaaattaagaaatctgctcctgagtaatatctgggttaacaatggcataagatgaaaatttaaaaattaccttaattaaatggtaacaagttattgaaaccttaagaatacagcaaaagcagtggtaagaggaaagtttatagtgactactgcctacgtgaaaaagccggaaagagcacaagttgtcaacctaatgttgacacgagaaaaaagaaaaaattaaagaaagaaaatataaatcaaaaaagagaaagaaacaagctgcctgtgttaggctgactcacgtcaaaggcagtaacacgcaaagtttcaatgatgttatctaagggccggagctcagaggaatgggctctgaagactctcccagcactccctcagcataaggatgaaaagaggtaagttttcctatctctcctttagtgtaagtgaacttccctgtcgaatctcatcccctctgctatgtaaactataccttgcctcttgctctgtacgttttaggagtttctgtttttcctgtagttaatgattgcaggttcctgcttctgcatctaagcagtacagcctgagcaggtctggcttgtagccagctacatgccatggtgggggtggcaggatgagtctttgtgagactcctttgaactaagcaggtaatgaccatctgggctgcatgggaaggagtattgctaaccctgagttacaagcctggctttgtttgattaacggcctctgtcttgcctctgtacgtgcgcgttcgtgccacttaggaggaggtgtataagcaaaaccttgtctttgttcggggcccagttgtttggacgttgagtcccttgggacagagtgcactcagtgaagaccctcctgctatgccccgaggtgtcccttgccctcctgatgttccgcaacctttcttgcgagccagcagccaggaggagaagagaggacagattggctgtctcctttgccggagggtctggggctctggtcgcggcgatctgtgaccccagggcggcctcggggagcacttcagcccggaggggagaccggctctccaggcccccggggcccctcccctgacagcgcaaaggagcgcggaaagggctgcgggatgatcccagaagcagcgctaatgaaccgcggtcggcttttggggcccaaggcaggacccgtcccacgaggacggaggggagccccatcacctgccgggctgtgcgtctagtccgacccagggaggctgcggcggcgagagggggtcgctcactcgggtaccgcagacgccgcaaccgacgcggcacaggagagaggcccgccaggccggttaggaaagggaactggggaggggaagtgggtgaaagggcgtgcaagagacggctgcaggaggggccggtgcggggagtgacgtgggaggcgcagatctcagcgtggactgggcgctcccagcgaagcctggggccgacctgggatagcggcgaagcggctggtaggagctgccccgtggcagcagcggccgtgctgggaataggggactctcctagccaggcggccccgaaaactcctgtaataggagacgctctgctcggtaaaaaaggaagtcagagtgagtgtgcgtcgtagagggaggaaatgggaggaaaatcgtggaaacccactccactggaatgtatactaaagaattttaagaaaggttttgcagcggattatggaattaagctgaccccctgaagttgaaaactctctgtgaatcagaatggccttctttaggggtcggctgccggccgagggtgctatatagatagggaggtgattggccgggtgtttaaggtggtgaccggggtgggaggacagccagggtacccagatcaatttccctatatcgattcatggctcaatgttatacaaaactgaccagcgtggttgcaccccccagcagcatattgtaagacgcctgtggcccgagcagccgaagacaaaatgaaagtaaaatcagccatgctggcagctgcagagaaaaagggaaagtcacaggaaagccgagataaaccagttctgcgggcacctcaggaggaaacagaatttcctcctcctcctcatgttccaagccacccccctttgccgagaccaactgctccctctgcaagttcagctgtgaggccagcagccccagctgtccatggggagttaaatccgggagagtatactcccccagcctcaactaagaaggaggaattggagctgcaggaagttagagtggaaagcccagaaagtcaggcaggccatctcaggtctggccgcacctgagtcctgcaaatgcgtctcagggagacgaggggacctgtctattatgaccagcatggccacatccagaggggagagtgaactttcgtttaccagcccttttcaaccactgacctcctaaagtggaagcatcatattccctcttacatggagaagccacaggctctcgttgattgatgcagtccgtttttcagacacacaatccaacgtgaccagattgaaaacagcttcttttgaccctgtttaatatggaggaatggcagagagtgacacaggcagccctccagtggctaaaactaatgcacctgcagacacagttaatgcccagacatatgcatatttgaccctgtttaatatggaggaatggcagagggtgacacaggcagccctccggtggctaaaactaatgcacctgcagacacagttaatgcccaggcatatgcacgggtcagttccctgaaacaaaccccaattgggacccaaatgatgcaacccagttgcagcacctgcagcggtactgagaggcaatctttcatgggctgaaggatggtgggagaaaagcagttaatataggaaaaatctcggaggtgctccagggagcagttgagagcccaagccagttgtattagagactttgtgaggcttatcggctgtacaccctgttcaaccctgagactactgagaatcagcatgtggtaaatatgtcatttgtaggtcaggcccagggtgatatcaggcaaaatttgcagaagatggaaggtttcgcgggtatgaatgctactcagcttattgaggtagccaccaaggtgtacattaacaatgatcaggaggcaaagagggaggctgattgaaggcttaagaagaaggctgatttactggcagctccccttacgggaagggaagctggttttgcaaggggatgcgggtatggatgagggcatggaagaggccggactggatggggatttgagagtcagctgagactagaaagagatcaatgtgtgcagtgcaaaaggaaaggacactggaagaatgagtgtccagagaataacaaggagaatggtcagggctgtggtatgggaaggccaccagcagggggctgccgcacctgggaggaaccagacactgacctaatcggactggccagggctgaaggatatgaggactaggacagaccgggctctttctctttgggcacccaagagcctatgttcagattagaagtggaggccaactagtggactttatggtagatactggggctgagcactcagcagtgacccgacctatagggccgctatccaagaactgtgcaactattgcaggagccactggagtctcagagaagaggcctttctgtcagtcaaagaggcgtgttataggaggacaaggagtccaacaagaattcctgtacctcccaaattgtccagttccttcgctggaaagagacccatttcaaaaattgcaggcacagattacatttgggccacaaggggatgtaactttaaatctagctcactcagaggctatggtgttaacccttactgtcccacgggctgaggaatggagactatatgcaggaaagactccagaaccaggagtaaattaaatgcgtgggttacttactaaaattactggagtttgggctgaaagtaacctgccggaactggcagtaaatccggcaccaattgtagtggagttaaaactgggagcgactctggttcatgtccgtcagtacccgcttctccctgaggccatacgggagtccacaaacacttagattgacttcacaggtgaggaaccatagtcaaatgccagtcactatggaacacccctctcttgccagtgtggaagccgtctggagaatataggccagtgcaggacttgtgtgcagtaaaccaggccacggtgaccatccacccagtgctgccaaacctgtatactttaatgggacatattccagtgagtgccacttggtttacagtcctagatttgaaggacacatttttctgtctccagctggcaccgattagtcagcctgtttttgctttgcaatggggtgaatcacagtatacttgaacaagactgccacagggatttaagactctcccacaatctttgaagaggcactggcctcagaccttaaagcctacaccccaccaagcagtgactgtgtcttgctctagtacattgatgatcttcttctagcagccccaacctggaaggactgctttcaggagacccaagacctcctgcacctgttatggaaggcaggatataaaggcaggatataaagtgtcagggaaaaaggatcaaatctgctctgaaagtgtccagtatttaggcttctatataagcgaagggaaaagattgcttggtagtgaatgaaagcaggcttttgtgtgcttcccactccaaccacctggtgacaaatgagagagttactaaaggcagctgggttctgccacatctggatcccatgtttctcactcatgggtaagccattgtatgaagccacaaagaggggaaagaaggagcccctcctctgggaggccacccaggaaaaggccttttaataaatcaaaggagacttgactgaagctccagctttaggcttgccagatctaactaagcttttctttttatatgcccatgagtgaaaaggaatggtcataggggtcctaactcaagtcatagggtcatggcaccacccggtggcatatttatccaggcaattagatactgtggcacttgcatggacccttgtttaaggcattagctgctactgcttcactggcacaggaagctaataaactgactttgggacggcaactgataatccaggtaccatactcggttataactttaatggacaaaagggggcaccaatggttataaaatccgagaatgatttgatatcaagagctcttatgtgaaaatccctgcataactttagagactgtaaataccctaaacctggctaccttgcccccttcattgctgtgtggacgtagcagatgaagtgttctcaagccagagagatttgacagatcggcccctcggggacccggacattgaatatttcactgatgggagcagcttcatcctagaggggcccgccgagcagggtatgcagtagtgactttggactcagtagcagaggcatagtctttgcctacaggaacttctgctcagaaagcagagctaatagctctgacaagggctcattggctagcaaaagaccaaaagaccaatattcacacaaactctaaatatgcttttgccattttgaatgttcatggggctatttacaaagaaagaggactcttgactgatggagggaaagaaagaaagtacaaggaagaaattctacagcccttagatgctgtgtgggccccgaagcaggtggctgtaatgcactgtagggggcacctgagggcaggaacatcagaggtgaaaggaaacagaaaggcagacaagaggcaaagcagactgcagtggtgactctgccttctaaagaggaagccttggctatgcctctccttccagaaattcccctcccagagaccccaagctacactccaaatgaaagggctttttttgcccaagaaaatgggagctacgttgaaggaggatggtggaaattctccaatgggaggctagccataactgaaatggtggcccccagatttgtaaagcagttccaccaagggactcacatgggaaaaacggcactagagacattattaggttgtcacttctatgtgtcccagcttacggctatcacttgagcagtttgtgaacggtgtttaacttgtgctcataacaaccctcgacaagggcccacttgaccccccaggaattcaggaaacaagagccatccctgtgtaaacgtgcttatgggcttcaccaaactgtcctgagcagggggctatcagtacatgttggtgcttgtctgcaccttttcaggatgggtcgaggccttctccacccagacaaagaaggcatgagaggcgaccaaggtattgttaagagacgttattcccagatttggactacccctgactctggggttagacaatggactggcatttgtggctgaagtagtgcaggacttaactcgactattaggaataaaatggaaattatatacagcctgtagcctgcagagctcaggtaaagtggagcacatgaactggacactaaaacagctactgaagaaattttgtgaggaaactcacctgaggtgggatcaggtcttacccgtggtcctcctccaagtcgggtgcacccgcacaaaacaaaccgggtgttcaccctatgagattttattcggccggccacccccaatcacaggtcaaattaaaggtgatctctgtgagttaggagaactctaaggaagcaaatgcaggctttagggctagctatgcagaaagtgcatggctgggtgcaagaaagaatgcccattggtctgacagacccagtacaccctttcaaacctggggacctcgttggggttaagaaatggaatcataactctgggacccatatgtgatgggccccatgttgtaattttgtccactcccactgctgttaaagttcagaaatcgtgccttggatccaccacgactggctgaaaccggcagcccaggaccagaggaccagctagcaggacccagaccatccgacccagctgaccctgcgacgagactgggttcccagcggagaggacaacagcccggctctgcttacttcggaagctgaccagtctatgcatggtggaagcttgagaaaacagcaagctctgctctagtcactctggaagctgactagtttacgcatggcagaaagcttgagtcgtcatcatcagatgagtaaatgtggccagagatcttaggtccagtaatcttatttgtattattaattatattactgctgtgctattgcttcaacaaatctcctccaccctgcccatgctaggtgtaagaatgctacaccttgccttgtttctgtcgatccccatatctgtcctaggagaggaagagcctatagaggaatgtccacattgcatgtgtactacgtggataggtaatacactagttaagactttattgtaccatacatactatgaacgcacaggaacccctctggggacttgtatgtacaaccaaacgaactattcagtttgtgacccaggggatagctagctttatgtatactatgaccctaagcttttacctgggcctggtttgagattcgcactgggtcaagggaaggaagtcttttaaacaagaccgaagtttctctctcccacaagggagtcacatctttgtattttgatatttgccagataacatccatagactcactctttcccgtaatccacagttccatggagtactataatagctgccataaaagtaagtgtgcatcccctgcttgctccaccggttccctggtaacaacttgctggggctttgcaacatggcctactaaccaacaatcactagggctaatcatgcttaccaaaataccttcagaaccagattgtaaaactaacatttgcaatcctgtgaatcttaccaccttggagccaaattggctcgtatggactacaggtttaaaagcaccactgagggtacaagccagcagccaagaaatagactcaagagtctatgtctatattatatacataaaaaaaaacctgaatccttcttgcccagcagcagttccaagtctttaagtcattcaatgagcactttaagcaggaggtacctgaagctcctcctcctatagctgtagatctgtttgcacggttggctgaaaacagctggcagcttaggtgtttcctcatgctttgtctgtggaggaacaaatatgggaaaccagtggccttgggaaacaaaagagctatcgcctcaagaaaattacactttaaccctttcatccccagagccggcactcacgagctcaagtgtctggctgctaaaatcttctgtcattggaagattctgcattgcccactggggaaaagcctttacaaacccagtaggggaattagtctgcctaggacagcaatattacaatgagacattagggaaaactttatggcggggcaataataagcaaggtaaagatacaaccaggttgccatgccataatccattttcccattttcactctttaaaccactcctggtatcaactagaggcaccaaatgaacacctagcaagcaccttctggcctcgactggatctgtgggccatgagcttattggcaattacctgccaattggacaggggcctgtgtgttggggacaataagaccatctttcttccttgacccgttacaacagggagaggttttagggtatcctatctatgatgaaattaaggggaggagcaaaaggaatatagacataaaaaaagatataaagataggagattggaaggacaccgattggcctcctgaaagaataatttaatactatgggccagctacatgggcacaagatgggatgcagggatactgtacccctatttacatgctcaacagcatcataaggttgcaggcagtacttgaaatcatcaccaatgaaactgcaaatgcattagacctgctggcccagcaagccacaaagatgagaaatgccatttatcaaaataggctaggcttggactacctcctagcccaggaaggaggcataggcgggaagtttaatctgacaaattgttgtttagaaattgatgataacagaaaggccatcatggaaataactgcaagaatgcaaaagctagctcatgtcccagttcagacctggaagccaatatggtctctagattccctttttggaggttggttttcaggttttggcagttttaaaacattaatagggatagtactagctatattaggaggctgtttaatactcccctgcctcttacccctccttatcaggggcatccaatcaactatagacgccgtagttgacaaaaccatcaccacttgactaatggctctaactaaataccaagctgtaccaaacgaagaaaacttgccttatcatgaagaacaaagttgtagtgatgacttctattaaaatttcatacataggaggcatcaaaggcagggtatgagatgggaaaaaagaaaaaaattaagaaaaaaagaaaatagaaattaaaaaagagaaagaaacaagctgcctgtgttaggctgactcatgtcaaaggcagtaacacgcaaagtttcaataatgtaatttaagggccagagctcagaggaatgtgctctgaagactctcccagcactccctcaacataaggatgtgaagagataagttttcctatctctcctttagtgtaagtaaacttccccgtcgaatctcatcccctctgctatgtaaactatatcttgctccttgctctgtaagtttttggagtttctgtttttcctacagttaatgattgtaggttcctgcttctgcatctaagcagtatagcctgagcaggtctggctagtagccagctagacgccatagtgggggtcgcaagatgagtctttgtgagactcctttgaactaagcagataatgaccatctgggcagcatagtaaggagtatactaaacttgagttataagcctgtcttagtttgtttaacggcctttgtcttgcctctgtacattcgcgtttgcaccacttaggagtaggtatataagcaaaaccttgtctttgttcggggcccagttttttggacgttgagtccactgagacagagtgcactcaataaaggatcctcctgctataccctgaggtctcccttgccctcctaaatttctgcaacaatgtcacacctcaagaaactggagaaataagaacaaactaaacctagatccagaagaagaaaagaaataacaaagatcagagcagaactaaatgaaaatcaaacaaaaaacacaaaaaaccaatgaaataaaaagttggttatttgaaaaaataatcaaattcatggaccattagctatattaaccaagaaaagaagagcaaagatccagataagttcaattagaaatgaaatgagacaatacaatctacactgctaatatataaaataatttgagactactatgtacaacttcatgtgcacaatctaggagacttacaggaaatggaaaaattcctagaaacatacaactctcctagattaaatcaagaagaaacagttactttgaatagatgaataataaacaatgagattgaatcagtaattcaagaattgccaacaataccaacaacaaaatagggccaggtgaattcacatttgaagtctacacaaaattcaaagaaaaattgctaccattttttctgaaactattttttaaatttagaaaaaaagaatcctccctaaattattctctaaagctactataacccagatacccaaaccaggggaacacacacacacacacacacacacacactctctacatacgaattttcctggtaaatatagatgcaaaaatactcaaaaaatagctacctgagtccaacagcacatccaaaagataattcatcatgataaaagtaggtttcaactcagaaatggaaggattatttgaacatacacaagtcaataaatgtaacacatcacataaacagaactaaaaacaaaaactataggattatctcaatagatgcagaaaaagcatttaacaaaattcagcgtttttaattataaaaattctaagtcaggtaggcatagaaggaactgacctcaaactaataaaggttatataggaaaaactcacacccaacatcatgctgaatgtgaaaaagttaaaagcattccccctgggaacagaaacaatagaagaatgtccatgttcaccagttctattcaacatagtgctagaagttctacccagagcaattaatcagaagaaaaaaataaagggcatccatattgagaaagagaaagtcaaactatcactgtttacagatgaagtgattatatacctagaaaaccctaaactcccccaaaatactgttagttttagtaaatgaattcacttatgtctcaggttacaaaataaatgtacacaaattggtagcactgctatacatcaacaacaacaaagctgcgaatcaaatcaagaactccatttcttttacagaagctacaaaaagatatttaggaatatacttaaccaaaaaggtaaaagatttctacaaggagaactacaaaacactgctgaaagaaatcatagatgacacaaacaaatggaaatgaatcccatgctcatggattggaagaagcaatattgtgaacatgaccgtaatgcccaaagcaatctacagattcagtgcaattcttatgaaaatacccacattattttttacagaattaaaaaataataatgttaaaattcatatgaaaccaaaaaagcccaaatagccaaataaatcctaataagaaaaaaatggagccatcacattactgaacttcaaattataccacaaggctgcagttacctaaacaacatggtactgatataaagtaggttcatagaccactggaacaaaatagagaacccagaaataaagccaaatatgtaaagccaactgatgttttacaaaacatacaaaaatataaattggaaaatagacaccatatttaataaatggtactgggaaaactaggaagccacatgtaaaagaataagactggatctctatctgtcaccatataaaaaacaactcccattcaaaatttcaaagaaatgcatttacataaattggaaaaaaactctttataatttgtatggctggggtgattgacccaggctatcaagatggaatcatactactactccacaatggaggtaagaaatagtatgtttggaatacagggggatttcttagggcatctcttagcattactttgccatgtgattaaggtcaatgggaaactacaacaacctaatccaggcaggcatacagatggctcagattcttcaagagtaaaagtttaggtcactccaccaggtaaacaaacaaacaaatgaacaagaaacaaaactgaccagccaaggtaactgctgaaggccaaaaaatacagaatgggtagatacaagaaagttgttatcaataccaggtatgaccatcaaccagaaatgaggactggaattgtcatgagtatgtctttcttatcttcttaagaatatatttctgcatgtatataactgtactaagaaaatgttttctttttgtttttcatgtaacataagatttatcgacttcatattagcatttgagagttgttaactgtatatagtggcatttaggttaaggattagtgcattttcagttgtatgaaggatagctgtattatgttaggcataattatgaccttactattgtctttatttggagatcgagcatgatttcaggtgatatgtagggatgctaagttgacaacaagggattggcctgtgatagttaatattaggtttaacttgattggattaaagcatgcttagatggctgggaagtattgtttctttgtgtgtctcttgggttttgccagaggaggttggcatttgactaagtagcctgcaagagaaagacccagccccaatatggaagggcaccatccactcagctgccagcacagctagaataaagcaggtggaagaagaggagataacattgcttgctgcgccttctgtttttgttttgttttgctttgttttccttgctggctgctttcttctgctcttcctacccttggacataagatttcacgttctttggcagttgaactatggggcgtgaagcaggggcttgctgagggttcttgggcccttggtcagagaatgaagtgtgcactgttggcttttctggttttgagacttctggacttagactgagccactaccagtttctctctcttcccaagcttttagaaagcctatcatggaactttcattttgtaattttgtgagaaaattctaataaactatatttcctatatacatatgttatattagttctatttctctagagaactctgggtaatacagctttgatacaaaaaacaacattgttgtattcacaaaaatgtatcctaagataagccaacacataaaagtgcataaagtatgattctatttctaggaattataaaaaatgaaaatgaatctaaagtaacaaaaaaagatcagtagttgcctaaggacagattggaaaattatatttttccaaatgctacaaatgatactctcacctactatgagcattgctctctcctcaggaatttcacccaagaaccgactctatagtcggagacatgcaaacaggttcctgttcatgtacgaactcttcctaacactttcttttcatgtacttccttgacttatttgttgatgaaggttgataccataaaaataactaaaccaggctcacattagagaaaaagaagagagtgatggaaagattaagccggagcatccagtttcagtgattctttgaccctgccctccctgaagtctagaggcagagggatgagccctgctgagcagttcacacttgtccacagggagaaagaggtgtaaatgtgccccccatccatgctcataaaatggcccatggacagcttatcccttgtccatgaaggggatgccacctgatgtcggtgcccttcctcagtgtccacaccttagggtctctgctaatctggggttctcttcttattctcagaggtagggtccctgtggatcaagcctagctgtggctgcttctcagcctgttccctctgtgtttgtaagagtcctacaagaagttcactggtggaatctggaagagaaatgatacagcctaactgttctcagagccttttttacaaagcctctgaatttaccttcattgactctagcatgagctcagcccagcaggcttcaggacaggggttggtgtgggaggcaaaagcgagggattcaagtggaatttgttagtggtaccctccatcaatacaaagaaaaatcataatcctcagggacacccttgtcagcacagtctccctcaaaatgaccaacctgagagccgaggagaaggccatgtattactgtgagagacacaggagatatccgtgtggcaacctaacacaggggacacctgtatttgtgtctgagcccagacacaaacctccctgcagggagacaggaggggaccgtgtgacagacactgctcagaaccaccaaggggagctcagaaccagcaggaggcagtggggacacaaaggaagactcaggagccaccagggggcgctcagaaccacctgggggtggtgaggacaccagggggcgctgaggacacaaggggaggatcaggacaccagggtcggctcaggacgcgaggaggtgctcaggacaccagggtctgctcagaaccaccagggggcactcaggaaccaccaggagaggctcagccaccaccagggggcactcaggacatcaggagctgctcagaatcaccagacggcggctgggcgcggtggctcacgtctgtaatcccagcactttgggaggccgaggcgggcggatcacgaggtcaggagatcgagaccatcccggctaaaacggtgaaaccccgtctctactaaaaatacaaaaaattagccaggcgtagtggcgggcgcctgtagtcccagctacttgggaggctgaggcaggagaatggcgtgaacccgggtggcggagcttgcagtgagccgagatcccgccactgcactccagcctggggtgacagagcgagactccgtctcaaaaaaaaaaaaaaaaaaaaaaagaatcaccagacggcgcacaggacatgaggtggcgcacaggacatgaggtggcactcaggacacaagggggagctcagaaccacctgggggtggtgaggacaccaggggatgctgaggacacaaggggaggatcaggacaccagggtctgctcagcaaccaccagggggcgctcaggacatcaggagctgctcagaatcaccagacgtcgctcaggacatgaggtggcactcaggacacaagggggagctcagaaccaccagggggcgctcaggacatgaggtggcgctcaggacacaagggggagctcagaaccaacagggggcgctcgggacactagggggtgctaagaacaccaaggggcggtcaggacatcagggttctcttaggaagcagtgcatcatcaggtccctggggagggtgggtttctttatttaggccttgtgattcctgacctggtaaagtgaaactcttctcagcatcttttgccatttcttccttggaatccatgtttctcttacctacaaaatcctaacttagaacaggaattcaattaaacttttaattctttatatttttgtaataatactagtaataatatctcagtacaattttaaaatgaagaaattgtgtatgcttacttcaaactatttacacagatttttgttactgtgctgtgtcagtcacacttttgtaaatgttttctaacaataactcagcatatgcatggtgttgagtttctttttcttccatttgctgattgtgaagatgaaaccccactttaagggctcctgtcctccactttggtggcccctggtgttctgcccctcagtctgtttctccaccttcccttcttctttccaaaccttttataatcctcaatttccattcaaggaatcagcaagcccgtttattatgtctcatccatgtctggtgaatcagttcacttccctttatgatcactgaagccaaccaagtataggcaggcaacagttctaagaatatgctcatctacctgcagactctctgccctcctcacccctttcaacggtcctgcagacatcaccccaccccatcctctatcttccctaagtaccacagagtgggctctgcagctcctgctgcccactgtgtgctcagccctggggctcactagtgctttgatgataaagcctaaatccctaacgtgtttgcacacttcctgaccaccctctagcaagttgtcattgtgagtgaatcctgggaaccctgtgctgatattaattctatatttatggatattctctagcatccaggaatattgtcaaataacctatcgagttgatgttaaaaattcatgtgaagccattgcaaaagaaaaaagtctttaaactggaaattgctattttttaatacttaatatttttttaatttaatatttaaatgctatttaaattagaaaaaggtgatgccttttgtaaagtacaatgttatttcaaccaatcgtgtaataaaattttaatagagatgcttgccttattgattattatatttatttataacattaaatgcattaaaacatttatttaaaaaatatgctattagtaaaaatgggaaataagctagcacagagtatgtaaagaataccattgtatttttcaatgatagatttgtcaataatggcagttacagtaagttttattaaaacatgcatttacatatatttcttaatttacattggaatagacagacttactcatagaagaatgttactttggactaaaaccttaaactataaatacaaataaatccatataaattaaatatataacacagaaacaaatgtatgtcactttgatgtttggaaatgcatttatttttgcctgtgcacatatatgtttcattgctgggtgtgtgtgtctgtgtctgtatatatgggtgtgactgtgaagtttcaaaatacattattaacttgtatagttatataaatctaagtttttttatgttaaaagatagtaaaaaaacacacacaaaaatattctagagagcatttgcaataactaaggagtattcaggtgttgtattaataatgaaaaactagccaaaatgtttttaaacttttattttaggttcagaagtacttgtgcaagtgttgttttataggcaaattgtgagttctgttggtttgatgtacagattattttgtcaccaaggaaataagcatagtacctggtaggtagtttttcaattctcaccctcctcccaccctccacactcaagtaggacctagtgtctgttgttttctttgtgtcaatatgattagctcccacttatacatgagaacagatggtttgtaattttctgttactgtgttactttccttaggataatgacctccagctccatctatgttgctgcaaataacatgatcttattcttcttatgactgtgttgtattccattctgaaatatacataaatcagtaaatgtgattcatcacacacacacaatcatctcattgatcaatattaactttcaatgtaaatctcccaggaatctttcatcttctcttgaccctcccctctcctcaggcatcccaaaccatagctttctatatattaggatacatgaaaatagggccctctctcagctgatgaaaaccagcccagccctgactctgcagctctgggagacaagccccagccgtgcagtaccaaggtgcttccattcagtgattagcactgaacactgaagacatcccatggagttaggaatgcgctgggttttctttgttgttgttctaaaaggcaatcaagaagaactagaaatattgtctgtgagtgatatgagtgagagaaacagtggatctgtgtggcagtttctgacaagaatgtctctgtgtttgcaggtgtccaatgtgaagtgtagctggtagagtctgggggaggcttggtacagcttggggggtccatgtgactctcctgtgcagcctctggatacactttcagtaactatggcatgcactaggtggaccaagctccagggaagggactggagtgggtcttacattaatgctagtggtggaggcatatactactcagactctgtgaagggccggttgaccatctccagagaaaacaccaagaactcactgtatctgcaaataaacagtttcattgctgacaccatggccgtctattactgtaagagacacagtgaggagaagtcagtgtgagcccagtcacaaacctcctacaggaacgctgggaggaaaatcagctacagggctcactcaaggcccactgatcagagtccactccagagggaggttcacatggaggttaggggctggttttctgtcaggacattggacttcatcatcttcttccattactttctttagggagcctcttcattttagaattctgtgtgtactattgttatatatacatatatatatatatatatataaaataatcatagtaatgcgaggacatattttctcatgcacaaaatgtagattgacacttacagagaagaaaaattatcaaccaatgtcaaaaacatcagagtcctggaaaatcttaagtgttctggtgggtcatctctaatcagacccagaacagtaacctcagtgaaattccatgattcagatactatttttggattctgatcataaccaagacagagtctggaccagggtcagtgtcatatagaacctcacagcttccatatatgacccttctcttgacagtgaaatatgaaattcagtatcagcagtgatttgatttttcttttgctttccgtattctttctttttagttgttgttgtttagttatttcttttgctatatccattttctttttttttagttgtgcctttcacttttggctttcacttttccatttgcttttcctgcttcctgataaagggagatgtaatccctgtggtctaaattccagggctcaagccttttcctgggagctcaggtgggtctcaggatgtggctcctgcagccacgtgaaagaggctgatgggactttctttccttctcatgactcaggcattccacggtgttgtgtggagactcatctgagattgcacgtggccattagtagtgaaggggatgagatgtgggtgtggactgatcctgtgctgtgcaaattgtcattagtagtgaaggggatgagatgtggatgtggactgatcctgtgctgtgcaaattgtcattagtagtgaaggggatgagatgtgggtgtggactgatcctgtgctgtgcaaattgtcattagtagtgaaggggatgagatgtgggtgtggactgatcctgtgctgtgcaaattgtcattagtagtgaaggggatgagatgtgggtgtggactgatcctgtgctgtgcaaattgtcattagtagtgaaggggatgagatgtgggtgtggactgatcctgtgctgtgcaaattgtcatggagtcacttttctcaccatagtgttagaaagagactgtaaaagttgtcagaatcaaactgcaacaatttgtgttaaaacctgggaaatggagctgggaaggccatgagggagggttctcatacacatgccttccataacaagaactgtcataaatagattctgcaaaaccacaaccttgcacaaaggccagcacaaccttaaaataattacttctccaagtacatctgcccagaggtgcctgtgcaatattacactgatgccaccctggttattgatcattttatcccaggttaagtgtctcaaaaccgcatatgtggccctcctcattttttctttaaaacactttccttatttacctaccgaaatgtgcccgtgcacattcccattgcaatgctaattctcaaataaataccactttactttagagtttctttctgtctgatattcaggtttgacaagctgcagatggacttgccaattttctgtgggatacagggtataataattatgagagatgtgtaggcatgttcaatgttcataagagcaaccgtaaataaatgcaggctggaagtctcagagagagctgaatgtgctgaaacaccatactattttatcttctcccattcttttctgattggaatcagacccaaccaggttatcaatgccaatctacctaagctagagccaactgattacggtatcaacagcaacaatagctttttattttctgcttggctttgtattgttaccttgttccatcctctagagtatctatttcagcccttcggataccggtttcagaggctttcccctaaagtgtaatttcttagttttgtagtggtgataagggaggaggtgggtctggatgtgttttagaagttcaggctgtcattctctcccagacagacactttagtacagaacgatttatgtggttgtcccatttctacaggaaagatattcaagagaataagaaagctcttcagtatttggtccctgagaattttacactagagcacattcaccactcttgactttaagcaacctaattaatgtatttgaagccttatcttgaaatagactatatttcatatggcagactctgcctcaggtaatctcataccctgactttgttactctctacaagaacttgtctctccctaaatttcagatttgttgtttgtcttaaaatttcgattatctgaagtatgaaagacaatttgccaagtttcttattttctgttcatctgttattgttgatgttgttgttgtaaaatacaaaaatatatatatttcttatctaagtacttctgcaagctgagtagcagatatttttggtaaaacccagaataacagaagagtccacatattaattagcttcttaataggaaaaatcattatagtaaatttgttcactggactgttacccatcatttataatgtacaaatatctgatacacacaacaaactaaaatatctaggtatttatgctgagtaaaataagccaaaaaaataagtatatatgctatattattccatttctataaattctggaaaatgaaaactaacctacaataatttaatgaagaacagttgttgcctgaggaaatggtagaagaagggaaagggataggaggaaatgtggaacaggagaaaaaattgaggcgaattcacttgtccactttcttgataatggtgatagttatgtcatgtttatcaatgtatactttaagtatatgaagtttattatctctcaattagaccttataaagtttattacaagcaaacaaataaaaaattagacaaaaagaactgatagaaaatgggtaacatatgttaaatgccagttacctgaaaatttatctgcgtgaaccttagttctctccataattttaggtgaacgctggagtgtaacagagtcacaatattttcattaaggcagtaagttctgcaagccacactagacatgtcccgctctgtcctggagttagttcagggaacacagtgatgaggaacacgggctcagataccggaactcactcatctcagacatgagcacttagacacatacataggcactctgtgtgtgggtttactttcacatccgtacatggagaaacattgagtctcacagacataatttacacacatatttaaaatataataaggtgtttgatgctgtttatcacagcacaatttcctcgtaaaagtgcaaatcttctaaataccataagttaccaaactcctgcaggacaccatcatcctctctcggcaatgccttctcctcacgtgtcccaccctagagttttttatgtagttggaaatatgcaaaggaccctccttctttggtgaaaaccagccctgccctcaccctacagttctgggatgggagacccagccctggaatttcaaggtttttccacatggtgattagcactgaacagagaactcaccatggggtttgtgctgacttgggatttacttgttactattttaaaagtagattcagggtgaactagagattttgagtgtgagtggataacagttaaggaaacactgaaaatatgtgccagtttctgaccaggatgcccctgtgtttttgggtgtccagtgtgaggcgcagttgttggagcctgggggagacttggtacagcctggcgcggtgggggtgggggtccctgagactgtcctgtgcagcctctggatttgccttcagtagccactggatgcactgggcctgccaggctccagggaacagactggagtgggtctcatgtattagtactgatgggagtagcatacgctatgcacattctgggaagttctgattccccatctccagaaacaatgccaagaacacactcttatctggaaatgaacagtttgagagctgagtacacagccacgtattactgtgctggagacgcagtgaagggaagtcaggttgagcccagacacaaacctctctgcagaaacacatgaagtaaatcagctacgggggcgctcaggacccactgatcagattcaacctcagaggcagatgcagatacagggtaggagctggttttctcatagtgtttgtaacttccctctccaactgacagtttcccagagaacctcactaatttagagttctgtgcctaccaaaaaaatctccaaatatacaccttttaaaaggtagtaatataaaggcctagtctcacatgcacaaaatgcagatcaccacttccaggcatgagaagttctcaaccacggtcaccaagatcagagtcctgaggaagctcaggggtgccttgtgggtcttctccaatcacattcgggacaggaaactaagtttaattccctgattaaaaaaggctataattccctgatttaaaacgtttcattccctgattaaaaaaggctggaatttttctgattccagccaagaaagaggctgggccagagtcagtgtcacgtacaagctcacaggtttcacgtctgccccttctcctgatatgagactatgcaaagcagtatcagcactcatctgctgcactttttgctgtcaatccattttctttcttttcagctgttgtcactttttcgttttcttttctgctccctgaaaaagaaagatgtggtccatgcggtctaaattccaaggctcaagctcttccgctggagctcaggtggggctcaggctgtggctcctgcagccgcatgggagaggctgatggggctttcttctttccccagtgcttgggaccctccaccgtgtttcatggggactcatgtggaaatttgagtggcccaggggaactgaagggcataagcttgtttggtgagagtgaaacgtgactgtggaattgattctttgttgtgcaaaccagaagaaattttgaattttgtcagaatcaaaacggagtcacttttgttaaaacttttgcaaatgggactgggaaaggccatagaagcagggttctcatacacttacacttggtaacaagaactaccacaaatagagcctaaaaaacacaaccttgcacaaaatccaccacaactttaggaaaaagctacccccacaaggatatgtcctcatgtactgtgagtccaactttccactgttgccacccttgttattaatctttgcagcccaggaaaattgtctcaaagcaacttagcaacttacttagcccttcttattttaactttaactgcctaagaatttataccgtgaagtaattgcttcatttagtgttaatattaatgcccttttgacaatctttgaagctctttttttctgatatttcttccaacataaagaatgggagctttttcaccatataaagaatttttaggaagatatgatggaaagggaaactcaatgtattgttcagtgtttctgcctaacacatcaatctcttaaaatattttgctgtgtctgcatgtgataaagcagatgctaacactggagataaaagaaaaaaatgcacagaccttccacattccaaatcataaagtggtactggatgtgtttctgatgaagtgaaccatgggtcataagtgctagtgcaagtagctttggaaaatggagttcatagcttcttaaagttttgctagttttaatttaagaatgttatttactatttctttttagtacaagctttccagaagattcttgatggtaatggaagtgtcgcatttaagaattacaaatgactcacagagttactttgtaattttttctgtagggtgtacatgtcagtcacttgacataaaagctcatatgtcacagatagaaaaatgaaaattgagccaattttaataactgcagtggaaatagtttttggcaatgagtgcttcaagacaaccacaaaataaatcggcaaaatattaaaatacagcaggaatctgatctcagtttctctgccttataagaacaaggctgtcccacatcaaaattattattcaagctctaggaaaaaatacacttttggattctggaagctaaaagctctctccttagatagtgctaaagtacttgtgaaatgcagagttgtgttcatgaaaaagatgactttattgtgattttttttttttttttttgcctgttgacaactcaccaatctgtctcagatgtaaagccctgctctatgggttgaatgtggttgcacatgactggcagagactgattattcataactccaggtgccctgtctttggagcagctacaggagtcaggcccagactagaagagcccacactgaccttctgcatcacttatgctctctctggccactacatcacaaacagtgcttatgactgggcctgaatctgccagcccaggaaagggctggaatggatggggtgcattggtagtgatggtgggggtcctactagcctgtggcaaatggaagcatctcttttttatcagactgaataatattgtagtgttttcttataccacatttacttcatccctttgtgcattaacacttaggttgtttttatatattggctgccataaatagagctgcaattaatataagagcacaggtgtctttacaagttcatgattttatttcctttccctgtatttccagagaagcgtttgctgagtcatattgtatttccatttttgatttatttatgagctgctatactgtttttcataatggtgcaactaaaaaatggtgtagtcatcatgaaaaacagttttagtttttgacataatccaaacacaatgtttgaatctggttatctataggagtttctagtaaaattggtgaatgtaaattaaaaagcagtaagaaaaatctgcaattcagaaatagtgtacccagatggtctttctctccgaaatgaaagagaaataaactatttctcaggtgagataaactaagatattttcttcacacttgaccagtcatacaagaaatattcaagggaatttttgtataaaagccagcatatgaaaaccatcagcttggaaaaaaacacacaaaacctatatttcaatggtagaaacaattaaaaaaggagaaaagaaacaaacattattactacaaaacaacatcaaatcataaaaccaaacagaaagagaataaacaaagatagagatatatacatatatacaaacaatcataaaacaataaagaaaataatttgagtaaatacttataaataataaccttatgtaataaaattcctcaattaaaaatacagtataaaaattgattttattaaagtcccaactctatgctgcttacaagagactcaaatcatctgagaatctacacacagactgaaagtgagtgggtggaaaaaagatatgctacaaaaatagaaaccaacagcacaaatagctctacttatatcagacacaaattttaagtcaaatgctgtaaagggagaccaaaatggacattatataataaaaaatgatcaatgtagcaagaatacgtaacaactgtaaatatacatatatacatatatgttatatatatgtaacaagaacacataattgtatatatatacatatatacacacacacatatatacatatgtacccacacctgagaactcaaatatgtaaagcaaatctattacatagtaagggatagatactaaccttatacaattatagttggagaatttaacacgttatttagcattggatatgttacctagccaaaaattaacagacaaacattggatttaaactgcactatattccaaatggacctgaatttacagaccattgcaccaaacaacttcagaacacatattcttttttttttaaaaattaaatggatgtgtttatttatctttttttattattattatactttaagttttagggtacatgtgcacaatgtgcaggttagttacatatgtatacatgtgccatgctggtgtgctgcacccatcaactcgtcatttagcattaggtatatctcctaaagctatccctcccctctccccccaccccacaacagtccccagagtgtgatgttcccctcctgtgtccatgtgttctcattgttcaattcccacctgtgagtgagaatatgtttggttttttgttcttgcgatagtttactgagaatgatgatttccagtttcatccatgtccctacaaaggacatgaactcatcattttttgtggctgcatagtattccatggtgtatatgtgccacattttcttaatccagtctatcattgttggacatgtgagttggttccaagtctttgctattgtgaatagtgccgcaataaacatacgtgtgcatgtgtctttatagcagcatgatttatagtcctttgggtatatacccagtaatgggatggctgggtcaaatggtatttccagttctagatccctgaggaatggccacactgacttccacaatggttgaactagtttacagtcccaccaacagtgtcaaagtgttcctatttctccacatcctctccagcacctgttgtttcctgactttttaatgattgccattctaactggtgtgagatggtatctcattgtggttttgattcgcatttctctggtggccagtgatggtgagcattttttcatgcagaacacatattcttttcttcagcgcatgtgatactcttcagagttgatcatatattaatacagaaaatgtatcaaaaaatttaaataaaattataccgacgttttatctgactaagatagagtcaaagatggaatcaaactaaacatcagtaactggaggaacttctttttttttttttttgagatagactctttctctgtatcccaggctggagtgcagtgacagaatctcggctcactacaacctccaccttccgagttcaaaccattctcctgcctcagcctcctgataagctgaaattacaggcacctgccaccactcctggctaattttggtatgtttagtagagagggggtttcaccatgttggccaggctggtcttgaaatcctgacctaaagtcatccaccagcctcggcctccaaagtgccgggactacaggcatgagccaccacccagcctggagaaaatttcaaaaaaatataaacacaaaaattaaacaaatcactcttacatggccaatgggtgaaagaagacattaagaagaaaataaaaaatgtatgaaacaaacaaagaaacacaacataccaaatcttatggcgtttagtcaaatcactattatgaggcaagtttagagcaataaatgcccacatcaaaaagtagaaatatcttaattaatcaaaataacaatgcatgttagagaacttgaagaacaagaaaaagctaaattcaaaattatttttaaaaacaataaagagcagattagatataaatggaattaagactaaaaataccagaaaatattaaaatagcaatagtctttttaaaaaagataagcaaaattgaaagccattagctgggctaacaaaaaaaatataaagagctaagacatgaataaatgaggtagaaacagaagatgtctcaactgatatcccagaattaaaataaattaggaaatactataataaattatgtgataaatgtgaaaacctagaggaattggatacattcctggccatatactacctaacaagattgaaaaaggaaaaaatagaaagccttaacagaccaataaaaagtaatgagagggactcacttaaaaaatctatatcctattgaacataaataaaaaaacccaaattactagcacagcaaatcaaacagcatttaaatactaatactaatactaatacagcatgacaaagtagaattcaacccagggattcaattatgctttaatatacacaagtgaataaacatgatatatcacgtatatacgacaaggatgaaaaacatatttttactttaatagatgcagaataagtactttataaaactcaaaacctcttcatgaaaaaaactctcaattatgtgtagaaagaacaacacaataagaccacatgacaagttcatagctaacatcatacttaacagaaaaaaagtttaatgcttttcttctgaaaactggaaaagacaaggaagccaactctcagcacttattcaacacagtactgaaggtactagccagagcagttagacaagagaaagaaataaaggggattacaattagaaaaaaggtagccaaattacctctaatttcagatgacataatcatatatatactaaagactcttgtaaatgctcttagagctgatgaatttagtaaagtttcaagatacaatatcaacatagaaatctcagtggggtttctatacacaaacaataaactaggtaaaaaaaatcaagaaatcccattttcaataactacaaaaactattaaacacctaggaatacatttcaccaaggaggtgaaaatccgtaaatgaacaaactatgaaacactgatataattaattgaatgagacaaacacaaaataagaaggacaatctgtattcatgaactggaataatttatattgttagaatgaccataatgcacatgacaatctacatattcaatgtcatctctatgaaaataccaatggcattattcacagaaatattaaaaagcattattaaaatttgtatacaattgaaaataccccaaatgactaatgcagtcttgtggataaaaaacagaggtggaggtattaacaaccagatttcaaaaaaaattataaaactgtaataacaaaaacagcgtagtgctggcataaaaatccatggaaaaaagtagagaaaccaagacattaatccatatatttatagataacttatttgcaacagaggcaccaaaaatatttattgtgaaaagaaaagtatcctcagtaaattgtgtagggaaaaactgaatatccatatgcagatgaatgaacttacattcccacatttaactgtatataaaaatgaaataaaaataagttaaatactcaaatggaagacccaaaactataaagctgctcttaaaaacttagaaataatgcttcatgaaatctgtctggaaaacaattttataaataagacctcaaaagtacagtcaactaaataaaacacaaacgaattaaattttatcaaactaaacagtgtttacacagtaaaataatccaaatattgaatagataacataaaagtggtaaaatgtattttaaactattaattaaacaggctattaatatccagaatataccagaaaaataaatgtctcaaccacaaaaatataaataatcttattttataacagacaattaacccaaataagcagacgtttctcaaagaaacacatacaagatgccagaaaatatttgagaaaaaatggtcaccatcggtaataatcaggaaagcacaaatttaaagtacaatgaaatattatctcaccccagacagaatagccatattcaaatacataaaaatagtgctaatgtggatgaagataaaatgggacatgtatacactgttgatgagaatgtacactcatacagccactatggagagacgtatagaagttagtaaaaccacaaatgcaacaatcatatgatacagaaattttacgactgaacatttgtcccaaggacaggaaattaatatattgaagaggaaaatcaatattttgatgagatttcttcactcccatgtttattgcagccctgttcacagtagccaagtaattgaatcaaccgaagtgttcaatataaggtgagtagagaaagatgatgtggaatatgtacataatggaattctacacagccatgaaagattaaattgtgtcactcatagaaacttgcatgtaacatataagactctatgttaattgaaagagccaggaacagaaagctaaacaccacatgttttcactcccataaaatagtcaagaaatatccataaaacataaataattgaaattggacatgaactatagaaacaataattgtcacctgaatatttattttccttcaaataatatataattcaatgatagtaagaagagtcctgataaataaatcatgttgagataaagagctactgaattgtgcattccacactaaatggaaacaatgccataagatccagtgttgtgtaggatctgtttacctttttacctcaaatactacaagtcactcccttgttctaatcaccccgcaaaactgatattttgttgctttatgttatgtcagtaaaaatgattccacattggaagcttcatgtgttgctcagaaatcaccctgttgataaaatgagcacaactacagttacaacctttctgtagatattttctgcatatgatcctcactttttatttgttgtttttgttcacagtttctttaagcactcagagttatatagcatattttcagcatattttaattattttccattgttatggtcagtgctcctgtgggctcaagagtcaggtgttgtgtgactgccagttgacttcactgccacctttacctacacaaaacactgcaagatgaaccatgatgtgtaagaacccatccacaaagtgcttcaaataaagacaaggtgacttgtgtatagatttagtgagactggggaacagttcacggtgttatgttacagaggagcagaaaggtgaatctctctcggagttattgagggtgtaagagctgcagttttggagggtggtgaaaggcacttttgagtgggaagccctagagcatgtgtgaaagctgaaggaatgatcaccatgcacatggacgctgatgaggcatgtggtaaggtccattccctccagatgttcctggatgggcggttgtaggatggctcatgtatatgaaaatgtgggcagggctgaaataggaacaaggccatcatcccacgggaatgcgagaaagcaaaacagagatggacacccatgaagagagctcattagacctggtgaaggaaagataggaatctcttccaaaggctccgctgttcttggctaaatatgaattgtggtgatagactgaaaataaggaggggaagggagatatgactcaagagaggaaaaaccctaagacagcataaaccaaatctacacagaacaatcacatggtagatgccagggtggggctgaaacaggagcttcaatctactgggtacctagttgagatcctttgacatttcttgtgaggtaattctagtgatgatgaatttcctcagttttcctttgtctgggaagtatttctctatccttcatttcataagagatgttttatcaattttaggttcttggttggctgctttttccccccagaaatttaaatccagttatttgctgcataacaaagtttctgccagtaacagatggtggttccacggtgctatacttccttacttatctatatctctttatgtttagatacacaaataattactactatgtttccatggccaacagtattcactacggttgtttctgagtcactggggtgttgctttttctggccagaaccctctgtggccagtggcacttttgcctgagttcttgtcctacatgtggaaagaatgaagtatgcagccatgtggagggtaagcaagacaaagcctagcttcattaagcattagagcatctcagaggagacccccagtgagtagctcctctctgtaggcaggtagactggttgagtgttcagctctaagcagagagggtagctcctccctgcagccggtcgtcctgtggtcttcccagttctcaggagagagggtagctcctccctgcagctggtcgtcctgtggtcttcccatttctcaggagagagggtagctcctccctgcagctggtcgtcctgtcgtctctccatcctctgtcctgctccagctgaggccaggggtttttacggacctccgaggggaggaagtgcaagcccattggtccatgggtgctcatgggtgggccgtaggaagcaccacaagtcccgactctggtctgaggatctgggagccccggcccagccttcaggcccttcctggggacccgcccctgtgcacaggatcttcctgcctcctgttgtagttcatggtccctggggctccgccctgactttgctccaagatcagagcaggcaccagcagcaggaagaagccaggaagtgggagcaggcacttcggagcatgcaagagcacagggcttttcctggggaccccaagagtgcaggggcgcctgaggccgcagcccccggtttgcggagcagggcttctgccggcttcatggagcgagaggcccgtgtcttcagccgcagtttgggaggctgcagccacagccggggaggcagggctccttcctgttcctcgacctccaagagcacagagtccgagcccactgccctggtttgcgcagctggagccgcacctgagagatgagagctgctgcctgctcctggctcccaccggctccgtggagcatcagcccctccacccctccttgcagcctgggcaggggctcctgatcctctctgggccctggccggcgtccagggcaggagtgacatctccacaagctccctgcattgccccggtgctcagggaggcccgggcagagctgatgacgaccccggcccgtagtcgggagtggcggcctccatggtcaccctgacatgcggctgaaccctggggacgcggcccaagcagcctgcacagaacctcccaaggcccaggaaccccgcaccctaggcggggtgggcacagcggctgctccgctgcccgggttttcaaggaggcgccacttccacttccctccctggaaccccgaagtttgacatgggggctcctttctgccttgctccgcagctccccttcccccggagtggagccccctgtttccctggcgttccctcccacagctgcagtgttctccatcggtgtcatcaccttccagctctgctgccctgctctgcagactaaggctctgattccataagagaggggagctgcttcccagtagaaccttgctggggagctctgttcccatctcagttcctgaggggttaaaccagtgcatttaggatactggttttggtggtttgcccctgttgagtaatttcttagttctctagtgggtgtaagagacttggctctggaagcatttcagaagtgtgggctctgatacaccccagacagacactttgggaagggaagatttttgtgactattctcattataagggaaaggcattcaaaagaatagaaaaactctccagtatgtggttcctgagaatttctcactaaaaacatgcttatcacactcgactcaaaacagttcaatgtatattagtgtattttatcttgtactagcctttattgcatttggtgaactctgccccagttcagctcatactctagctttgattctccctacaaaaacttgtctctctctagatttcagatttgttgattgtcttaaaatttcaatgatctgaagtattaaagaaaatttgcaaaagtccattttctctgattaacagttattgttgattttattcttgttgtaaaaaaaagaaattctcatctatgtacatttcaaacctgaataacaaaatttttattaacaccaaaaataataaaagaatccaaatatttatcagctgcctaatagaaaaacaaatcatggtaacattgttcgctggaatattacccatcattcataataagggaatgtctgatacacaaaataagaagataaaattatcaagtatttaaattgagtaaaataagccaaacaaataagagtatgtatgattctatttttaaaaattctggaaaatgaaaactgatctaaagtaatataaagaagattagtagtttcctgggaatatgttggcagaagggaaggagaaaggataaggaaatagaaataggaagtagaaggacagaaaagaagttgagggaatttcacttgtccaccttccttataatggtaatagttatgccatgattatcagttttacactttaaatatgtaaagtttataatctgtcaatcaaatcttataaaatgtattatgaggaaacaagttgaaaattagacaatgtaggagtgacagaaagatagatatgagtatgttgaatgtcagagatacctgaaagtttatctacctgaaccctagttctctccatagtttaaggtaaacaggagagtgcaggaaaatcatccatattctgattaggcagtggcttctgcaaaccacactaggcctggccggctgtgtcctggagttggctaagggaggagtcagggccagtggtgagaagtgcaggcccagataccagaactcactcatcccagacatgagctcttagatacacagagagcccatccatgtgtggatttatcttacatctgtaagtagagaacattgactcttacagaacataatttacacacataggtaaatctgaaataaggtgatcagtgtgaagattttatcacagcacagtttcataataagcacaatttctcaaatcccattgttgtcacccatcttcctcaggacactttcatctgccctgggtcctgctctttcttcaggtgtctcaccccagagcttgatatatagtaggagacatgcaaatagggccctcactctgctgaagaaaaccagccctgcagctctgggagaggagccccagccctgggattcccagctgtttctgcttgctgatcaggactgcacacagagaactcaccatggagtttgggctgagctgggttttccttgttgctattttaaaaggtgattcatggagaactggagatatggagtgtgaatggacatgagtgagataagcagtggatgtgtgtggcagtttctgaccagggtgtctctgtgtttgcaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagacacagtgaggggaagtcaatgtgagcccagacacaaacctcgctgcaggggcatctgagaccacgagggggtgtcctgggccctgtgaactgggctgctctccgtggcagcggctggtggtgctaaaggctgattttctctcagcatctggggctgattcatcaagtttcctcagagacctttcagattacaattctgtacttacgtttaatgtctctgaatgtgacactttccttccctggtgtgtctttgtttttgtgacaagaggacacattctcacctccacagaagcccgagtgtcactttggggacagaaatgaccctgccctggtcaccagaatcagagtcccgaggaagcccaggaggacctgggaagtgtttttcaatcagactcagggcaggcgtctccgtgggaatctctgattggaacaggctttgggattcagattgggaccaagagggaggctcacccagggccagggtccttagaatcctgacagttttcacagtaaccccatcgtcctttaaaactgaacatctaactcagaactgacccatttggtcctttctctgtaatccattttccttttctctaggcttcattcttacacttcccttttcaccttcattctgaaaatggagggtgtgcttcctgtggtctaaaccacaggcctcagatgcattacctggaactcaggtgtggctctggctatggctcctgtggacctggcaggctgagggatctttctcattccctggtgcctgcatgcccctgctgtcttctatgcgtggatgcatttgggaaatgcaagtggacactcatagtcgtttcctcaaatgggatactgttgtagagctgatcttgtgcttctcaccctgtcacagagcccccactctcacttgtggatttttgggagagctgaggatggacactttattgggctgtgagctctgcatgatggcaatcgtgaggtctgggtgggcacagccagagccaatggagctggccaaaaggaaagacaggacggaattcctgggaagtcctacagctgctgtctaccatagagttccattgtcttctcctctgctaggattaaaccagaccgaccaagttcatctaggacaatcttcctgacctagagaagtgatgacaggctttaataacacctgtattatacatcagagcaacacctagattagtgtttgattgaataattgagactatgtcctagtcaaggtgacacacaaaatcaattattaccatgattaatattttatattgattaatattttaatactaatattaatcaatgcaatattgatttaatattaattaatattttatatttgacaatagaatcagactcatgttataaataattttgcaaatatatgtatattattattggtcttctgagcataaatctccattagccgattaagtgtgcatgcattggtcgaaggagggcatccacccttttgagggaaaatgcatggagggtaaatgaggctgggaagctgatggcatatgatggaagcctgtccctgagtgaaggagagagggaggcaggattgggtggaactttcctacatttctgtgctgtgcaaagaaactccagattatcactgagtctcctgcaagtcaaagttgcccctcaggaaacccccatcactcccagcaatgactctgccccagatgagtgcaaggctcactctattcctgagaaaggagcacaggatatgggatttagcatgagccacgtcatggacgtcagagagcaggagctgggtgcatgatccaagtgcactgttctgcctgtaggtggagagaggaaggtgcattcccagagctaacacactgtggatttttatacagaatacacgttttcacctgatttattggaaggcatatgaaaaaatgtgcagtccacaaacaattgtaatttccaaatttaccacaattgcattatttcttcattctgcatgatgtcctggaacagagttacatttttcatgggtattgtttcatggattgaggacatgaatttcacacctgcctttttagccatgtgcagagaccttgagtagagcatgtctggacctcatctacactatctctcatgccccaagggaaagagtggagacttgactgactgcaaactttggggtgggagctgctcctgcacacctcagaggctgcagagaccccaagtgcagttttattgagttggggtgtctttctatgtgggggaattatgggctgccccactcctggtgattgctggtcagctctaaagacgggttcagaatgaggtcacctggtaacctttctcactgcagctccattatgtaaattaccactaccagattccaggtaataatgcaagctctatttttgcgacctcattttcttatcttttttgttcataagtttggttatagaaaatgttaccacctagtttcctgattcaaatcctataatttgctgaactactcaggatgttttttaatgtgcccagtatttgggaaatataaatgaacagccatgtgtggttcactgagtggacatagtcagttaagtacattagtaaaaacatgattgctgaattgtatagtgaaactacaattagatttgcagaaaattgcctccagtaatgtctgaagggagagccacccagccaatcccgtctctgggcttggaggaagctcactacacaggccaggtcacatgggtgatatccaaggtgcagctcccagcgttactgtgctattttccaggaaccagacatacaacttggcatctcagaagaagatctccaagatttcctttacctggacttcatgggcagcacaggaccagcaggagatgctcagaactcacccaaggcagaaccccagggaagagcaggtgcggagaggaaccagccagggaacctctgaccaccatctagggttgccttcttttccttcacagcatggagccctcaggagaccacccactaggttgtctgtaactcacgtccttcttgtcttgaagcaaaacagacataaatatgaatttgcagttagccccttgaacctgggtcaattttttctgagaatgccaacttaatcgtcaacatcatgggcattatatcaaaatcgagatggatatttagtcaccaggaagacagtttgtctcatggtagaagtgcttattcaattaaaaattacattttaatgaaaaggtctctaagtgaggactgttcaaataataaagtattagtgaagtatcagaaaaataaatggcaccattatctttggtatccagttaatctataaagcatatcaatattcatgttgtaagtggcctaggacaagttatggcagtatttaggctataaggagacattgctttccttcttagataggaatgtccttttttatcatactttaagttctggggtacatgtgcagaatgtgcatgtttgttacataggtatacaagtgccatggtggtttgctgcactcatcaacccgtcatcgacattaggtattactcctaatgctatccctcccctagccccccaccccccaacaggccccagtgtgtgatgttcccctccctgtgtccatgtgttctcattcttcaactcccacttatgagtgagaacatgcagtgtttggttttctgttcctgtgttagtttgctgagaatgatggtttccagcttcatcaatgtccctgcaaaggacatgaacaggaaattccttctaaatgaactgtgttttgacaaatattatccagtgactcttcctacatggggtttctacatgatctatttttcttttccaaaaacaaatcactcaagtttctcatctcctgagtgagaaaaattttccccaaacacaatctcagtctaggtagacaccttcatgaatgagccttcattctcagacaggcacacactgtccccatgtggatgcttctctcagacaggcacacatatccccacatggttgggatcatctgctgggactttgccccatggggatctctattatcactggggcaagttagcacctcgatcctcatccacactgtggcctttgatgtctgtgacctgccacaccctgtctgtccctcagtgtctagaatggtgaagtagtccaccccagggatggaggaagatcccagattttcctgtgaaggagacagaatgccaatcacagagatggaaatctctcacatccctcctgggtcatattctgggcagggtctctgaagtcacccctggatcagtgtcctaagatgtctccctctatttccttgggaagaacccatagaaagacaaataagtttttctattagggcatcgtagaacttgtgctttcttgtgtgacaaatataggtattttgactattttaaaaattagatataatattaagtctaccaaatatgtaaatatataagctttataatgtatccctagagggatgtctcctggaattgagaattgaatatatatatatatatatatatatatatattccaagataaatcttggtgaacattataaaattgactctaatatttatgttcaagatgatcatttcaaaaaagttttaacaacagagaccagatgtatctttccaccagaaataactgtaaaacacagtgaaattttttaaacatgattttaaggtattttacatcaaataacaaggacagtgattgctgaggtggggaaaatatacaaaaggagccctctgatgaacgcatgctttgctactttttaaagagagtttccaggccacagtgctgaagaggaaccaggtagatttgaagttgaggaaaaggagctgagatcccagacaggccaagaagtgtggagatcacagactagacagtggatagcagaacactgttcagagagtgagccccgtagatggccggagagagacccagccttggtagagtgtggatcagtgtatgggaaccctggaaagttgtacatgagaacacaccttactctagggggcttgccttaaaatctaaaattaccctaaaatttaaacataatcagttacaaattttaaaacataaagaaagacaccatgttaaagaaagataaaggaaaggtggatttgcaatattaaaatataaaaagtgtatttctgaacaaatgataatactgatgaggggggacaagtttattccatcacggcaaatgatttaagagaagaacattccaaatgcttatggccctaatgaggaagcttcaatcacgaatataaatagagttatctcattaccagtgtgatggtgtgagaaacttcaagatttccaaagagacaacctaatctggtaaaaattatagaaacccaacctgtactatcaaggaaaattattctgagaacacacagtaaatgaaatccattgactgacataaagtcctcctgttgactgaagggttatgaccccccacaaggcatatgttggaatctcaactccatcgtgacggtggcaggaggtggggcctttggtctcctttgaaaggtgttgaggctccgtttcatgaatggaatcagcgtcctgatacaataccccagagagctccctctttccttccaccaggtgtggtcacagtaggaaggtggcaatctataaataaagaattgggacatcaccagataccaatctttaagtcatctttatcttgaacttcccagccttgaaaattgggacaaatgcatttatgttatttctgagccacccagtccatgatatcctcttatagcaactcaaacagtcttagcaagtgcagtgaggatcacaatacttgagagaagagcattacctcttctttacatctcaggatcacagaatcttgaccttgggctgaactgacaagaaggtggtgcttccctctcccccagatctcagttgaggtcatgatgtcagatctttatggtggagactaaattcctgcctgtgatttgatggatgcctttctcctcccagcctcactcacaagacatagtttccatgtcaggtgttatagaccaagaacaggtggaccccgattattctcaccccagctcacttgtagggcagaggttctgggagcttcctgggagaggaacagtgagatcatacaagtccatcacttccatgcagttttctgtacttaaagcaggagtgtccttctgagctgcttgaaccctttcttctgcaccaaggtagagacttccatgtttttctagtgatacagtcagggcataaaaacagtgatagaaagctctctctaaagggcgtgaccagatttgcagtagaatgagaatagtttcaaccctaaagttcatctaaaatgttagtggttttcatggtaagtaattaatagaaacctgacagctccatgacagcaatatagaaatcaatagtccactcattttaacagagagaattagaaaacctataatttaagaataaccagctgggcactgtggctctgcctgcagttgaatttacttgggagtttgaggtgagaggatcacttgagcccaggatttcaagcgcagcctggaaacatagctagacttaatttcttgaaaaaaatcagtgctattttggggtcagaacaatcctcaaaaatggtccccggaaagaagcccaaatttaattgcaccagattgttgaacgatttatgctacaaaacagtgtcacatgtcagaaatgagcacagtgtaacatctacatggtttgttaagagacacaaatggtcaagtagaacaatcaggtaattaggctgtcgaaggcaacactgccaaatgacagcatttccgtggaaactgcgtgtacatccaggactgcacctgtgaacgatgacatcatacccttcacagtgtcgaggaaagagacatcactcaaacagacaagccaagggacttcagaaaatataaggggaaatacagtgtgcaaatatgtaaaaaatgcaataagatgattactcctaaatgaatatcaagacacaatcacataatatgaaattaaattttcctgaatgataggattactaccaatcaccccccaggacaccctcatctactctgtgcacagccttctcgtcaggcgtcccagcccagaccttgctatgtagcagaagacatgcaaataagacccccctttttgctgatgaaaagcagcccagccctgaccctgcagctctgggagaggagctccagccttgggattcccagctgtctccactcggtgatcggcactgaatacaggagactcaccatggagtttgggctgagctgggttttccttgttgctattttaaaaggtgattcatggggaactagagatactgagtgtgagtggacatgagtgagagaaacagtggacgtgtgtggcactttctgaccagggtgtctctgtgtttgcaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacacacagtgaggggaggtcagtgtgagcccggacacaaacctccctgcaggggcgcgcggggctaccagggggcgctcgggactcactgagggcgggacaggtcccaggaacaggtgcagcggtaggttttctttctcctcagctggagaagtcaggtttgtgttttcagaactctggagtcttacaggttgctacattttcatacagttattagtatgtatttattatcattggtatttaagttttaataattttaaaccttttatgtagtgttattttttaaaactgtttactttcatttgcagttattcttccagagtttcattaacatctattgctatgagcaactacatagctatgagagcataaatttacacctgtagacgtaggtctaaatgccacaaacctgtgcataaatgtatagtgacttatatttaacattataataagataatttttaaaatatatcctaaacgatcaaacttactgatgaactaaatataaattatcagagtaatgcataattgatttcaataattttatattgtttatattaattaatatctatttctttactgaaacataatatattggtcatttcaaaatagctacgatacatttcaaatggccttgatgctaataatgaaaagattttgaggtgattaatatgctaattagttatatttaattattccatattgtattaatatatcaaaacattgctttgtacctcataaatagatacagtcgtaatttgtcaattttcaagacagttatttaatccatcctgggtcataatctttttttcccctgtccatggctgattggattgtcctgataaacccatccatacgcctgcctcccgcaggcttctgagacgggctccatgaaggccagaagcaggcaccctgtgagagtccacacgacctggagcctccctctccttggattaggccatctcctcgggatcgcagggctcttcattatcctcacccccttgttgtaccaaacaagcaacatcacactttaattcatcacgctttgctttaattttccccccaaaaatcaaggtaataattttagcaataaacatcacaacctactatgagtaagtcctttccaacgtactaaggtttcttctgaggactttacatgtattacacagtttaaatttctttatgaaatgagataccaatatctctatattagagattgtttttctaagtcgtttctgacaattaatttgtccaagggcctgtaaggattctgttagaaatccaggataaaatttgaaatttcagcagtaatatctggaaaaacattgagactatatttaacttcgtacacgtgctctcaaatatccttatttccctaaaggttgttctcagttattattttacacatgatatctataattaatactaataacacaggttaaaatattatctcaattatttaacgacttttgataataacaaaatacatattccacatatttttgaccagtttgttttctctatgaaacacgtgtttattaacttattattatcagatgtcacccttatctttctgatttctgggatttaattctagcaggtatcgtttagtatattttattaattcatattatattgttcacattttcagtatgattttattatttgcattgtttattgaatttgaaactttcttacataatttttttaattttttattttcatgagatgtaatttcaatataagtaataatgcatagatctgcaatgtaccattacaggatttctggcaaatgtaaacacacttgtccccaacagccaaggttggatgtagaggaggcccattcccccagcacaagcgaccttctctgtgcttccagtcagctcccacatttaacacaatgttttgatttctgccactgtagattcactgttcatgttttgattttcatataaatggattcaaacattatagaccccttttctggtaaggggctacttttgttatttttgacgtttatttatgctatttcatatgtaaaattgcatctgtatattgtcatttattcacttaacagactgcctctgatataaaatctcaaagttttgatatatatggataaagagagagggagagagagagagggagaaattttatacttgagtcagtgcatttaacaataaacgacagtaagctgatccatttccctgtcaatgcacttttaatttgtttctggtttattaacatcataagcaaagctgctgcacatattttttgtttttctatttaccttttctcatttttattgagaaagtatgtggaaatatccatttcttcatcataaaagtaaacttcatttgttcagctttatggaactataattgacaataaaattgtatatatttgaggtgcaccacttgatattttggtataaattgtgaaattttcactatgaccaaggagttagcatgtctgttaccctacatttgccattttcttcctttaatttatatgtgtgtgtccaatgagagcacctgagatctatccctttaccagagatcaagtttgcaatacagtgttgatagctatagtcccattgctttacattagacctccagaacccattcaacctgcacaactgaaactttatgcccttgacaagaatcattctatttccactcctcccagccctgggaaccacttttctactctctgcttctaagaatttgaatattttagattccccatataaatgagataatgcagcatttgtctttctgtgtctggcttattccacttagcataatgttctccaggcccatccatgttgttggaaatgttataatttccttatttttagaggtcacataatattccattgtatgtgtatacatttgctttatacacccatttacctacggtcactaactttaaaaaaattctaggccattatgaataatcttgtaataaacatattttttacttactgattttatttcctttgaatacgcagccagaagtgggatcaccagatcacgtaatagttttactttcaatttataaaataacttttactaccactccactgaataattctcttttcaccagctaactgtcagcattttgttatcttttgtgtctgtgataatagtcatggtaatgaacgtgaggtgatatctcattgtggttttgatttggattcccctgatgattagcaatgtggaacacctttccatgtcctgctggccatgcatatgtcttcccttgaatacaatgtctatgtacagttttgccctcttaaaaatcaggggttttttttgctattgtatgggttctttacacatttagatagatccctttgtcagatatatagcttcaagtaatttatttgtctatgattttggtgtcgaatccaaataaatcattttccagatcaactctggaaagcttcttttttccctgttttcttctatgagtttacaattttagatatcatattatatccaagccttgagtacatttttaggtgatttttgtatatgagatgagatgaggtctcatttttttctgcatatggatgctcagtttttacaccatttgttaaaaaggcaatcttttccttattgtgtgtccttggaacaaaaaatctgggagatacacaaaagaggaaaatcttagaccaatattcctgatgatagacctaaaaatcttcaagaaaatactaggaaattgaatatagcagcacattaaaaagttattacattatgatccagtagattttactcctttcatgcaaggctagttcaacatacacaaatcaataaaggtgctccaccacataagcagaatcaaaagcaaaaactatataattatctcaatagatccagagaaactttcaataagattcaacattcttcatgataaaaaccttcaacagactagacatcaaagaaacttagcttaaaatgataagagccatgtatgacaaacccacaactgacaccatactgaatcaacaaaagctcaaatcattccccttcataactggaacaaaacaagaatacccactctcaccactcctattcaacatagtagtggatgttctagccagagaaatcaaacaagagaaagaaataaaaggcatccccacaagtaaataagaattcaaactatctatttttgctgttgataggatcctatgcatagaaaattctatagactctgccaaaagaatcctagaattgataaacaactttagtaatgtttcaggatacagaataaatatacgaaaatcagtagcttttttatacaccaacgacatccaggcatagagaaaaataaatgacacgatcccacttacaacatctacaaaaaaagaaatacctaggaatacagctaaccaaggaggtgaaagatctctacaagaagaactacaacctctccagcacatgttgtttcctgactttttaatgatcgccattctagctggtgtgagatggtatctcattgtggttttgatttgcatttctctgatggcgagtgatgatgagcagtttttcatgtgtctgttgactgcataaatgtcttctttcgagaagtgtctgttcatatccttcacccactttttgatggggttgtttgtttttttcttgtaaatttgtttgagttcattgtagattctggacattagccctttgtcagatgagtagattgcaaacattttctcccattcgttaggttgcttgttcactctgttggtagtttcttttgctgtgcagaagctctttagtttaattagatcccatttgtcaattttggcttgtgttgccattgcttttggtgttttagacatgaagtccttgcccatgcttatgtcctgaatggtattgcctagattttcttctagggtttctatggttttaggtctaacatttaagtttttaatccatcttgaattaatttttctataaggtgtaaggaagagatccagtttcagctttctacatatggctagccagttttcccagcaccatttattaaatagggaatcctttccccatttcttgtttttgtcaggtttgtcaaagatcagatagttgtagatatgtggcattatttctgagggctctgttctgttccattggtctatatctctggtttggtaccagtaccatgctgttttggttactgtagccttggaaacaacaggtaacaacaggtgctggagaggatgtggagaaataggaacacttttacactgttggtgggactgtaaactagttcaaacattgtggaagtcagtatggcaatttctcagggatctagaactagaaataccatttgacccagccattccattactgggtatataccaaaaggattataaaccatgctgctataaaaacacatgcacacgtatgtttattgtggcactattcacaatagcaaagacttggaaccaactcagatgtccaacaatgatagactggattaagaaaatgtggcacatatacaccatggaatactatgcagccataaaagatgatgagttcacgtcctttgtagggacatggatgaagctggaaaccatcattctcagcaaactatcgcaaggacaaaaaaccaaacaccgcatattctcactcataggtgagaattgaacaatgagaacacatggacacaggaaggggaacatcacacaccggggcctgttgtggggtggggggaggagggagggatagcattaggagatacacgtaatgctaaatgatgagttaatgggtgcagcagaccaacatggcacatgtatacatatgtaacacacctgcacattgtgcacatgtaccctaaaacttaaagtataattaaaaaaaacaattacaacgaaaatccttaatgtctcttgagtaggtagagaacatatattttatctaagtaacttgctctaaactgcaaaccaaaataagatgattcaataaagtattttgtaaactagtctttagcaaaaaaaaaaaaagaactacaaaacactgcagaaagaaatcagaaagtaaacaaataaattgaaaaaaaaattccatgctcatggaatgggagaaataatattgcaaaaatggcaatattatccttcaatatttatcgattcaatgttattatcaaaataccagttttattcttctagaaatataagaaaagtattctaaaatttgtatgtaaccaaaaaagaacaaaaacagccaaagtaatcctcagccaaaagaacaatgccagggacatcacactatttgacttcaaactctactataaagccacagtaacaaaaactgtttggtacttgtacaagaataaacacatagacaaatgaaatagaatagaaaactcagaaataaagctgcacacccacaaccatctgttttttgacaaccctgaaaaaaataaacaagcaatggggaaaagacaacctagtcaataaatggtgctgggataacttgctagccatatgcagaagatgggaacttgactcgtgactatcaccatatgaaaaagaaaattaactcaaaatggattatagctttaactaagacttcaaactacaaaaagctaggaagacaacctaggaatactcttctctgcattggccttggcaaagaattactggctctgagaccaggcattttttgtaacagtgatttattttctggggtacatatcatggagtgggattgctgattgaacgatagatctattttagttgcttgataagcctttacaatttttttcacataggttgcactaatttacattaccaacaacagtgtataaatgcattttctctgaattctcatccatatctataattttttgacttcataataataggcactttgactgatgtaaagttgtgtctcactgttgttttaatattaatttatctaatgattaatgttgttcagctttttatttccatatgctttttggccatttgaatatcttcttcacaaaatgtctgttgatgtcttttgcccacattttaatggtgtaatttatttatttgttgttgttgctgagttgtctgtgttcttgttagattctagatgttagttatttattgcacagtaatgtaataaatctaaaagtcaggaaacaacaggtgctggagaggatgtggagaaataggaacacttttacactgttggtgggactgtaaactagttcaaccattgtggaagtcagtgtggcgattcctcagggatctagaactagaaatatcatttgacccagcaatcccattactgagtatataccatcccatgactgggtatatacccaaaggattataaatcatgctgctataaagacacatgcacacgtatgtttattgtagcactattcacaatagcaaagacttggaaccaacccaagtgtccaacaatgaatagactggattaagaaaatgtggcacatataccccatggaatactatgcagccataaaagatgatgagttcacgtcctttgtagggacatggatgaagctggaaaccatcactctcagcaaactatcgcaaggacaaaaaaccaaacaccgcatgttctcactcataggtgggaattgaacaatgagagcacatggacacaggaaggggaacatcacacactggggcctgttgtggggttggaggggcggtggggagggatagcattaggagaaatacctaatgttaaatgatgagttaatgggtgcagcacaccaacatggcacacatatacatatgcaacaaacctgcacattgtgcacacataccctaaaacttaaagtgtaataaaaaaaataaaattaaaaaaatcaattgcaaaaaaactgttgaaactatgaaaatatgaggtaattaaacaacacaattttgaccaatcattggctcaccaataaaattaagatattaatttttaaaaatacaaagaaaaatgaagccacaacataccaaaccctctgagatacaggaagagcagtactaagagcttatagttctaaatgtctatgaaaaaatagaaagattataaactagcaatctattgatttacttcaaggaactagatattttagaacaaaccaaccccagagctagaagaagaaaataaataaagatcatggcagatttcaaaaatattgaaacaaaaaagcaaaatataaggaatcaacaaaacaaaatgtggttattttaaaacatgaacacaattgatagagcactaactaggtcaacaaaaaaaaaaaacagaagattcaagttagcacaagcagaaatgataaaggtggtattataactgacccaatggaaatacaaaagattatcaagacatactgaatatgtctatgctcacaaactagaaaatctagaggaaatcaataaatttctggaaatattcaactaccccccaaaattgaaccaggaaggaaaagaaatcctaaatagaccaatgcgagtaataagactgaatcagaaactgaaaatctcccaaccccaaaagcccagaaccagataaattcaaggtctaattttaccagatgtaccattcttactggaactattccaaaggattaaagagaagagattctttcccacctttgtctaaaatactcgtatcacctaataccaaaatcaggcaaggatacaactacaacaacaaaaagctacagggaaatatccctaatgaacatagatacaaaatagtaaacagaatactagctagctgaaaccaacagcacaataaaagataatacatcatgaccaattgggttttattccagggatgcaaagcttgtctaaaataaacacatcaataaatatgattcaacatataacataattaaaaacagaaaacataagaccatctcaatgaatgcaaaaaagtcattcaataaaattcaatatcccttcatgaaaaattcctcaacaagcttagcatcaaagaaacctacctcaaaactataaaagccacatacaacaaccaacaaaaaactcttaaataaatcaatagaacagggatcttcttaaatttagtaaaaacctatgcaactgatttattcaatatgctggacttggtagtgaagaaatgaatgactttaactaaaaaaaaaagccacatataacaaaacaacattatatggaatgagaaaaagttgcaaaaatattcctgaagaacgtgagcaagaatgcacactttcaccactcctactggacgtattactgaaagtcctagccagaataatcagaaaggaaaaaagaaatgtatgtttcaagttccaagctaaggaatccaggagtggcagacccagagacttgttttttaatctatgaataacatccaaacccctgaccgatcccttggaacacaggatttaggggtgattgaggctctttcttttgggttaaatgaaagttgctaggtggagggtgttaagtaaaaattactacataagctgcatagttttgtcaaatggttgtagttttcttgtccagcctgctgttcctgaaccaccctatatgaaagccctcaataaactatatgtcttgttcactggtttggcctgttgtacacgatgccagtcctattggagtccatattggtctggcgtgacatccagtcaacctggtaaaaggtccaaaaaaaatctcatgagcacccagacaatggaatctaaaaagaggagacccctgcagaaaccttgggcaggctgttaatttctacgtggggcccaacagccgttatccatgatggatggggcccagtgcctgagtatggggataccgccacaatgccaaaagttctggaagaacctcttcagtgggtgcatcttacaaagtgaaagtcagatgtccaggctgttgcattatcaggtgagtggttcttcctgactgcactctgagaagccactgagacagtgctcactgtgtatgctacagtgtgtcagtcacaagaagagctactcctagaaaaacatgccagactagctcagactaatcagagacctttctgtcctgcctgtggaagcagaatggcaaattggggaccgccgcttgtggagcagcacatttgaaggatttctggccatcacatgaattagttacggctgtgatgactaaactgtcatgggaccctaagacctagttcccataaagagttctagggggaggaggatgaagtttggggtaagcccatgggggttcctgtcctctctacacatctggtggctaccaccaaggtaaaaatgggccaactgcaccagcagaggcgagccccagagacatttcccacctgaaataaggaaacacaccacaatgtgggattccaccactgcggaattgctgacacttagaaatgggttcagacagaagaagagagagttgatcacagggtggcttcttcatctgtgaggcatgcgggaggagggcattatactccctgaactcaagattagtaaagtgacatccatcacaaaccatctgggcctgaggcagcacctcgatggtgtcagtcatggagattggaccatccctctccttagctgggtggttgcagactgcaagggaccctggtgaaacgagggagatgtccgctttattagtgtgttctcgtattgctagaaagaaatacctgaaactgagtaattcacatagaaaataggtttaatttactcatgattctgctggctgtatgggaagcatgatgaaaaatctgttcagcttctggagaggcctcaggaaatttacaatgatagtgaaaggcaaaaggggagcagccactttatatggtgggagcaggagcaaagaaagagtgagggtggaggtcccacacactgttaaacaaccaaatctcatgagaactcatttactatcatagcaaggggaccgtgctaaccattattcataaatccggacccacgatacaaccaccgggccccgcctcaaacattagggaagcaaaatcacatacagttgttatgacaggtgggacatcctgaaaacctctctaggcatgtcccacacggccctggagctgtctcaggggagcagtctcctccagtgtttagacgcacaggcacggataatagggctaagtctggccagatgtgtgatattcaacacattgcacaactgctctgttctgtatgtaatttatcttctctacaaatgtaacattgatggttgcattaaatatattctgcaaatatgtaaaaataaaataagatgatgattgctaaatgattatcaaggcacaatcacataatccgaagttacaatttcctgagagataggattactgcccatgcttaccaggacactcacatctgctctgggcactgccttctcctcaggcgtcccaccccagagcttgctatatagtaggagacatgcaaatagggtcctccctctgctgatgaaaaccagcccagccctgaccctgcagctctgagagcggagccccagccccagaattcccaggtgttttcatttggtgatcagcactgaacacagaggactcaccatggagtttgggctgagctgggttttccttgttgttattttacaaggtgatttatggagaactagagatgttaagtgtgagtggacgtgagtgagagaaacagtggatttgtgtgacagtttctgaccagggtgtctctgtgtttgcaggtgtccagtgtgaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagagacacagcgaggggaggtcagtgtgagcccggacacaaacctccctgcaggggcgcgtggggccaacagggggcggtcgggaaccactgaggacgggacaggtcccaggagcaggtgcagggggcggtttcctgtcagctgcaggaggcgggtttgtttttgcaggactctggagccttatgaggttgcactattttattatggttatttatcatgtgttttttattgatatttgtgttttagtaatttttacatttatatgtaggggtattttttaaaaatacataacttcaagaaataattcttcctagtaatttacacctattcctctaaagttttattaacacctgttgatatcagcaactacatagctatgcaacattaatttacatctataaacatatgtgtgaatacatgaaactatgcatacatgtgtagtcatttatatttaacattataataaaataataaattaaataaaataattgaattaaattaaaagaattaaacttaatgatgaactaaatataaattagagtaatccataattgatttcaatccttctctatggtttacataaatcgatgtctacttgtaagcttaagtatagtgaattggtcattttaaaatagccaagaacaaatttcaaatgttcttgtcaccaaaaaatgataaggatttgaagatttgaggtgatatatatgtcaattagctcgattcaattattccacattgcattcataaatcataacatagctttgtaccccatcagtatatggggtacaaccaaaatttctcaatttccaatgaaattttaattatatattttttaatttgatgcctctctttggatcaggccacctcctcaggattacagtgctgttcagttttctcaacatgctgttgtaccagataagcacaaaacatttaatttcattatgctttgctttagtttttcaaaacaacataaaggtaataattttcccaacaaacatattacagcctattctatacttttttattttttgtttttatgagataaaatttacatgtaagaaaaaatttatagatctgaaatgtgtcactagagagtttctggcaaatgtgaatacccttgtcccgaacacctaaggtagactaaagagcaagtccatacccacaacatgcgtctttctctgtgcctgcggtcaacccctacatggggaagtgttttgatttctgacaccatagatccatttttttctgttttgagctttatataaatggaatcaaacattatagacctttttttggtaagggactactttgctattttttaggttaattcatgctatttaatgtatgaaattagatcatcatagtgtcatttactcaattaatgggctgactctgatatgaaacctcaaagtattcatgtatatatggagagagagagagggaggaaggacagagattttatatctgagacagtccattgagtaaatatatgacaatatattgatctatttgttgtcgatggattttacatttgtttccagtatatgaatattataagcaaagctgttacaaatacattagtgtaagtttctctatctatgttgtctcaattttgttgagaaaatatgaagtatgtttttctctattgtaagaggaagtttaatttttttcagttttattgaggtaaaaataaaatattttttaaaatgtataggtttaaggtgccccacttgacgttttgatgttgtattagtccattctcacactgctataaaaaatgcctgagactgagtaatttgaaaaaaaatatgtttaattggctcacggttctgcaggctgtacaggaagtgcagtggcttctccttctggggagagtcaggaaagttaggatcatggcagaagacaaaggggagcaggtgtgtcacatggccagagcggaagccacaggaagcggaccggggtgtggggggactgcacactgttagacaactagatcttgtgagaactcaggcactgtagtgagaacagcaccaggagtcggtgctgaaccactcatgaaagacccaccccacgacccagtcatctcccaccaggtcccaccccaggactgaggattataatataacatgagatttggtccaagacacagatccaaaccatatcatatgcacattgtgaaatgctcatcatggttaaggtaatttgtatattcatcttctcactattttttgtttgatttttgagacagagttttgctcttgtcgtccaggctggagttcaatgtcaccatctcagctcactgcaacctccaacccctggattcaagggattctcctgcctcagcttcccgagtagctgggattacaggagctcaacaccacaccccgctatttttttttttttttggtacttttagtaaagacagagtttcgccacgttggccaggctggcctcgaacagctgacctcaagagatctgtccgcctcggcctcccaaagtgctgggattacagatgcaagccacagcgcccagccaattttattattttaaaaatgtactgcatgtgagtgtgtgcgtgtgtgtgtgtttcatgagaacacctaagatctacccttttagcaaaaatcacttttacagtacagtattaaatacaggaaaattggcgtaggttagatctccagaactcattcaccctgcacagctgaaactctgtaccctctgaccaacttcacccaatttccctctcctcccaggtcctgggacccactattctactctctgctttcaagagcttgaatatttcagatcccacacgtaaatgagatcatgcagcatttgtctttctgcatctggcttattccactcagcgtcatgtcctccaggcccatccatgttgcaaaagccagaacttccttcttttcaaagctaaataaaattcagttttatgtgtacacattttctttaaacattctttaatctatggtcattaaactctttcacaaatctacactattataaataatctggcagtgaacatgtgtttaacataataattttatttcatttgaatatataacaagaagtgggatcaccagatcgtacgataactttatttttcaatttattgagtaacaagtcctaccacaccatatcatgatttcctttcccaacattcttgtgaacacttgttatattttgtcttgctgataatagtcattttaagtggtttgaggcaatatttcatcgtgctttagatttgaatttctctgaaaattagtaatgttgggaacctttttaggctctgtttttcatgagtgggttttctgaaaaaaagtctatccaggttttttcccttttatcaggtcgtttgtaatttgcacatagttttttttcctgtgcttttggtattaaattcaaataaatcatttctgaatcaatgacaggaagtttttccatgctgtctatgagtttgtggtttcaggttttgctcatttttagttgatttttgtacatggtgtgagagaaggtctaattttatttcttctgcatatggatgtccagttatacatcatttattgaggagactgtctttcttcactgtgtctttttggcatacaaaatcaggaagagacataattaaaaaagaaaatattagatgaatattcgtgatgaacatagacctaaaagttctcaacaaaatattagcaaatagaatccagaagcactttaaaatgtaacacatcatgatcaagtgggctttaccctgggatgcaaagttcattcaacatccacaaatcaataactgtgattcattgtgtaagcagaataaaagcaaaaaccatatgttatctcaatagatgctgagaaagcttttgatatgctccaacactcactcataataaaaaccctcagcaaactaggcatcaaaaaacatacctcaaaataataagagccatctatgaccaacccacagtcaacattatactgagtgagcaaaagctcaaaccccatgagaattggaacaagacaaggatgccctctcaccactcctattgaacatagcactgaaaatcctagtcagggcaaccaggcaatagcgaaaataaaacgcagccgatatggtttgtactagtgccccattcaaatttcatgtcaaattgtaattcccagggttggggctggggtctggtgaagggtgattctatcatgaggatgggtctccgtctcttgtgctgctctcgtgatggtcctcaggagatctggtttcaaagtatgtgtcatctccctcctctctcttcctcctgctcctgccctgtaagacatgatgcttccctttctgtcatgattgtcatgttcctgaggcccccccaagagccataattcctgtacagcctgcagaaccataagacaattaaaaacctttatacattacacagtctcaggtgtttctttagagtgtgcgaatggactaatacagaatcaaaataggaaaagaagtcaatgtatctgtccaaattgatgatataattctatacctagaaaattctaaagactctgccaaaataattctagaatagataaacaactttggtaaagtgtcgggatacaaaatcaatgtacaaaaatcactagcatttgtgtaccccaactacatccaagctgagagtgaaatcaagaacacaattctatcccacttacaatatccacaaagaaaaggaaatgcctgggaacacagataacaaataagatggaagatccctgcaagatgaatgacaaaacacagcagaaataagtcataaatgacacaaaaaatgggaaaacatttcatgctcatgattggaataatcaatattgtaaaaattgtcatactgccaatagaaatttacagattcaatactattcacataaaactatcaccatcattcttcacagaattagaaaaaaaagtatatatattctaaaagttatatggaaccaaaaagcccctgagtagccaaagcaattctaagcagaaagaaccatgacagaggcaacatgatacctgactttaaactacaccataaagtcacagtaaccaaaacagcttggaagtggtacatgagcagacatgcagaaaaatggaacaagagagaaaacagaaataaacctgcacacataaaccatctgatatttgataaggctgacgaaaacaagcaatggggataaaactctgtattcactaaacggtgctgggataactggattctgtcagatatacagaatgcaaaagtgaaggaggctgggcagcttcgacttagatttcagaggatatgtagagggccctgcaggcccagcaggaggccggctgcagcagtgcagccaccacagacagcctctactaggacagtgccaaagatggggaaagagagggttggagccccaattcacaatccccactagggcattttacactaaagctgtgggaatgtggccacgaccctcaaggtccctgaatggtagaaccaaaggcagcttgcactctcagcctggaaaaacttctggtactcgactctaacctatgaatgcaggccaataagctgtgctcagctataaggatgaaaagcctgaggtttctgggactccttcaacccagggtgccctggttgaagtacatcaagtgaagcgagattattttgtagctttaagatttaatatctgcccagacaggctttaggtgtgtggggggcctattggccattcctttggacatttttttccttttgtattaacaatatttaaccaatatctgtggcagtcttgcatgttggaagtaaataactctttaaaacattttgccagctcatagctggagggaaattgccttaagactcggataagactttggaattttcagttggaggttgaccaagttaagacttttggaaactattaaaaaaaaaagatcattttgcaacctctgaaggacgtaagatcagggggcacaagagtgaaatgatatagtttagatgatggtcccctccaaatctcatggcgaaatgtgctccacaatatttgaggtggggccgactgggagattttgggacatggggaaaaatccttcaggaatggctcaataaccaccctatggcagtaggtgaattattcctgtattaactactgggagatctgattattaaaaggagtctgatgaccctcctcccctctcacgtccacccctcaccatatgacaccgcctgcttcccctttgccttccaccataactgtaagcttcctgaggccctcacaagaagcagatgctggtgccatgctcctcacacagcctgccgaactctaagccaaatgagcctcttttatttgtaaattacttggcctcaggcattaatttagagcaatgcaaaatagactaaaacacactgcccaaagcaatatacagagtcaatgcagtttccatcaaataaccaatataattaagtacattttttttaaatgtcctaaaatttatatggaagcaaaaaagagccttttgattccatataatagcaaaagccgtcctaagacaaggaaacaaagctgaaagccccacattccctgacttcaaattatactacacagttataggaagaaagacagcacggtactggtaccaaaacaaaacaaaaaatattagaccaggtgtgcctgtaatcccagcactttaggtggcagaagctggtggatcacctgaggtcaggagctcaagaccagcctgaccaacatggtgaacccctgtctctagtaaaaatatgaaaaactagccaggcctagtggcccatacctgtaatctcagctacatcggaagctgaggcaggagaatcacttaaacccgggaggtggaggtttcagtgagctgacatcttgccattgcactccagcctgggtgacaagagcaaaactccatctcaaaaaaaaaattaatgtaacagaatagagagcccagaaagaaagccaaatatctacaaccaactattctttgacaaaactgacaaaaatatacactggagaaatagtcctctattcagtaagtcgtgctgggaaaattggatggccactcatagaagaataaaaccaggcttctatctcaccacagacaaaaagtaactgaatatggattcaataattaaatgtataaactgaaactataaaaatacttgaagaaaatgtagggagaattctcgggacattggcctaggcagataaaatatgactaagacttcaaaagcaaatgcaacgaaaacaaaaatagatgaagaggacttagttgaactaaagatcttctgcagagaaaaagaaataatcaacatggtgaacaaacagcctacacaatggtagaaggtatcacttcatctcagttaagaaggctcttatcaaaaaagaaaaaaaacagccaggcgtggtggctcatgcctgtaatcccagcactttgcgaggccgaggcaggtggatcacttgagatcaggagtttaagaccaacttgtccaacatggcaaaaccctatccctcctaaaaatgcaaaaattagctgggcgtgttggccagcacctgtagccccagctactcggtaggttaaggcaagataatcgattgaacctgggagttggaggttgcagtgaggtgagatcacgccactacactccagcctgggtgacaggagtgaaactctgtctcaaaaagaaggaaggaaggaaggaaggaaggaaggaaggaaggaaggaaggaagggagggagggagggagggagggagggagggagggaggaagggaaagaaagaaagaaagaacgaaagaaagaaagaaagaaaaagaaattaagaaagaaaaaaattaagaaagaaaagaaagaaagaaaaagaaggaaagagagaaaaaagaaagagagagagaaaaaaggaaggaaggatggaaggacagaaggagggatagaaggaagaaaaggaaaggagaaagaaagaaaaaagagaaagagataaaaagaaataaagagagaaagaaagaaaactaacaaatgctggtaaggttggggagaaggtaaactagtacagtcagtcactatggagagcagcgtggaggtacctcaaaaaactacaaatacaactaccaaacgacccagcaattccactactgcaaatgtatccaaacgcatgaaaataattatatcagagatttcttactcccagtgtatatggcaggacctttcacaatggccaagatatgaaatcaaaccaggtgtcagagagcagatgaatggttaaagattatgtggtgcatatacatgatgagatgctcatcatccacaggaaaggaaatcctgttgtttttggcaatgaagacggaactggaggacattatgtgaaatgaaataaaccaggaacttcaagtaatacaccttgttttctcactcatacgtggaaggaaaaagaaaatttgtctcatagaaataaatagtagaacagaggatactagagtctgggaagtgcaggggaagagataggcagagatttgtgaaggaatacattagagttaggtgggaggaatagattataatgttctttaccactgtgggataaatgtatttaacaattatatgtagtttcaaacagttagaagaaggatattgagtgttcccaacaaaaagaaaatgtttcagatgacggatatattaattatccttatctgtcccctacacactgtttcacaacatcgctatgtacctcatgaatatttacaatcattatttgtctattaaaattatattagaaaacacaaaattcactggaagtaacataaatggaggctctgggatagacctggagataacggagggtctgggatacattacaggcctagcactcaatggtcagaggagctcccattagctttttgtatttgtagcactgagtaaatctaacatttctcagagcttccctttgcaatagagacgtgaggcctagggagatcttgcagatagtcagatatgcagagggaagaagcaggggtagagggttgctggcccattcaacaatagttggaatgataattacgcatgtagagaagccaacattgatttaaataagttgcatcactgaaagccatgaaaaaaaatccaaaggaaatctttaaataaaattgagagtgaaactgttttgggtgaagaaatgttcactgaagttaggtgtgccagtaaagctgttaagaactacagtaaccactggattggattcagctttgtctgaattcagtgtgattattactggctcaggcaggggtcagaaatcaacatggataggtggtagcaacacgaaaaagccagggaccagaaagattcacagccgaattttttcagatgtataaagaagtgttgctaccaatcctagtgtaactatttcccaaaaatgaggataaaggtctcctccctaaattattccatgaagccagcattattctgataacaaaacctggcagagacttaataaaaaaacatgactttagaccaatatacctgatgcaaaaatgctcaatgaaatactcacaaactgaatacagcagcacatcaaaaagcctaacctaccaacactttgttcctgggatgcaaggttggttcaacatatgcaaatcaggaaatgtgattcatcacataaacagaacgaaaaacaaaaaccatgttaaccggcagggcacggtgactcatgcctgtaatcccagcactttgggaggctgaggcgggcggatcataaggtcaggagctcgagaccatcctggttaacatggtgaaaccccgtctctactaaaaatacaaaaaaattagctgggcatggtggcgggctcctgtagtcccagctactcgggaggttgaggcaggagaatggcgtgagtccaggaggtggagcttgcagtgagccgagatcacgccactgcagttcagcctgggcgacagagtgagactctgtctcaaaaaaaaaaaaaaaaaagaaagaaaacgttaaccatagacacagaaaaggttttgaaaaaactttaagattctttcatgttaaaaaccatcaaccaggcatgaaggaatacaccacaaaatataagggccatctatgacaaactcacagccaacattatactgactgagcaaaacctggaagcattttcccctgaaaactagaacaagaaaaggacacccattctaaccactcctgttcatcattgtcatggaagtcccagccagagcatgcaggcaagagaaagaaataaaaagcatcaagtcaggaagagagggtgtcaaactatccctgcagatgaaatgatcacattcctgagtctgtagtttggtgactgacattaatttaaaatattgtcagtcatcattgtttaaatatttcttcttagcctttctctatttttttctatttcccattatgtgcatgttatacctctgtcactgtctcaccattcttgggtaagctgttcttcttttgtatatatgtgtgtgtgtgtatatatatatatgtatatatgtgtgtatatatgtatatatatatgtatatatatgtgtgtatatatgtatatatgtgtatatatgtatatatgtgtatatatgtgtgtgtgtgtgtctgtgtgtgtgtatatttgtatttgtgtgtttactgttctaacaatatattttttgtttttgcttttcagtttgggaaatttctattgagatagttttaagttcagatttttgtccgcagctatgccccatctacatataagtccattgaaagcattacttaattctgttacaaaattcttgatatctacttttttttccttttttggaatttgcttcattctacttgcatgacacagctgttccagcatgctgtctgcttaattcattacagaccttagcatattaatcacagtggtcttaaattctttgtttggtaattccaaactaaatggcatggctgaatctcattttgatgcttgttttgtcttgtcacactatgatatatttcttttagtatatatcatgatttttatagggagaaattatgtatcaggtgaaagaaactgctgtaaagaggcctttagtgatatcattgtaagttgtggagagaaacctgtttcataatcctctggccatggcttcatctaggaagcttaaggcctttgaaaataaatccttacatgaacgtgaaaagataagccacagatatggagaatttcctcacaaatcaaatatttggaaaaggacttttatcaggaataataaaaattaccttacagttgaatgacaaaaccacatgatctaattttaaaatagacaaagacctgtatagaaagaagcctcatctaaaaataaatataaaaagtgatcagcatgatttttaggtatatgtatgtttaatattcaaaaaatactatatcctgttagaatgggtaaaatacacattttagacagtaccaaatggtgatgaggaagttgaaaaacaggaacattcactccttgtgggtgggaaggggatgctgaagaggcacatacacaactacagttagtactttattgtatatttcagaatagctagaagataagatttagaatgttcttaacacaaagaagtaatcagtgatggaggtgagggatatcccaggtatctggatttgatcattgcagataacatgcttttatcaaaatatcatgcgtatcccttaaaggttttgaactgttatgtatctatataaattaaacatttttaaaaaaacggtgcaggggaatccagctaattgcagattcccattagatgggatgtgctgcataatctgtaaactaatcagagtctgtgggtttgtaaaggactttagaaatcaactggactacttgtttctaaagataagtctcgcaagtttaattattttcttaatgggtggcgattttgaacatagaagaaatgttaacagttgtttctcaagttttcttctagtttcagaagaaaaggtttgcagggaggaatctgggaccatctttcaagtctcaacttcaatgtgattatctcagtaaatattttctgatacccctgagcagggtaagtctcatatatgtcctagaaactgcaagtagaattctaggcaccccaactgactgaagggaacttttctcttcaacgaggagttccatggacactagaaaacctagtttaggccgtgtcagaaatggaggatcagaaatccctcattataccctcctccctttggaattcaagcacaagtaaccagcattttccttaaaacagatttaaggctcagaaaacagattccgtgtagcagtaaaacaccaaattctaacctgactcaagaatagcatcacatgacagagaaaaggccttggaaggaatcaaagtcttttaccctaaaatatatgtctttgacatatttttaaatcaccctgcacagttatctttttgcaagagaaatttacattctgtagagaatcgcttccctttgaaggtgtttgtgttatactgaggtatcgggggaaattcagccagatactgggagaaattcacccccgatatttcacgtagattcttttctattttccttaagtgtcagccggtctgagaaataaagggacaaagtacaaaagagagaaattttaaagctgggtgtctgggggagacatcacagttcggcaggttctgtgatgccccctgagccgcaaaaccagcaggtttttattagtgattttcaaaaggggagggagtgtacgaatagggtgtgggtcacagagatcactgcttcacaaggtaatagaatatcacaaggccaatggaggcagggcgagatcacaggaccacaggaccagggcgagattaaaattgctaatgaagtttcaggcacgcattgtcatcgataacatcttatcaggagacagggtttgagagcagacaaccggtctgaccaaaatttattaggcgggaatttcctcgtcctaataagcctgggagcgctacgggagactggggcttatttcatccccccgctgcgaccgtaaaggacagccgccccccgaagcggccattttagaggcgtttagagcgtttctgtcttctctcccagtttctacgagttcctccagtgcctgtaacacagagctgttagtggctttgcccctgcctgttaattctttggtcatgtaatggtggtgagggagctgggtctggatgcatttcagccacagctgctgttccacttccccacacagaaccatctcgggaggaagaggttggagatttttctgatgtgtcctcaatcctggcagaaaaggtttcaatagcaataggattccctcagttgtatgtcctctgataatttaaacaataacttctttattatactcaactctaaacggtctaaagagtatgtctaagttaaccctgcattcgcttatatgacatttgctctaccccagataaggtcatattctctttctgtttgttcctgcaagtcactgactttcacaagatgtaaggtcccttgtttgtcctataacatcaataatctgatgttttaaagaaaatatgctaatttgcagctcagtaagtttagttgtaaaaataatacatttttttctgagatgcctacatctccatgctgagttggagctttatttgtaacactcagaaactggaaataacaaaaatattaaggagctttataaatagtacgggcacactcattaactggaattctgttcctcattacaaggaacatattctttatacacaaccaaactactgactcacaagtaattgtgctgagcaagaagccacacaaatgaaatggaaactgtaaggtttcactttaaccaaattttgaaaaatagacctgaagtagcaaacatgagagactgactcagtgtagtgagcggaaaatgactgggaggcaggaattagaggaaactagggaaaccttgaagtgtaattcattgttatcttgattgttattttggatgcacaggtaagcacatgtgaaactgcattttttcctttggagacatggtcttgctttgtcatccaggctggagctcagtggtgagatcatagctctctgcagcctcagaccctgcgtctccaccaatcttcctccctctgccatacgtagctgggactactggtatgtaagacaatacttggcttcagtgcttattaaaatgcacactttaattaagcagtatttgttatacagcaatcatgcctcaataagagtattgcaaataagtggatagataatttgttcaataaagattgatggaaagatagatgctaacatgagaaaatgcatgacacccaagaaaataacactgtaggaaacatgcttttctttacaattgttaggtaatcacaacagagcatacacatcacaccatgttctcgttacagagaaaaggttctgcaaacctcactagctgcaacccctgtgtgctgggcttggttcagggagaagtcaggtccagtggtgagaagcacaggcccagataaccaagctcactctgaccgaatgtgagccctgggtacattgtacaacccatctgtgcttctgctggtaatttttcatctgtaacatggaaatgacattgatactatataccatgtttcctctgcatatgtaaaaataaaaggtgattggtgctaactttaaatatacacagtttatgtacattgattgcacctcaatacaacagttttaaatagatattacaacattataagttttataggtttaatattttatcacagaacaaactttcaataagaaaccacaatttccaaatgctatcaatatcacaaatctcccccaggacactctcacatgctctgagccccactctctcctcaggcgtcccatcccagagcttggcatgtagtaggagacatgcaaatagagccctccctcggcttatgaaaaccagcccagccctgaccctgcagcactggaagaggagccccagccctgggattttcaggtgttttcatttggtgatcaggactgaacacagaggactcaccatggagtcatggctgagctgggtttttcttgccgctattttaaaaggtaattcattgagaactattgaaattgagtgtgagtggataagagtgagagaaacagtggatttgtgtggcagtttctgaccagggtttctttttgtttgcaggtgtccagtgtgaggtgcagctggtggagtccgggggaggcttggtccagcctggggggtccctgagactctcctgtgcagcctctggattcaccttcagtgactactacatgagctgggtccgccaggctcccgggaaggggctggagtgggtaggtttcattagaaacaaagctaatggtgggacaacagaatagaccacgtctgtgaaaggcagattcacaatctcaagagatgattccaaaagcatcacctatctgcaaatgaacagcctgagagccgaggacacggccgtgtattactgtgcgagagacacagtgaggggaagtcagtgtgagcccggacacaaacctccctgcaggggtccccaggaccaccagggggcgccagggacactgtgcacggggctgtctccagggcaggtgcaggtgctgctgagggctggcttcctgtgatggtctggggctgcctcattgtcaaatttccccagggaacttctccagatttacaatcctgtactaacatttcatgtctctaaatgcaaaacttttttgttctttctgtatttttgtttttgtaacaggaggacacattctcgcctccacagaagccacagtgtcactttgggggcagatgatccttctgtagtcagcaggatgaaagtgcagaggaatctcagtggaacctgggaagtcttttccagttagactcagggcagagacctccatgggaatctctgattagaacaggctttgagttctgataggagccaagagagaggctcacccagggtcagagtccttaaaacctgacggttttcacagctatctcacctcgtcttgaaaaactgtgcacatctgactcacactaattcagttgaccttatttctgctaatctattttccttctctgcagacttgattctcacagttccctttcttcttctcttgcctgaaaacagaggatgtgttttctgtagtcaaaatcccagagatcaggtctgcaggacctgggtaggctgaggggactttctcactcaccatagcctggtgacactcctgctgtattttgtatgtggaggtgtttggaaaacgaagtgaacattagtcatgaagggaataatactagttttctccaaagggatgtggatgtagagctgatcttgtgcttctcacactgtcacagaatttatgctctcccctgtgactttaggagagctgaggatggacactccattgtgctgtgagctctggtaatagtaattatagggtctcgctaggcagcctaaggtcaatactgctggccttcgggaaaggcaggctgggattcctaggaaaacctgcatctgccatccagcatggagtcccatcgtcttctgttatgctctgattgaatcaggcacacctaggttatctagaacactcttcgtgacttgggaaaaattagtggcaggctctactaagacctgcattatgccatgggagcaacacctaggctagtgtgtgattgagtaggtgagactatggtctagtcaaggtgacagggaaaattgttgccattattatgttttattttatatttggcaatatagtcatgctcatattacaaatatctttctacattttttgtgtcagaagcttttgaacaagagcaacttcatcttgaatagaggctaggaaaaataagactgagacctgctgggctacattcccagtaagttaaggcgttcttagtcacagggatgagataggaggtctgcacacgatccaggttataaagaccttgctggtaaaggttacagtaaagaagctggccacagcccaccaaaaccaggatggcaaaaaagtgatctctgttcgtcctcactgctcattataatgccttaacatgctgaaagccactcccctcagcgccatgacggtttacacatgccatggcaacatcaggaaggttccctagatggtgtacaaaggaggggaggacacctcagcttcgggaattgcccagggactcatgaataatccatccgttgtgagaaatacattcatccctttgagagaaaatgcacagggggtggaatgaggctgggaagccgatggcacatggtggaagcctgtccctgagtgaaagagagggggaagctggattgggtggaaggtccctatatttctgtgctgtgcaagggaggggcaaaatataattgagtctcttgtaagtcagtgtttcctctcaggggatccccatgactcccagaaataatggctctgcttaggaatccctgcagagtcactcctttcattagagtagaccacaggacatgggcctcagcacacgccatgccacagatgtcagaaagcagctgctgggaacctgacccacctgcattttgctgcctgtaggaggaggaggacgtgcattctcagggccaacacactgtttttggatttttatagagaacacctgcttttactttattttttggaaaaatatatgaacaaatgtgcacctgcaaacaattgtaattttcacatttattttaattgcatttgtttataattgtgcatgaggtcctggtgcagagttgagtttttcatgggaattgttccaagaatcaagaacatccattttccactttcactggtttttccccatgtgcagagaccttgagtagagcacatctggcccttatccacactatctcttgtgtccccgggaaagacagggatttgcctgactgcagaatctagggtaggagtctgcacacgtctgagcctgcagagaagcccagtgaagtttaatgaagtcagagagctttcccgtgtggggaacctctagcttcctcactctcagagattgctggtcagctgtaattgaggggttaagaattagagcacctgggagcctgtctcatcacagctccattctgtaacttaccaccatcagactgcaggtaataactcaatcttgatttttctgaccccatcttattcatttgtaagtttggttatacaaaatgttacattttagtttctgattcaaacctcagaattttgtgaattcatcaggaataattaaaaatgtgtccagtttttgggaaatgtaaattaatgtccatactgtttatgtgtgtgtgcgtgtgtgtgtggggggatatgtcagtcacttacaccccagtaaaaatgattccttaattatatagtcgaactgcaattagatttgctgaaaattgtctacagtaatttctgtgaagctgaccttgccaccttgctgtgaggatgctcagtgcacaggtgaggtctcacaggagagatccaaggttcagcccccaggactggctgagctcctggcttggagccagacataggactgggcatctcagaagcagatcccctggccctcctttatctgggctgtatgggcagcagaggacaagcagaagaaactcagaattcagccaagacagagccccatttaggagcaggtgcatcaaggaaccagccagagaacctctgactacaatctagggttgtcttcttttgcttcacagcatccagtcctaaggagaccacccactatatcatctgtaactcagaactttcttgttacaaaggaaaacacaaatgaatataactctgcagttaacttcttgaacctggattgatgagtttccacggccttatgagcacagagaccacatccagtgcaggtgcagagcaaggctgcaacagtcagcctgctgctccctcaggagtcttccaattcccttgtccaaagcatccgctcattcatgggctgagaaaagggaagtcattcatgcagtctactctctccacagaactgacggggcacaaggacaacatcgatttttcatggaacatgcctctaggaatgcagctgtgtgcacacacactgctaagcacacacttctttacataattacttgtaactgtattttcttatttattctctccaatttttttacacaaattcatcacttttccccataatcaaagaggattttgatcagaatgcttgtggggagccccttgccccccagatgcccaccatcattattcttgaagggaggaggaacggcagctctcttgatttctactctaatcctctaggactaaaaccagaaggttgcatgtccggtgcgggagcatcgaagaagatcctgtctgtagaagcaggagcgtcaagacttgactgagagccatggtgctgaaatgagatagattccctgatggagagcacacgtggacccccacacctgagggctcactgctcctcaccacagatgcactcccctactgagtcctgagacctgagtgcaccccatagagtagggctcagatgaggggatgcaaatctccaccagctccaccctcccctgggttcaaaagacgaggacagggcctcgctcagtgaatcctgctctccaccatggacatactttgttccacgctcctgctactgactgtcccgtcctgtgagtgctgtggtcaggtagtacttcagaagcaaaaaatctattctctcctttgtgggcttcatcttcttatgtcttctccacaggggtcttatcccaggtcaccttgagggagtctggtcctgcgctggtgaaacccacacagaccctcacactgacctgcaccttctctgggttctcactcagcactagtggaatgtgtgtgagctggatccgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattattgtgcacggataccacagagacacagcccagggcgcttcctgtacaagaacccaggtgtttttcagtggtgctccctccccacttctgcagaacaggatagtgtggctgagatgccatttcctgcccagggcgtgcgtttcccatccccatctgactcagagccttgttttcctcctttttctttactaataaatggcatgtcccctgttagtggttcatgcaagcagaagctgtatcctgtttgacaaagattcagcatgaaaggtcctgctacctaaaaaaaaatagacagatgagatttaattaacctaaataatttttttcacaacaacagagtgaatacgcaatttacagaatgacagaaaacttttgcacactttgcctgtgacagggaactaatatgaagaatttgcaaggaactcaaacaactctacaacaacaacagcaacaagaaccaaataactccgttaaaatgagcaaaggacatgagtagacattttcaaaagaacacatagaaatggataataaatatataaacaatactcaacatcactaaccatcagggaaatgcaaattaaaaccacaataagatatcatcttccaccagtcacaatgactattactaaaaactcaaataatatcagatgttgctgaggatgggaaatgaaggcaactcttagacattgttgatgaggatgtagatgagtacaacctctgtggaaaatggtatggagatttcccagaaaactagaaatagaactgtcatttggtccagcaatcccactactgggtaactacccaaaggaaaataaactattatttcaaaaagatacccaccttctatgcttaccataaaactactctcaatagcacatatgtcaaactgagtgtctgccaaccgatgattttataaaagaatatagcatgtatgcacaattcaatactagtcagccacaataaggaatgaaactgtgtcttttgcagcaagatgcatagaagtgggggacaatataattagtgaactaactcacaaacagaatgtcacatgtcacacattattacttgtaagtgggaggtaaacagcgtgtacacaaggatttgtagagagaaattacacacattggagacttacaaggatgggcgggcagaaggtgggagcatgatgagtcattacataacaggcacaatataaaataattaagaattgaccaatgatcttaaaattaaaatgtagaatatgatcaataaatgaacttgatattagttgacctcattaaatttaaaaactttttctactcaaatgactgtaagaaaatgaatgcccggttacagatgagaaactgtttgcgagtcaaataaccaccaatgtaactataataagaaacttcagaactcaactgtgaataaaaaagaaacaactgatggataaattaggcaagggtttctacagacatttcgtcaaagaagatgtgcagatgacactgaagcatataaacaggatctcaacaggattttccgttagagaaattcaaatcaagcccgcaaagagacaccactgtacactttttaaaatggctgaaattaagaagaaatacagataacatcaatgctggtgagcataccaggttgctagaggctaaaacattgctaacaggaatgcaaaatgaaacagatactcaggaaaataatttttagttttctctaaaatcaaacatacccttaacacctgaatatttgcatcagagaaaaacaatcttacattcacgcataacttctattcaaatattcaagatatcgtgtgtatgtgtgttagaaagtaaaaataacataaatgtctcaaaatttgaataggtgaagaactaggaagcatctataaattgaataccaccagcaataaaaaaataacaagtgaccgatacataaactattacaggtgaactccagacattgtgctaagtgagagaagccagtctcaaagatcaaagggacacagctgtaagcaccacggtcatcctcaggtgtcagtggtttgggctggactttctgtgtctctttcctgaccagacccagatattgagctccaccacttgcagatggaaaatcctattttcaaccatgcagtgaggtttgaactgcttcacagactgaacgaaacaaacacgggctcctttgaacagcgtccggcatttgttccaaccacaagagaacgtccctcagctctcccacctcctcggttctctcctgcaagccagcagccctgcagtttagcctgcatctcccgtgcatccacccatctccctccaagcaccttcccccacaccctccactgtttctgagagcacaggcaggctttgaacttttccgcattctgttgttattgaagttaggatgtttaggaccaacttaaggatcatattttatgactgaattccagtgccccttctctcctgggacagagtgcataaccaagtttctgcaggtggagacgaagttgagcttttttcttcctcagcctaggagatgagcgctaattggagggttggcagaagcttcccaccatcccagcactttggttctggtggggcggaatcggtgccatagggcagagctagaaaccgcggactgaatgttcccagtggcactggacccagggcagagcctccatccacgagtggggctctatggaagaagtgagtctctggctctcagtagctctcgtccagcactgaacctcagcatcatgtgctgtgtgcagggtcagagggccaacgtactggcccctgggaaagcgtttcctctggtgggagttggtagaaggtgtcctgtcttcttggctgcatctgtccgcagtggagtttacatcatgctgagctgggatgtggaaggaaggaagagcatcttagatcaaatatgatgactggccttactgagttttctagattttcctgaataaatgtttcttcactcactgtgtgctgttagagtctttccaaacctgtaatttcccaaaataattttcactggtctcatgagggcatggattcattgagcccctcatgctgtcaaagagaaatagaactgtttttttttttcacttcatagcgaacatccatgggttatcaaataatgggctggcttttcttccaacactttacagacaccatcaattttcttcttgcttataaggttttaaccagaagaatgctgtcatggtcttttctgttcttttggaaggaatgccccctctactcacctccacttgtctgcctgtatttctatttgtctttggttttcaacaattttaataagatttacctaaatgtgtgtggggggagcatggggtgttattctgctgttctgtgttctctgagatgcatggattcaccatttactctgtctccatttttgtgaaaacaattagaaaaaaagtcagtatgagcccagaaacaagcctccctgaagtgggcacaggaccacctgggggcgctcaggacccactgaacacaagagccagccccagggcaggtgcagatgcgggttaagttctggtttcctgtcaaccctgtggcttcctctccataaaacagtttcctttgtggcatatctctggattccttatcctgttcttcctgtgaagtctctgaagaagaaacatttgtcgtaacaagagaaaaactttctcacatgcaccaaaggcagagtcacctacagtcacttactcctgtttctcaatgtcaataagttaccaatgcttctgaagttaatcagctaaatctataaaaggtgcggtgtttaactcagcattacagcccagctcaacagaactccaaaggtcagccagcagcagccaggaaaaagtgcatgctgggcattggggcagagggagttaccatccagtgcaagagaagaaagcccccgtggtggtcattgtcaggactccaatcccacagttccaattgtaggtgatgccaggcaaaggaagagagaccccaccaatggttagtgtggatgtcgagtttgatgtttccacactcacactccaggtgaatatgaaaagatttattagctctatttctgaggtgtctgctgagagcagcacagtcctctcaagaaattacagattggaatttcctcagtagagcaggaaaggaggctggctcagggctttataatgatttggtggtggggtcggcgggggggggggggcgtttctactcaggagaaggagcttgtgtgatttaaacctcacactgacatcacatgagggagcttccatgatttcttactagatttcccatgtgtgggggacaaggatgagggagaataaaccttaattcatcagcatcaaggcaccaaaaataggacctgacactttattctccctagcagcttaagaaaatgagtgaaaaagagagataagagtccacccatgtgctgaaaagcatagctcttggtaaagacgagaaaaaggcactcctacgaagaaggggttgggcagaagctttatgctgaagggtttggctaaagagacataatcaacaggttacaggaggggctactgatgttcatggaggtggtcctcacacatgcatactgaacaaacatgtctgtaacgtatgacccctgttcacttaccagtggagacttagcatttaaattcattccagtcaggccctatgtgcaaacagcagaagcagagacacaaaggtactcagggtgcagcctctgtgaacggccagagccaggccatggtcagcggtctcggattaggagaaagttcctgatatcactgtagtgttcaatcaaagctggggttatggtttgtggaacaggggtcagttcatcagggggtgggctgcaattgtcttcatagtgcttgtctcagtgccggtgcttactgagccactagagaaaaaggtttaattgagcttctttaaaatcaacattttgaattatttatcagacgtttcaaatatgtcatgttgtttagattctattgctggagagttaaggtgatatttggggttttgtaactctgttttttcatacttcctgaattgcttatctgtttgcttttcattagctaaactatcgcttcttcttattttttaattcattctgattttgatgaatatttaattccctttagaatgtgaatataatgtacattgtgtgggtattttgattttggttcttggtttacttagtggcaaagactctgtaagagttccttgtctatagatagccattatttagtggctttctgaaatggtggttttagtaccaaagtactggacttgtgagtaggctcactgccccctgcaggtcctagatagtggaggcctcaggaactgtttctcatttggaatgcctttgtttcagcagattttgtgttgggttgttaagttcaccctccacattagtagatgtccttacagattagagctgactctggtagaagcagttgagtgcatgcttgatatctgtgcacagggagaagctctctgttgcctcaggcgatggactggtctatgaaatgcacagtgacctgagttccctgctcagcccctgagaggtggaccaagctggacacacatgagccaccgagcctggcaagcaaaagcgccagccttgatggaaatggcgagctgagcggcatctactcagtgtggtttcttttgttattaagagctttagtgtggtggctgtttcaaattcccgttgtagtagtaatatactgggtatgtgagcaggcccgtggtcttttgcggggttggaatcaccgaagtaatgagaagctaatctcattttcaactgctgtacactggtggtattgagtttgtatgaggtcatgcagtttgaacgtcaggccagtaggtggtgctcgcaggtaagagccggctatggtggcagcagaagggtttatgctttactggtgattaaagtgggaaacttggcgtgttccagatcttagagaaaagatttttagttatttctcattcaacctgatactacctgaaagtctctcgaatgtaacttttattttgtcgagatgggttctttctatacccattttttatgttttttttgtgaaaggatgttgtttcatcaaatgcgttttcagcatcaattgaaaaaagttatatgtggattaaagatcaaaatgtaaaacctaacactataaaacctctggataataacataggaaacagaatttaggaggtaagaactgacaaaggttttataatgaaaatgctagaagtagttgcaacaaaattgaaaattgacaaatgggacctaagtaaattaaagaacttctgtacagcaaaagacactatcgacagagtaaacaggcaacctacagaatgggaaataaaatatttgcagcctatacatctgacaaaggtccgacacttagtatatacatggaaatttaacaaacatacaagaaataaaaagtgaccaaaggacatgaaaagacacttcaaaaaagacctacatgtggccaacaagcataggaaaaaatgctgaatatcactatcattagagaaatacatatcaaaacctcaatgaggtaccgtctcacatcagtcaggatggctaatcttaaaaaaaaaataacagatttttaaggttacagaaaaaaggggaaatttatacacttttggcgggaatataaatgagttcaaccattgtggaaagcagtgtggtgatccctccaataacctaaaacagaagtttcatttgacccaacaatcctacaactggacatatacctaaaggaatataaacatgtaggttcactgcagcactatccacaatagcatagacatggaatttacctaaatccccatcactggcagaatgatagagaaaaatgtggtacatacaaccatggaatactatgcagctaaggaaagaatgaaactatgtcctttgtaggaacatgatggaactggcagtcaatactcttagaaaactaattcaggaacagaaaaccagatattatatattctcccttatttgttggagataaataaaagcaaatattcttccagggcctgagtcttccttattcaacaagtcattctaaattaagtgttcagcaagttgctgatactcatctaaatattctatttcatctgggccacttacatcactcaaaaagcaatgagagctatatttctaaggggggttctaggataataaatacctgaatagtgagaatatgaaggatatggaaactgggccacttatatcactcaaaaaggaatgagagctatatttataaggggggttctaggataataaatacctgaatagtgagaatatgaaggatatggaaactgggccacttatatcactcaaaaagcaatgaaagctatatttacaaggggggttctaggataataaatatctgaatagtgagaatatgaaggatatggatggtttttttttaactcaatgggcacataactgtgggagatactatattcctatgaagaaggtattcagacttcagagataagtaatgtttcctacattgtgcttgtgacttggaagcagtggattgaagagtgtgataagtgcccagaccaagcagaacagaaatcagcatgtaaagatgatgatctatggatatgatctaaaaccatgtaaatacttcaaataattctatttaatgcagtttgaaataaaacacaaacttattcaaaatacaaattacttggtaattattttgggagctatgagttcaccaagaaactcaaattcctatttctatttcaacccctgattcctactgtcaatgggagggaagtctcagaaccaatcacacatcagacggcaaatctgtcaaccaagagtctttccactgaaggacctgggaggtcaggaccctcaggaaagtgctggggaccctgtcttgggagtgcccagcagatctcagaactctccatgggtcctgctggacactcatgtagggtaacgagtggccaccttttcagtgttaccagtgagctctgagtgttcctaatgggaccaggatgggtctaggtgcctgctcaatgtcagagacagcaatggtcccacaaaaaacccaggtaatctttaggccaataaaatgtgggttcacagtgaggagtgcatcctggggttggggtttgttctgcagcgggaagagcgctgtgcacagaaagcttagaaatggggcaagagatgcttttcctcaggcaggatttagggcttggtctctcagcatcccacacttgtacagctgatgtggcatctgtgttttctttctcatcctagatcaggctttgagctgtgaaataccctgcctcatgcatatgcaaataacctgaggtcttctgagataaatatagatatattggtgccctgagagcatcacataacaaccacattcctcctctgaagaagcccctgggagcacagctcatcaccatggactggacctggaggttcctctttgtggtggcagcagctacaggtaaggggcttcctagtcctaaggctgaggaagggatcctggtttagttaaagaggattttattcacccctgtgtcctctccacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagacacagtgtgaaaacccacatcctgagagtgtcagaaaccctgagggagaaggcagctgtgccgggctgaggagatgacaggggttattaggtttaaggctgtttacaaaatgggttatatatttgagaaaaaaagaacagtagaaacaagtacatactctaattttaagataaatattccattcaagagtcgtaatataagccaaattcacagagtggaaaaggccacactctataacgttgatacaaacattccatgaaggtgctactgtgaacaagttttcaaattggatgaatacatgatttggagcaaggttatttgatcatgtggtgagactaagaatgattcttaaaaagtgccaaaagtttccttcaaatgtttctgtcactccttatcataaagtttattttacagcagttttaggattacaaagaaattgcacaggaggcgtgagaattcccatgactccctgccctacacaggcacagcctcctccactacgaccatcctgcaccgcagtcacaaatcagttacaatggaggaatctccaaggacgcttggttctttctttttctggtgatctcctaatataacaagcctaagtatctcaagattccacggttttttcagtgttttctagaactgatattagtcagagggaaagtgggtaaggctattactatttgaactctttcttccaaaatccacaaaatatatattaatttagagcttatcttacttctggtttacaatgctccttcccagagagtaagatttttaagcttttagaggccagttcatgtctctaaaagaccagaaagttctggggaatcccataatgaacatcctttcattggaattggagaccctggcaatgagagattccatgtataatgccctagagttggattaggtgcactgtgagctcttgggtggtgagtctgagtaaggtggtttgtgcagcaaatgcaaacacattcatgggacccaggtaggaacaaaagcttccctctgcaaagggagtgtgcacctgaagcagccctcacagaggtgggcactgcttgcccttgatgagtgcacattagccagaggcatgatcatgattggtcttgcagataaagagcaccactgaggtcataggttatgaaaatgtttgtcatcctccagctgagcaagtccatctgcttgtttgtgggtgtcaactccatagagggtgcactttgggagatgacaagatgcgcacaaacctgctctcactaattatccactaccacacactcaagaccaacctgtgctccggaaaggaatacgtgcctgtggaaatagacagagcttaagtattttgtaacctggtgaacatactgcccaaagccacacgtttcaggaagattagctcagaaatgttcaccaattgactgaagggcagtggcgggtgaggtgatgggacagcctcagggctgcacatgaggagggctccctcccccatgcaggcttttcctccaggagctgcatcaggacctcaaggaagatcagggagaattctgagaacacccttctgtggagctgcctagagaagaagaataaatatgaaaaaatacaactctgagtaatgcatggatatttgttcatgaaaactctctctgaaagcttgtgaaggtctcgaaatacccctgattagctgaagacaaacatttaaaccctccttccacagggagttcaagcaggctggatgtgtccttctatggatgatcttccccaaccccttcctcttcccagctcatccctggctctctgtgtaaacagttctcatcagtggaatgtggttgatgaagtgacgtcttcaatttcctcatcttcttggtggtcatgttattttttttcatctgagggttaaaaactcacctgcatgcagcacatgacaggctaaaatctcttgtggacaaaacggtaacaaaggcacccaccagggttgagcatccgtgttgctgacaacgaccaccaggggtcaacgtcctcttcacaatcctgtgtcagagcatcactggaatgatttcattagcaacttcccaggagaatcagcttaaaaaatacttgtcccattttccatgcagatataacccatcccttttcctgaagaaacagagctcaatactaaatacactgaatgttgtttttgctggttttgtaagtttgtgactttatcactttctaatttctgagttaggtggaccactctacatatttctctcatgggtgtgaccagccttctggatgtcaaatataactgactttgttcgtgtaaatgtcaacacaagctcttcatggtttcggtgctcactgactactctaaacttacacaatgtgtttctttattagctttgttttctggtatctctacgtggcttattcatcacgcccattttatgttacttgtacaggtaattgattgttatttttaaaatttactattgcttactttaattaaataagtaggcaatagcttagaatagaaaataaggtaaagtaaaagtacatgcagtaatatttaatataagtaagcaggcagctgaaagcaagggaaatctactctgctgtgtaaaagggtatggagacctcacagtatgatgatcttctgcagtttaatccatactgctacataagtgacaacgtccactctgtttatatcagagcttcccctaatatgtacaatgaagactgagcccaggtacctccaaccagaatggccagcaccttttaccaagtgcctgaactgacagcaatagagatcacgtttgtctaaaaaaaaactcacactgtaaggatacccaccagtcatatggagacaattagaaaaaattaaagcccaagcctgataggtagtaatttgtacttagaagaattaacttttatctccacatgttttttttttaatcatagagaaactactagtggtagttccactgtccaagttactgaatatcttattcctagaatgagacactgcacaatgtgttctgacacgacagaacgtagctgtagttaagggacaggagatgtgatcacgggaacacgagtctgcgatccagcagttcttgctccttcacatttgcccagaaacaaagaccccagcagaacaatggaagcattgacttaggtctccacagtctgatgtgagataaacagcaggtagtttatgcctctgttttatagcaggaaatttaatctctaaagaagggccattttggagataatactattctccaggatgcttaaatgcccccaaacagagagcactgcagagccccgtggccaggagctacaacacctgggtctggaaaccactggacagaaatatgagattctcttaccacatgtatgatggaaccttgaagaatgtttccttccttctccataatcacagcctgcgatgaactggaggtcccagtacataaaaaaacatgtgtctgcattggatacagaattagtcccataaaataattgtgctactgtggtgctcacactgttggaccagctgaccaagaaagtgttgtaagagctgcagtgtctactgattcctaccatatttggggctacattcacatctatcaagggaaagagagataagaaaatctctctaggccgggcgcggtggctcacgcctgtaatcccagcactttgcggggccaaggtgggcggatcacgaggtcaggagatccggaccatcctggccaacatggtgaaacctccatctctcctaaaaatacaaaaaattagctgggcgtggtggtgggcgcctgtagtcccagctactcgggaggctgaggcaggagaatggcatgaacctgggaggcgtagcttgcagtgagccgagattgtgccacttcaactccagcctgggggacagagctagactccataaaagaaagaaagaagaaagaaagaaagagagagagagagaaagaaaaataaagaaagaaagaaagaaagaagaaagaaagaaagagaaagaaagaaagaaagaaagaaagaaagaaagaaagaaagaaagaaagaaagaaagaaagaaaggaagaaagaaagagaaagaaagaaagaaaaaggaaatctggcctagtctattgatttattttcatttcttcaaaatgaggtaaaaaaatcgcatcaactaaaatgcggacgatgatgaagtgatcaaagacaacagccactcagtgtttcaggtgtgttttaacccaaagtcacacaacatgtgagaagctgaactccggagccaggggcatctctgaggagaatgtggaaggtgggcgggaggaaacagtgattcatgtctagggaaatttcagggctgcctgctctaggggaaaggaaagcctgagcctctcccacagtgtgctctgttaaaaattttggctgacttattgtattcttcgacacaaatatttttgtttcgtcctcttttaaatttttttatctctattaaaattctcactttgttcttgcatgctgccactagcttattaaacatgtttctaatatttacttcaaattttctgccaggacatccatatgtttttttattcattgatgccagattctggacctctatgttgtctgtctgtttggaccatgttcccgtgtttcttcattttccttgacggtctttcttgctatccgttcatcataacaaacagctctttgctcatcataacaaagagccacactcttccaagcctaggctcatagagacaaccctcaccaatcactccatcagtgattgcggatctctcaaaacttcataatgacttcataatattccaacttctgtctctgttcttagtggcccccaggtttagagaacgttgggttgtgccaggactcccaaataggagaggtagaaactatatactcaagtagcctcttgaacagtgtaccattagacacagttttattattgaggtatgattcatcaaaataatgttagttcaagcgcctctcaaccagtcatctaacattgaaatgttataatttcttatttggatctctctggagtttatcttttgaatatttaggtaaaattacaaactagtataaagctatttggcaaaattatctgctgcagaagtttcatcttctgtgtatctctttttgcacttaaatatgtttttattagtcatgtatccagaatatagaaatatgtcttaaagttccttcatttttttaaggttatggggttttcagaagaggtgagaaccttctttatttataaaatacctgattccacattgctggatagtttcttctttaatttgtctcctcctctcacattatactatattaagcaaggagaaatcaaaacacaccatccacactttgcttagaaatccccaaagctaaattttaagtatcacttactaattctaattttacccattgtaacttaattaacatgaaatctataacaaggttacacatactttcccgttctaataccatgttcgtgacagaaacaaagcaggtgtcttctctgcaatgtggtcatctgaggtctgagatgaggggtcacacaggtattttataatatttaagggtttggacaacagtagtgataacaattctgaacagcactggctcctaattgaaaggttataggtaaatttaatgctgcaattttatattaacaccttgtccgaatgaagctcagaggaagatgccacatcccaggtcacacagtgaggaggaatggagctgtgctctgctctccacaccacctacaaatcccaggccccagcccaggttccactggcgcacggcacctagagcacagttcccaggggatgatctcagggcacctgcttcctcgggcagggcgctgccttctctcagttgtgcacttgctcctcctgcaggttctgtagtgagcacttgcattgccgtgatttatacatgttctctcccctaatatggaaaaaatatttattaaattttcaactcattttctctgatgcacactgcattagcagaaaggaataaatcacattccttatcctcccataaagccaaagattcccgaagacagagctgatgtgatgtactcataggtggatctctgcccctcaagggaggccttggtcttcaagtttcagtaattctaggaagcgaaggacacctacatctcctgctccctgctctgtagctcacctgagaacagctttctcattggaatgtcttgtgtttaaggaataagagtccatgtttcaggttcgggagcccaggtgcacctactggatgcagcccaggattggagacactttccagaagacaacatcacctgagacatgaccagtcccactgtttcactttcacaatttcaacttcctcagaagaaaattaaaattgctgagacttgttcataagtgttgtgccatgtccttactctgttttcttgcctgttcatttatgtcataccaggtgtctgttatatgtaataagatcaaaattctgcctccagtaacacatcaatggagacctttgattgtacttttggtttatgcactgacacatagattatgatgttcatcacattcatttttatgtcaaaggaaatctgcataatctgaatgccaatactttttggaatctgctaagtaactgaaattgaaaaaaaaatacccactcaagaacctggatagacagccatgtccagaatggcagttgacacttgtttaactggaagagaatctacagaagccacaagttgttgagggcacttacatgataagcactatagttgtcttaaagacagatgtggactcagtaaatgtgactgttccagagggtcttatatttctatgttttatggactttctcaccagaaacctccagattctaaaaaatactatccaaatacgtttcttatttgtcagattggagaagattaattactgaaaaatattacgggagactttttcaaaagcttctacatggaaggacttttcgagaaccttgtcctatgtaaaggaagacaaatctcccattccagatttctctcccattcttccattattatagaaatgagcaaagttagccaataggggtaagatgtaagtaaatagtccagggacactgaaaccacaaaagggagtaatggccaaagtagcttttcccctggagattcctggtcaaagtcacagcccagaagaggaagccgatcgcatctctaggtttccattgtcaaaacaggcagtgcttgcctgcactgcacaatccattctaaccagtgtgatagctctggattaaagatggaagtgtggcaatgcacagactctatgtgagaagaacactggaaaactaaaggacaaaggcagagagtaggacaaggacgacaaagcaatctgaagcctctgacatcaccatttttaagatcaaggtcttggaaactccctcattgacctttagatctctaggagaaaaaagtcagatacctgggcctagtgtcagtgtaggaggaattttctataggctaggcattaggaagaagggaaaattcttccttattaggaagttattgttatagtgttatagtgttattggaatagtggatatggagtgggctttcatctcgatcaatctgcacctgctggtattttccaatgctacattcacctgcaagagcccaatgaagaaagaaggcactcccaaatcttttgcaagtttttgtattcactgtgggtccactgcttaagtgcatctggagcttcagagaaggggctctgtcctgtgtcatagaacccttgctttgagtctcacggcagagttcaatctgtttagtaaagttgatcaattatttcaagagatggtgtcaccagcatatggtgtcactgagggagtattctacactagcacacagccatttcacgctgggctagagaagctggggggaaatgctttgtgagccccaacaggaacctccttgcaaggcaagggctgggcgggagggggcactcaggagccactcagcacgggttccagccctgcagctggtgcacaggaggctgctgagaaggtttcctctcaggggctgggtcttcctttgggagaaaaaagctaaaattcaataagttgctggtgtgcccttaaatattctatcacatctgagctgctcccacaattcaagagaaggagaactatctttttaaatattctatcacatctgagctgctcccacaattcaagacaaggagaactatctttttaaagtcggcttctaagattataaataccttaatagtgagaatatgaagaatagggatggtcttactaattcaatgcagagagaattatgggagtcactatatttccatgaataataatttcagatttcaggctggggctggtggctcatgcctgtaatcccagcactttgcgaggctgaggtgagcgggtcacgaggtcaggagctggagaccatcctggctaacaccatgaaaccctgtctctattcaaaatacaaaaaattagccaggtggggtggcatgaacctgtagtcccagctactcgggaggctgaggcaggagatttaatcctacaagacctacagcctcagacaatgctgctgtcagtgatcgtgggaagcagagtttgcagtgagctgagattgtgccactgcactccagcttgggcaacaaagcgagattccatctccaaaaaaaaaattcagatttcagtgttaagtaaagttgcctacattgtgtgagtgacagggcagtggtggatccgagagtgtggatctgagagtgagtcagaaatcagcatgtaaagatgaggatctatgcacatgaactgaaagtatgtaaacagttcatgaaattctaataaatccagtaggaaataaaacccaaacttatccaaaacacaaattcccttgaaattattatgggagcatgagttcataaagaactcctaactcctgtttcaacttctgaatcctagtgtccatgacataagaaaatcatctccaattatgcatcacagggcaaatctgtaaactaagagtttttctgttgacgatcctggggaatcaggacaccaggaaggtgctggagaaactgtctcaggagcgccccagggatctcagaggaacgtgctggcactcacgtgggacatcagcgtcacttgctcagagtcatcagtgagctgtgctggtgtctgacgggtccagcatagggccaaggcacctgctctgtgtcatggaccgagatggtccccagaatgatccaagtggtctctgtgctaatctaatgtagtttcacagtgagaggccgttctgagggggcttcttcttcagtgaaaggacctctgtccacaaatattcctaaatggacaggggcatgcatttcctcaagcaggattagggcttggaccatcagcatctcactcttgcaaggctgatgtgtcatttgtcttccctttcttatcatggatcaggctttgagctatgaaatgccctgtctcatgaatatgtaaatacctgagatccactgaggtaaatatggtctgtgccctgagagcttcacccaacaatcacatcccgcctctagagaatcccccgagagcatggctcctcaccatggacaggacctagagctaatcttcctggtggcagcagctacaggtaaggtgctcccaagtcccagtgatgagaaggggattgagtacagtcaaggaggctttcatccactcctgtgtcccaccctccaatgggtgtctgctcccaggtgcagctggggcagtctgaggctgaggtaaagaagcctggggcctcagtgaaggtctcctgcaaggcttccggatacaccttcacttgctgctccttgcactggttgcaacaggcccctggacaagggcttgaaaggatgagatggatcacactttacaatggtaacaccaactatgcaaagaagttccagggcagagtcaccattaccagggacatgtccctgaggacagcctacatagagctgagcagcctgagatctgaggactcggctgtgtattactgggcaagatacacggtgcgagaacccacatcctgagagagtcaggaaccccagggaggaggcagctgtgctggcatggaggagatgacaaagattattagattgaagactttcttagaaaatagcattaagtcatttacgaaaaggaacaatataaatgtgtatttgagaaattgtaattatttgagagatttcttatgcaacatttattctgtaagcaaattctagggattggagaattaatcaaattaataaagctgacatagaaattcctctgaaggtatctttgtaaacatcaatttctgaatcagtgttgtaaatgttttggaacacagacacaagatcacattttaactctacttttgtctctataaaaaatgccaaaaagagtctcattttgaccatgtacctctttgaattcccaccatcaatgaatgattgttcttgggtttccacattatattaccatttatcattatgagaattgtgtgttttaaccattataataggtgagtaatggtatctaatttttgcttaaatgcacatgcccctaataaaattcatatttaacaattttcatataatttttggtgagatgcctctcctgatatttggttcattttcaatagcactgttttcttttgattagttgtaagtttacttgcatattgattataaaagttaattaacaaattaaaagaattcatttaacaaatatgtgacttggaagttgcaggggtttgtcctgcacaccctgacacaatgacgaatgaataaagtgcactgacacaaagatattctgctttgccagctcgactgagcatctgggccacttagtcacagccaccgcctcgatcagtcagggagacttacatttattcagtaaagattaattgacaaaggccgtgagtaaacaccactagaaggtaattgacattgtggacctcttgagtggaaagcaattaagcacccgcggtagatcaaaggttagtcttaggaacacatgagtaaacaagctagttagataagctcctcacattcctttgtttctactctactttatgtaactaaaggtaaggggactaggctgccttcagccagatttattaccaaagttatgcaaactcacaggccttccaagagggtttgtggctattagaactaaaatgtttcccaccagcctgactggaccaccacatctccccattttttgttttctacatcaggtcttttggattggagcgtgcagatatgcgcagcaacatgtctgtcaggtgtggcagtcattgctcttattctggctttgcatcctagaattagcaaataacataaaacaatcatgagtagaattagcaacattcttttccagtcagagtgacccccaggagcggggtctaaccaggagagatgatctcacacacccttccatatgactgtttgttgggggtgtagatctattgcgtgaagagattctaaaattttagtttgaacttactttacgtctgctgttaaattgtcatgaaaggttccccagaggtattgttttacctcatcctaactatgtattgatagattccgtggtagagaagtgatacagatatgttcatgttcccagtcacagtttaaatgctgtcagaatgccactgcatcttgtcgctccctgacatattctaaagcagcctcaagggctagcagacgtgtgataattttttgatctataccttgctgtaagagaagttcattagacacatttttggccagattatctaaaaaggcagcagtttacactaagtcaataatacatgcaacagcaacactagctgttgccaggatgactatggctgagactataaaggccataagtgtaactatgaatcttttgtgtctgacctgggacagggcacgttctaaggttgcaagggcataggaaccttgccaattgcatgccagattgactggtaagaatgcctcagattttctctttaataccatggcgctagtaatttttaagttagatatactgtgattagtgatacatgaggcaaaccaagcctgtccctgcatccaggtcacaaacgtggagttttgaggtgtaatggaaatgttagttcccataaggaaatcgtatggatgggtagtgcaaattaggcactgatcagtgtgattatgaataaagcttatagcatagttgcaacgggaaatatggtatgtcccatgccaggtgttaagggaggtgctaagatgtcccagacaccataaagtaccttggggcggcatggactttacttggggccttggatatgccatccccccttggcacaaattataggggaaaagacatggctatgaaactgattgatgctctgatggatgaaggtattagtaaggctgccctgcaatcagccgctgggactccagtctaagatgttataattacctaactggaggctatgggctcgtctcccatgacagacctcccagctaaagtcgaaccgattactgtcccagctttgttccttagcacaggaaggaatgtttgggaaagaagcagcggcatggattgcattgctcagtttgaggctatctgcagctaagaatgttaaggcatttcctttgctatgatgtaaccatacttgtttttgggcaggtacacagtaagggttagagtctttataacttacacacactgggaggataatagtggattgacatatagtgttatctgccaccttagtccattgtgtgccattattgagggaccccacgtggggtaaatctatccctcctagccaagcagtcacgttactataggctgggaagggagtgtcttcccatttggcagggtgaaagaaaggtgtgtctaagatagaggcccaatagagtgtagcaggtacaggttgcagacaaagtgagagcataaaaaggattaataccctacatgagttgcaatgtacaacagaaatcatagcaccaaacacattatctggagtaaatggtgtctgcatttggagcaggattcgttcagcctcctgagttgtccttttcagtaccccccaggtaatgtctggggattgtgttgttcacagaagctgcatcgtccggggctgtaggtcttgtagggttaactccttcatttctggtactgggttgggtcctagcaatgtcctggtatggtttgatgcgtcgtgctggaacccaaagacgacccgagggggtgtggatacaagcgtaccctcttccccacattaataattcacttggaccacaccattcattactgtttacatctttccataaaactgcaggtttcatgtattgggaaattttagcaaagtgcttttctacagcggattcaaatttgtcttctaaattaaaaaaataaggtttgtgccaaaagtgttgcagggtctgtacccatactcccctgtttttgttttttgtgcatattttaagggtggagttggcaagttctactattgcttgtccttggggtttatatgggatacctgaggaatgtcggatattccacgtgtgacaaaattgttgaaattgtgagctggcctaacctggacaattatcagtcttaatttttgcgggttgttccataaatgcaaaagataaaagaagatgtttaatgacatatcgagtaaactctccaggcggagtatgtgcactacttaaatgagtgttgatatcaaaggatacatgtacctatctaagttttccaaattcagggatgtgtgtaacatctgtttgccacaacagattaggttctagggttaatacctgttgaaggaggagacgtgcctgtgagctggcgatctcagagactgtttagccagtctctgtataagttgagctggcgatctcagagactgtttagccagtctctatataagttggaattgtttagataagtttttccaattttggtggaaaaattggtgcaattgggtggcttggtcaagcagcgatatcataacttgaaggttggcttgattattgtcataagctaatggaccaggcagtgagctgtgggctggaatgtgtgtaataaaataggatgtgtactttgatttagcaattgctgaaatcagagaaaaagagtccacagggctggctccagagttgacttaattagggctgtaaaagttctctagacccaatattaaggactcaactttagctttctgagtgctagtaaacccagattgagtgaatgaattgtgtggtgtccaccagactgctgcttttccatatttaccagatctatcagtaaacagtgctaaagcattaaatatgggggagtaaactatttttgtaggtaacacattaactaggccttttgggaatgatgaaaatgggtaaattctaagggctgttagtagaatattacccataaaatgaataatcttgtagccaggaaactttttcctactagggagcaaagcttgcttttaattgctccctaactaacttaggggctttttgtaatgtctctccctttagaggttactgttttacttaaactggatttggagtcatgttaggaataagagagagataacagtggccattattagaaagaggtttctcaaattcttaaattttacttaactcttatcatagaattataatctgggatgtcgcttgtatacaaagaacataacaaattttgctttgggccgcctgcggagccagagagcggagcaggtgggtcccagggcggctgcggctttgtgcttgcttagaagccacttttcgccaccgcgtttcctctgtgccagctccctccccacactgctcagcagctgctgccggcagaggggagcttcctgcacttgctcctgcccctaatgccttttcttaacccttcgtgtacctgattgccttgctgatcttgcattactgggcagtctaagagctccccttttaatgctgcttgtcgaagacagggacatatagctgtagtgtatttcctctattttttctatctattgaaagagggggctcaggcaaaacctccgtttcctctttgttattttgggaagagcaggtggtaaggcaagtgacgtttcttcctccttcccctttttgggttcttctttgtataatgggactaaagccatccctactaaagcccatagtgttaaagatgatgctgggacccgttgcgcttgtgtgtaatgctgttcaagatttctccctacttgttcccagagctttacttctagctttccttcttctgggaccacagattatgtgagacaacagttttcattaggtgccttaattgagcctgcgaaactgatgctcccctagccttaagcaactgttacaatactttcatatgctgtttgtgttgagctgataactgctgtcccatgatgaaatctcagcctgaacaatctcccctgaacttggagatcccaagtgggcaccaatgacttactgttttactgacttgaccacgcagtcttcctcaaccttcgttttcatggggtctgtcacgctccctttgcagcgatcctcacatggggcaccggctgtgggggtctgtcctgcaggtcctgacacaacaacgggtgaataaagtacactgacacacagatattctgctttgccagcttgactgaccatccaggtagatcaaaggtgagtcttaggaccacatgagtgaacaagctagttagataaactccccacattcttttgtttctactcaaatttactaaactaaaggtaaggggactaggctgccttcagccagatttattactgaagttatgcaatctctcaagccttccacgaggacttgtggctattataactaaaatttttcccacgagcctgactgaaccccacaggaagtattttctccaagtctgtggttgccttttactcccttatcagtaggtatcgcagaaaaatgtgtgtgtttgtgtgtgtgtgtgtttgtacaaatttagattgaaaacatatataattttattcattcatagatcatgcctttggcattatatctgaagtttcattataaaataaactaatagtcattattttttccatatctctaatctcaggccacaatcaactcatgagtgtttaaacttcacctgcttgattggaggaccatcaatctaatgtatttggaatacttctgtaaggagatgtgttcttcttcctattattttttaattaatcatctattaatatcagtattggttgatggatgtccattttatactttgaaaaagatccatgctacatcattcatttaattgttcaaagcaccacagctttattaggtgctgggagctcattttgtttgaatcctgcatccttacagcacacctcatatttttgtttttgaacacttgcgtatttcctggtattaccataaattctaagcttgttttctttattacctttttttacatagaatcaaccacttttataaagattgcatgtttctgatgttaaagaatagtattaaaataaaacattgtgatactggctctgtgtgttgttaatgtggtatgagtacttctagaacctctcaaacaatggtcccagtaaacgtgcatgtttatgtgaacccaagtttatggactcattgaaactatttatgtatctaatcttctgtaaccatatcacattaaaaatgagaacacactggtctctccacccaactatgttagcacatgaacctttctagtcttctttctttgcgtttccataaccacccactgcaaagtgagaaaccccattccaccatatgtaattttattacttagctgcacagtttcaggacacatgcatagcagtatcaaaagtgtaaagctgtgcccttgatggaaccatgtttatctactagaatagagtgcttatgtgcagattttttacacattaaacttatagaatttcttcgttttctgagttgcttaggtcagcaacttcattttccacattcttcaatgaagtcatttcaattacattgtataatttcatttatttgaaattccataaatgcttagactatagtcaagtaaacagacagaggatgttccaggaatttagagagtgggtataaaataagcaaaaaaaaaaatgtggtgtttaggaaaaataaaactatttttagtgatatgcaatggttgagatatgatataactaatttgtctaagctaataattttgtgatagaaaatataaacttaaacatattcaattaaaaaaattcagcagttcattaaccccaggattaaatgcagactgtataaaattatccaataacttatttggtgagagtggggatgttatgagatacatgcaacaaagaatgaagtaattttccccatttgcatatacaatgtttccattcactgaagaccttttattttaaaaaaatcaattttctaccttacccttgtttttaattcccgacaagcaaataacccaaaggattcttttctttcattggttgagaaagattttcccctaacttcagcttagttcaggcatacgctgacctgaatgggcatttaccctcagatgggtacacacctgtcaatatgtggactcttctgtcagacagacacagcttcactcatgtggattcttccctcaaacacaaatgtccccacatggactatttcctcagactaccacatatgtccttacatttacactttcctcagaaaacagacatttcctcatgtggactcttgtctcagataagcaaacatgtctcagtgtgaatgaagtcttcactcagataagtacacatatttcaacactgactgtttcctgacacaagcacatatgtccaatgttaaactgtcttgcgacaaaatgatctcaagataatgataattataaactccaaccctgaaaatctgtagatctgcattttgtctattgtaacataacttcatctcattgtcagaaacagtcgtttgcagctataaatgcactgattacagtcagatttccattttctctggaaatgtatttcttatgttcttactggactaatttgttgataatgtttgctcacatgaagatacctgaacagtgtccacattagagaataaaaaagagcaatgggcagattaaccctgtgcatccagacgcaggaaccatttgactctgccttccctgaaatggagacacagaggatggatgagcaacgctgagtggtgcacctacgaccacaaagagaaagacctggaaatatgtcccatcccctcctcatgaaaggcagctcatcccctgttccttcaggccctggtgaggagccaccccatatctgtgtctttcttcagtgttcacactatggagtctgcactgatctgggtttcccttctcatcaccctccatattagtgtcccttgtaaatcaggtccagctgtggctgctcatagggttgttctcagtctatttcctctgtgttcatagaagtcctgtatgaagttcagtggtggagtcagaggggtaaacgtagtacagcccagtggttcactgagactttcttgcaaagcgtctggattcaccttttctggcaacagcctgaggttggtccagcaggcttcacaacagggattgtggtggctggcaacagtgagtcaacaagtgggagtgctcaggtttactcttcatgagtacaaataaattaactggtccagcgacaccctttcacgtgcactctaccttacaatgactaacctgaaagccaaggacaaggttgtgtaatactgtgagcttcacaggagagagattatctgcacaagcccagacacaaaaatctgcagggagacaggagggaactgcatggtagatgctgctcagaagcaccagggggcactcaacacaagggggcgctcaggacaccaggcggcactcaggatacagctgggggcgctcaggacaccagggggccactcaggatacagcggggggtgctcggatccaccagggggctcttagggcaccagggggcattcaggaccactagggagccctcagggccaccaggaggacctcaggacacgtcagcgtgctggagccaccgggggggggggggggggggggctctgaggaaaccaagagacgctctgaaccgcgaggggaaggaagctcaggaccacgaggggacgctcaggacaccagggggcgctcagaacaccagtgggcactcagaacaggaagaatctcttagaaagcagctccacatcaggatcctgggaggctgtggagaaatgggaacactcataaactgttgagcatttaaattagtacaaccactatagagaacagcttagagtttcctcaaaacctgacgatagagttatcatataatctggcaatcctgctgctggtatatacccctaaaaaggaaatgtttttgcactaccatgtctgtaatagcactgttaaagcactgttcacaacagtcaaaatttgaaagcaacctatgtgccgattaacacatgaatggataaataaaatatggtacatataggatatgggttaatatcatgccataaaaaaatgagattttgtcatttgcagcaacatggatgaaactggagttcactatattaattgaaatgagcccagaacagaaagacaaaattcacatgttcccatttatttgtgaaagctaaaaattaagacaattgaactcgtggagatagagagggaaaagatggtcaccagaagctgggaaggtctatggtagatggggattattggggatggtcaatgggtagaaaaagtgattagaaataataaataacacataatattttataacacaacagaataaatatagtcctcaataacttaattatagattttaaaataaaagtttatgaatggaatgttggtaactctattaatgcttgagaggatgtataaaatattcttcatgatgtgattattatgcagttcatgctgattcagagtcctgtaccccataaatatatacgtgtactatttacccacaaagattcaaaattaaagtgtttatgtgtctaatattctgtaactatattacattaaacctaagaacacactggcttttacacactactgtcatccacatagacattcatagccttctttctctgcttgtccataatcccacactccaaaatgagaaaacctctcctaagatatgacattaatttacttagtgcacaatttcaaaatacacaaatcgtctttaggattgttaaactgacccttgttgaaaatatgtttatcaactagaatacagtgcttatgtggagcttatttatgttttacaatcgcaacatcaaattctttccaagtctcttgtgtccaatatttatgccccaccttcttcagtgtaattagttcaaaccttctgattgttgttagatatttttatacagctgtctttttttgtgtttcatgacctgctaaatactttcgaagttgtatgcatttaggttaacactttgtctcaaaaaatatgagttttcagaaattctttatgccatgtgtccatcattgaatatcataaaaatagtttcattggccgggcgtgttggctcacgcctgtaatcccagcactttgggaggccgaggtgggcggatcacgaggtcaggagatcgagaccatcctggctaacacaatgaaaccccatctctactaaaaatacaaaaattagccgggagtggtggtgggcacctgtagtcccaactactcgggaggctgaggcaggagaatggcgcgaacccgggaggcagagcttgctatgagcagagatcgcgccactgcactccagcctgggtgacagagcaaggctccctctcaaaaaaaaaaaatagtttcattgggattaaaaagtgtgtgtttcacctaatccacacaccttctccccaccttcctgggaaacctcaaatgtttactggatctatatttttatctttggcaaaacagcctggctgttctcttagcctcttttgcaaagcatcaagattcaccttcactgactacagcataaattgagcccagatggctgggggacagaggctggagtgggtggtaacagtgattgattcaagtggaagttctcagtgatattctgcatcagcataatgaagattcacaattcccagggacaccaattaccagcacagtctcccttaaaataatctacttggaagctgagggggctctcacaggggtaggcagtgtattactgtgagagacacagcgagggacatttctgtgagtccagacagaaacctccctgcagggagacaagagaggactttgtgataaatggtgcttaggacaccagggggcactcaggacagcagagggtgctcagcagagcagggtgcgctcaggacatggtgtgtgttgtagggggcattgctcaggatcaccagggggctctcagaaccaccaagggtcactcaggaaaccagggggcgctctggacaccagggggagctcagaaccaccaggtggtactcaggacaccagggggcgctcatgaccagcagggcatgcttgggactctatgaggcatgcaggagaagcaggccatgctcagggcaacagggggctcacagaaccacctgggggtgctcagaaccactaggggtcactcaggacagcagcaggcattcgggacaccatggggccctcaggacctgcagggggcgctcagaacaccaggggaaggtcagaaagacctgggggcacttggaaccaccagggggcactcaggacagcagggggcgctcaggaccactagggggcgctcaggaccagcagggggtgctcaggacaccatggggcatgcaggagcagcaggctgttctcagggtaacagggggctctcagaacaacctgggggtgctcagaaccaccagggggcacccaggacatcatgcggccctcagaacctgcagggggcgctcaggacaccaggggaagctcagaatgacctgggggcactcagaaccaccaggtggcactcaggacagcagggggcgctcagtaccacggggtgcactcaggacagcagggggcgctcaagacacagtgggatgctcaggaccagcaagaggcactcaggaccaccagggggcactcgggggagcaggaggcactcaggacaccagaagaggatcagaaccactcgggggcactcagaaccaccagggggcgctcaggacactgggggcattcagaaccaccagcaggttctcaggacacccagggacactcaggacagcaggggcgctcaggacaccagggagggtgctcaggacaccagggggctctcagaaacacctgggggtgaccaggactagcaggggcatgcaggacaccagggaaggggctcaggacaccagggggtgctcaggacagcagggggcacagaatcacgagggtgcattccagaccaccaagaaatactcaggaccaggggtaacagaaacacctaaagacacacaagaccaccaggaggcactcacgactgctcagagtgctgaggacaccagagcttcaggacgaacagggggtgctcaggccaccatggggggctcaggaaccaccagggtatcactcagacaacagggttctcttaggaggcagctccacatcaggtgcctggggagggtcagatttgcttttagaccttgctgatccctgatctggtcaagcgaaaaccttcccaggatctctcaccatttcttccttgtaacccatggtttctttcacgtacaaatcattaacttagaacaggaattcaattcaacttttaaccctccatatttttagaataacactagcagtaattgaatgttttgataataagaaattgcgtatgcctaattcaagctctggttccatgcatgggtttttgttttctttgctgtgtcagtcacactatagtcaatgcttttctaccaataactcagcataggcatagtgttaagtttctttttctttcatctgccttttgtggagatgaaacaccactttcagggctcagttcccccaccttggttgggttctggtgttctgctcctcacactatttctccaccttcccttcttctgtccaagccttttgtcttcctcagtctcctagcaaggaagcaacaagtccctttattttgcctcttccatgtctggtgaatctgttcacttctcttcatgatcattgaagtcaaccaagtttaggaggataacagttctccttagaatatgctcatctacctgcagactctctgccttcctcacccctttctagggtcctgcagacgtcacctccaccacatccactcctttacctaagtaccacagaatagtctctgcagctcctgctgctctctgtgtgctcagcactaaggctcactagtgctttgatgatgaagttcaaatccctaatgtgttagcaattctcagacaaccctgccattgtgagtgaattttggggatcctgggctgttttcagttccatattactggatgttctctagcatccaggagtactggcaaattaacatctagaatttgtattgcaaatttatacaaaatcaattgtagaaaaaaatcctaatttctaaataagaacatttatcctgacttttataaaaatacaatgtgaatttaaccaataatataatacaattttaaaagtgatgtttatcttatatgttattaagtttattaataattggctggtattttaaaagtatactgatagcaaaactgacaaataaaccaacacagattctatacataaataccattgtccatttaattaatgtgtttggccagaatggcatttacattcagttctaccgaggcatgtctttaaatgtatttgtttattggcattaggatagagaaacactcacacagaaaagcattatttgggactactacattatactataaaagagagtaaattcaattcaattaaataaataaaataaattgaataaattcatgttttggtttggtatttggataggtgttcatttttctattttcacatgtatatttcagtactgggcatatgtgtgtatgtgtatgcatgattatgaacttctaaaatacattactcccctatatagttatataaattgaagttttgcatgttaagagacagtagaaaccacaaaaggggaaaagttatagaaagcatttggaatacctagggcctacagaggagtcatattaaaatgaaaaataatagctgaatattttggaaatgacacatgcagtaagaaatgtctatatgaaattaacaggatattggcacaaaatttagaaaaaaataacatgattatgcccactattggtctatgatatgcctataataataacacattttatttatcatagaaaataaaataattatacaaatagcactctcattgcttgattttagtattaggtacttcacttgttttttgatagaaatgaacatttatcattttttgatgataatttctatattatcttctaaaattaatgtccataattatgattgacatgttataatttccagaaacctattttatcaattgtgacttgtatttttatgatagtatttttacattcatatacatttgattcagaataattgtagattaacaaaataatcataaagttaatacagtgtgttcccatctctaagtatctcctaagatgaacatcctccacaatcataaaacatggtgttaacacatttacgttgataactttaaatatattcaataccaggccttatttgagatttaccatttttccaataatttcttttgtaaaccaaaaataaaattctaagcttcctcatccaactaaatgaactcaactatcagccaaagatattttaaagtaaactttaaaacttgttccagcaataatgggaaaatgagaggtcagatatgcctcattatgtcctcctgtctttggaattaaggcacctgtggccagcattaacactaaaacaaagacccttagactgacaaaactatattttttctataaacactcttcatagtgaaaagataccaaattacaatatgattctagtatagcatcacatgacaaacagcaacgcctaaaaatctattctctatgaagtctgctacctggaggtttcatctacataataacaattatgagctccacaatctcgtatcttaatccagatactcatttgtaatgagtgtgtaacatttcaaccaattgccaatcagaaaatgtttgaattcacgtatgtcctggaagcacttgagtaagcttattctgcctttctggactgtgtaaatggtatagctcacatgtgttgattcatatctgtctataccttctgtaccactaaaatgtataaaatcaagctgtaaccaaaccattttggatacgtgtactcaggaactcctggagttgtgtcatgggccttggccactcatatatatctcagaataaactgtcttaaataattcacggtttgtctcttttagtggatactgtctttttcttttttctttctttttttttttttgttttttgagacaggatctctccttgctgttgtttttgtatatttgtttgttcccagattccaacaaggtcatcactttgaattgagttgtcatgttcctttattctcttctggcaaatcacagtttgtgtttctgaagttttctagtttaatattttatagataaaaatttatcaagtagattgatagtcctatttaggacacttatatctttacttatttgaacactgcttgtcaatcacaatgagtgttgatttctccgtcttctatacatgttattatattttctgttccaaatccattcattaagtatttttaaatgtattttggaaagttgatcctattactttatgtaatatttctcttgagtcccaaaggtcttctttttatgattattttgtcttaaattaacatagctatttaagttttcttttggtttatattttcatgatatatatttttccatctttattttttctatttctgaatatgtaaagaaattttcttggagataaataatagttgggtgtttttttttagtcaactatgaagaattattttttaatgatgttactcttttgtccaattattcttgttttaatttgtatttttacaataaagtttattgtttctattaacttattatttaatcattctgtgactaacattttatgggttaccataaggataacaataaaaagtttctataattgaattctaattcaaaaatttaattcccattcatatatactacagagatattataactctatatatctaattcctctttcctatcccatgttttttattttctgtttgtatctatacatgctataaaatgtaatattggcatttttataattgctttccacacttacataatgaacaaaatacaaatgcaaaaactgtatttcaacctcatttttccattgttgaccatcttctttgtgcatattttcaggtgttggatctatgtcacatggctattcatctagagactctgctaaaatgtctacggaaagattcatgtgctggaaataggttttctcaggttttattggtccgacagaatatttatttgtctttgatttattgtctccagagacaatgtcaagaatatgctatatctgcaaatgggcgatctgtaaaccaagaacacatcagtatatcactgtgcaagaggagcacatgagggaaagccagtgtgtgcccagacataaacctccagggacacatgggcgaattagctgcagggggagcttgggacccactgatgagagtcgaccccagagggaggtgcacagaaaggttaagaactgctttcctgccagtatatttttaaaaaaacaaaacttccatctgacagtttctccagagaacttccctaattttagcattctgtgcctaccaatgccatcactaaataggtttttaaaaaatattgtaatatgaggacatattctcatatggacaaaacgcaaattgacatttacagaaatgaaaagtcctcaaccgtggtcgctagaattggagacctgtagcagctcagtgggacctgttgagtcttctccaatcacactcagaacagagaccttagtgcatctccctgactagaataccctttaggtatcgagataacagcctaaagatggtaaatcatgagagtctcagatgtccagatgacagacatgggtctatgggaatagtactgtaactgacagtaactaattttccataccgccagatgtcctattcaggagcagctacagcagtcatgcctaggtgtgaagatcacacactgacctcacccatgctgtctctggccacttcatcacaaccaatgcttaatattggacgtggatctgccagtccccggggaatgggttgaatggataaaatgcatggctagtgctgctggaaacccattcctactgtggcaaatggcagcatctcttttaaaaggctaaataatattctattctgtatacataccacattgccattatcctttttgtttgtttgtttgtttgtttgtttgagatggagattcactcactctgtcacccaggctggagtgcagtggcgtgatttcaggtcactgtaatccctgccttctgggctcaaacaattctcctgcttcagcctccggagtatctgggattacaggcatgcaccaccactcccggttaatttttgtattttttgtagagatggtgtttcaacatgtttgtcaggctggtctcaaactgtgacctcaaaaaatcaacccacctcagtctttgaaagtgctcagattgcaggcgtgagccatagcatccagccacttttctgcatttttttttcattgacacttagattatttcaatatcttggctcttgtgaatagcgctgcagtaaacataggagtgcagatatctccacaaggtggtgattttttctatcttgggtatattcccagaagggaggttgctggtcatacagtagttctagttctaattgatttaagatcatcttactgctttccatagtggtggagattcagattagtgtagctattatgaaaaacagtttcaatgttggggagtgactgaaaaacaaataatgcttgattatggttctccatgagagtctctaataaacctaatggaagttcagaaagtttcctcaccttgttaagaaaacatttgttttgctcataattctctttcagcccagagttggcagtatgtagaatggaggctgttggctcgtttaaggattctgaagcaaagaacagtaatgagagatgacaatagagaaaaagagagagaaggagatgctgaatcatcatggactcattccacctgcaagcctttcactgtaaagctctattgctaaggatcctgaggattctatactcccatgaatgcataatcaggatccctcaattcaaattttattggcagagacacactgggacccctctaggatatgtgccctacattactggctcaacatgccgcactgagaatcctgcattaactggctttatttgtagtggtgagtaaagttcacagttttcagtcatccatgaaggggagattttttttttggttcatataatttttgcagaaattcaggtattagtgaaaaccaataagattgaggatttctggatattttagcaacactagggatgatggccattttgtagaaaaatttacatttttcaaactgacctacatgttaggctgacataaaaaaatccaactacacagcaatattatggcaacacttcaatacacttggtggtgaaatacctcagaaatgaaatgttacacagattaattgagttaatgaaactgttctgaactatgataaacatttgtttgcacccagatttgcttgaattcaatttgattattatattcagctgctgccctaacttatttgaatgagtaagttactatttaaatgaccctgtctgtttgatttgttatatatacatctgaattaaagaacttaaaggacaggtttgtgctattattagaaagagatattctggggggcccttgtttgctccaggaacctccacatttttaacttagaattaatataaattccttgtgaattgggtcagtcttcaagagacctaatctctaaaacatatacccagaaccttctccagacagaccatccagaggaagaatctttccagtaatttatctccatggtggaaggtccttcattgtcatgcagaaccctctgcccaggcttcctttattatgcaaataattaatattagccagtagggtaagattaaacaaaaatagaccggagatgctgcagacagggaaggaagtaatagaccaaaatcagctttattaatggagactgcttttaaaggtcacagccaagaaatggaagaggataaaatcaatgagatgaaattgtaagaaactttgtccagttcaatcaagccatcagcaaccagatagcttcagtggacattatgtgtattacaacatggctaaagattctagattacacaaggattttctctatagtttgcatattgacaaagtggaagatggcatgggagatctggtggcaaacacttaaggtgcaataatagctatttttcctatatcatgacaatacatggcatgcctctatattcatttcattccaaagaagtccttcagaaggtcaagtaaatggagaatcttacatgcatggcccaatgcagtctccaagaagtgattttgaatgtacagctacaccagttactgcaatgctgtgtctgaccttcccagcatctaagatattcatgagtatcaagggggagatgggtctaggtgaaagaaaaggaagtagtcattcttgagaagaatggtatggccaagataagcctgaactctctatcttcttccatttgctgcagcttcttattgcccgattgaggtcactcgcccatggtggtaatgacatcagcaatgcagtacattctctggtggctttgtatctggtttataatgtgggagatgtttcctcaagagtggtgacgccagtatggcttctgctctctggtggtgatggcatctgcattagcctaggggtttggagaaagagagttattcagaccatggggaagaatctgacactgtcacaccgcctggtgccttcagtactggactggctcctgccctcattggtgattgcatcaaatattggcctcctcatcagtacaacacattgtaacagtcttctttgtacctggctttaatccaagaaagttgttgacttatggctctttcattatattgtatggcctggtttgtcacaatctttatttctggaattatcagtgctgccatcttggctgacttcaagtatgtcatcctcacagtttgaagctgcttgacattaacatttttgtcaatgtttgggactaccttacatattccggctctctgaaagaatgattagcgttagggaaggctgacactaaatttgggagccagagaaggaaagtgttactgtgctacagttgttttgtgataaatatggttaggttaaaaatgagctatgtaatgtagccaggtttccactgagttccactttgcttcttggctgtctattcctgtgcaagtttctatatattttgtatcaggcttcaattccattatgttttaaatgttgtctctaaagataaacaaagattttttaaaactaccaaacatgcagccatttgacagagtgtgcgctgcatttttagtctcaccatcttctgccctaacaagcaccgaatctaacaacacaaatatcatggaagctttccttggagtagctcctgtaattagaatcattggtattctgccctcctgtcagtggtggaacgttctattggcacatgtggaaacctcttagagggatgagtttctttgaacacaataaaattttaagttaggaataacttatttgaaagcaattcattgaaggttattgctaagaagaagttagaagcagtcttttggcagtcatttcttcaagatgtatggcagcgtaggatggatatatgaagtggaataggaacttgggctagttaaatggaatagcctccaatgttaatctgtttaccttttaactgaatgaaaaagcctatagttgtaagaaaagaaaaaacaatacagtgctcccctgtcccacacattaccttctcatcagtataattaatctacattgaagatgagtgtggtaatgcagagactctatttagggaggagaacatagggaaatgcaaagacaatgggagaaaaaagtcaaggacagtagagcaattcgaagcctctgataccaatagcttgaggaccaaggtcatgactcaacttttggtggacacagagtcacttctcttagggaaactgcagtattctaaggtgacaatatgcaaacatgatgaatgtacacttgctacatctccaattgtgtactgttttccttacttctgtttgaagaagggagtcgtatactcaggtctagtatcagtgtagggggtgctccctatttgcaagatactagaaaaaaatggtaagttagaggcccattgttataaaaatctactagctccgtgtcagtgtgtgtgtgtgtgtctgtgtgaatgtgtgtgttattgaaacagaagacatggagtgggcattgatccacaagcatagatacctacaggcactcttagatgtaatatttaactgcaggagtctaaataaaataaaggattcgccaaaagtcttgaaaattttggtgctgactatgtgtccactgattcaatgcatcctgagttccagggaagggaatccccaattctttcatagagttgactgggtctcctaaggtcaatgttttcaaacgatggtgtcagtaacatatggtgtcactgaaagagcattttaaactagggcatggccacttcctatagccctagagacactgagaggtaaatgccctgtgagcccagatggaaacctccatgcagggcagaggcagtgctgcagggggcgcccaggacccacccagaacaggctccagccccagagctggtgcacaggaggctgcagagggagtctctcacaaggactgagtgttactttactgaaaaccaaaaaattataacatgctaaataagaattttatgaggactatttatgtatatttaaataccctaatgtatttagaaataaataaatcaataattcagtgagaaccacatttaaaaggcaaaattattactgctttgagatattttactagtaaaaagataaagaacaagaatggttttattaaataaaaatgtacacatttcagagacacactggtcccgagagtaagactgcggagagcaaatcctggaaagggcggaggctgtccatgtgccatgggaacttgggctcacgctgagaaccatgtccggtgtgagtcagcttcttagcggagaaattctcccttcacaaatttccgggcatataaagggaaacatgtcattaaataagaatgaagatttgtacctcagcatcccacagttgtgtggtccatgtgagatctattttctctttctcgtgctggatcaggtgtaatgctatgaagtagtagtcctcatgaatacgcaaatcacctgaggtgaacactacagataactctgtgccctgagagcatcacccaataaccacatccctcctctagagaagcccctgagagcacagctcctcaccatggagtggacttggaggatcctaattttggtggtcgtagctgcaggtaggataattctcagtccccaggactaaggtgactgggtccagtcaaagggggttttatccactcccgtgtcctctccacaggtgcccagtcccaggtgcagctggtgcagtctggggatgagatgaagaaggctggggcatcagtgaaagtctcctgcaagacttgtggatacacctaccttcaccagttactctatgcactaggtgcgccaggcccatgcacaagggcttgagtggatgggaaggatgtgccctagtgatggcagcataagctacgcagagaagttccagggcagagtcaccatgaccagggacacatccacgagcacagcctacatggagctgagcagcctgagatctgaagacacggccatgtattactgtgggagagacacagtgtgaaaactcatatcctgagagtgtcagtaaccctgagggaggaagcagctgtcccagttttcaggatatgacaggatttatggggtttaatgttgtttagaaaataggttatataattgaggaaaagaagaaatagaaagatatatgcattctaattatataagaaatattcttttcaaatctcaccctataagcaaaattaacagagtgggaaaagcagcaatcaatcaagctgaaacaaacattcccatggaggatttgtgggggcagacgttttaaaattgaatgggtaaatcatttagggcaagattgcttgatccaatactaagactaaatgtaatttctgagaaactgcctatctttttatattaaatttattataaagcagttttagggttacagcagatgtaaaaagtagaaacagagagctcccatgtacccctgcccaacacatacacagccctccccatgatcagctccctgaaacagagtcctaactgcgttatgtgggatgaacctacatggacacactagttctttcctttcctggtggtcccccggtataacaaacataaattattttgaagcgccacgggttcttcaagtgggttactgggaatgatgccagttagagggaaagtgggtggggccattcctttttgcactctttcttcaggaatccataaaatgcacattgacttagagctcatctgactcctggttttctatgccccttcccagagggtaagttctccaagcgtgggaggaaggtccatttcactaaaaggccagaagcttctggtgaattccataatgcacaaccttttttgagaagtggagactttggacatgagggatttcatgtatgatgccctggagttggattaaatacagcataagctcttgggggtatttctggaggaggccctttctgcaggaaattagaatacatgcaggggatccaggcaggaagaatcacttcctttgacatcgtttggcacctgaaggaagccctctcagcattgggcactggtcccacttgctggctgcactttagccagaggcctgcgcctgatcattcttgcagtgggagagccttactggggtcacaggttataaaaatgcctgtcactctccagctgagcaagtccatatgcgtgcttgtcagtgtcaaccccatgatgagtgcactctggaaggtgacaatctgcacacaaacctcctcccactagttacccactactatacactactttaaaaattaatacttataattatataatataatatatattatataactatataaaaatgattatgatgatgacatttggctgttgcaatttctttaggatctctgcatctctcttcactagacatgtaagtcttcaatttcttgtccctgtgacacgttgcccagtgtttgaagtcaaagttgtgccgagtacctgagtatgtcctcagagaagatctcagcaatggttgattgttctacagggacttttccaggagacctgtcccagggagtcatgaggttcctctggaaatactagcccctgcaggagatgagacggaagcaggagaatcaagagcaggtgacaacattgtcagcaggaggctccagatgctttccagacacagtgaaccttcacccacttgccacactgcacagggagtttgcaggggcacaatgaggtgcctgtctgtgggatgttgggggacaaagtgaaaacctgagctcagcatccaggaaagtatgaactccagccctgataatatgtagcctgtgttttctttccttctacgtgaacactttgccttattgttaagaacagaggattctagctctaagtgcacggattgcagacagctatgactttcctccgggccaggctcctcttaatgtacttcttggacttatttgttgatgaaggttggttccattaaataccaaaacagggttcatattaaagaaaaatgaaagagtgacaggtagattaaacccgagcatccagttccagtgattctttgaccctgccttcccaaaaatctccgatatgaacaatgacaatgccctccatggttagattatattataaactagattgagctagagtgtttggtgtattaagtcactattttttttagcttccctgttagttttttgtttgtgtgttagcatttactttaaaattctattaatcagttctctagtaggtagaaattcatctgagagtttcttctcttgttgtccactttgataagatttccagaagacataagaaccctttttgtttgcaaaaatattccaaagttttacactaactaggaacatatatacttaattctaatttttaatttgtttaaaagctctaataagtgcactgttttctgccttttgagttaatttcacaacacataggagaatatatcctaaatgaaagtttgtgctaataatacaaattattggtaaataacctctgttttaattattgaggtattatccattaatatataatcttaaattgatgttctcaatgggactcttacctaaagaatatacaaaatattttcctgatcttgacataaaatagatgtgaacacattcttagtattcagccatgtctcctgtctatcacattatgaaccacatgctaactttgatttacttgggacttgttctaatttcaaactagttatttttttatcttcatgcagctggattattatgtgtggctattttatcagagaatgataaagacaattttaacaattttcactgcaggcacgtctaggcaagccccctgtgcacaatgaccttcgtgggttggacattctatggggactctcccctgtctgcctaggagagttatctgcctcctccctctatcattttcctctttgaataagcgcatctaactgccgttagaatacagacaaaggccaaccttaactgctcccagctgacaggggatgctgttttgggaagatctcccttgaggtctgtctaagggacctagtaaaagggagccattatcccaggcttcacttggatgaccatttggagttgatgcctgaaggtgagaagagacaaaccaggttattagaagacatgtatcaaaaccaaacaaggtggtaaggacagtttgaaaaaaaattccaaggctgctgacacacccagataactggcggctgtagttatgcctgctaagatttgggtgcatggggcttggctttcgttagctccctaggacttattttcccaaacaaagaaacctccgggttagggggaccctatttattccagtcacctggcatgatttgcaggataattgctcagaattaaaatattcgtccagatgtttatatagcccatgcctgtgtttcttctgagctgcagccagagatcattggttcgttcacagcgataagcagagttagtctaaaatggaggcaaatacttaaaacaattggaagagactgtaatttaaagacaaatgtatgatatgttttgaaacataatttttctctctccagttctgatttttgtcagaaactaatcattataggactgagtgatttgcaaaataaactttagtcttgtggttggtctgatcatttgcataaagtggagcaataataattaataataattctgtaggaaaagcctgcaagcaccaggagcttcacagtctaacagtatgagcacatgcatcctccagcaactcactgaatattttcaagtcagctggttcttagcttaaataacatccagttggtatctgtcccaggaacactaatatatggttctctctgcaggcccctctcgccacagatttaaggtttatttttttcctctgtgatatcaactcagatatgttgaaggtttttcccacatttgtggtttttcaggtttgttgttaataaggtcagaataagatcatagtttactcatttttttacattcccatgctgagtagctacttttctctataaaatccattagctgagagaaaaaataacattttcctaacggtgaacaattaaatagtttgacatatatttgtgtaccagtatataatgcagcttcgaatcaaggtgtgcctcaatcataaaaaacatggctaaattctcaaagaattgtgctgagtgaaagaagctaaggaattaagagtaaattttatataattcattgtagaaatattagaagatgccactaccataaattaaaatgaagaagacttaaatttttctgagaaaatggtgttgggaatgatgcggatgtgatttaagtttcagaggaataaggaaaaagatttagggattaatttaattattcaaaagttgattgaagtgccgagtgaatggctgcaaacatagctctacatttttcaaatcattccctataaatctgaattaattatttatttattatacttgaataaagcaataacgaagaaataaatgaatatttttgctaaaatggagcaataaaaagactgatattgacagaagaaatatgactgacttctgaaaacacacatgaaccatggttctctctgcatatttaggtgaattacagaaagttgtcataacagatggggaatcctgcagacttcactaggcatggtccacgctgccctggagttgtctcaggggagctgcctcctccggtgattagagcacaggcccagataataggattacatttttttagatgtgtaaacttagacgcactgcacagctgctgtattctctatgtaaattatcttctgtaaaatacaacattaaaggctgcattaaatatattgtgtaaatatgtaaaaataaaatcagattatgagagctaaatgttaatcaaggcacaatcacataatataaaattatattttcctgaatgatggaattactaccaatctcccccaggagacttcatctgcactgggcccggcctctcctcagatgtcccatcacagagcttgctatataatgggggacatgcaaatagggccctccctctgctgatgaaaaccagcccagccctgaccctgcagctctgggagaggagcccagcactgggattccgaggtgtttccattcagtgatctgcactgaacacagaggactcgccatggagtttgggctgagctgggttttccttgttgctattttaaaaggtgattcatggagaactagagatattgagtgtgagtgaacacgagtgagagaaacagtggatatgtgtggcagtttctaaccaatgtctctgtgtttgcaggtgtccagtgtgaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagctgtggtagcacatactacgcagactccgtgaagggccgattcaccatctccagagacaattccaagaacacgctgtatcttcaaatgaacagcctgagagctgaggacacggctgtgtattactgtgcgagagacacagtgaggggaggccattgtgcgcccagacacaaacctccctgcaggaacgttgggggaatcagcggcagggggcgctcaggagccactgatcagagtcagccccggaggcaggtgcaggtggaggctgtttcctgtcaggatgtgggacttcatcttcttccaacagtttctctaatgaacctctctaattttagaattctgtggttcctaatgtcatctctacatattttcaaaagatcattttaacatgaggacataacctctcatgcaccaaatgcacattgatgcttacaaagatgaaaagttctcaaccattgtgaccaggatcgcagtcctgaggaagctcacgggtgtctgatgagtctcctccattcaggcccaggacagaaacctcagagggattcctggaccagaacggcagggattctgatcacagccaatagagaggctgggccagggtcagtgtcctgtagaagctcacagggttcaagtctgacccttctcctgaccctaaagccaatgagcatcagcactgatctggtgctgcttttgctcccaatacatgttctttctttggagtgtttgttctcccttttttatttgcttttctttcttcctgaaaaagaaacacatggtctctgtgatctacactccagggctcaaggcattttcttagaactcaggcaaggctcaggcttggctactccagccacgtgggagaggctgacgggatttccttctctctccatattctcagggccctcctctgtgttgtgtgtagactcatctgggaatgcaattggctgttagtagtgaaggggatgaactcatttgatcaaaatgggatgtggatgtggaattaaccctgttctatgcacactgtcagagtcatcttcttcagaagtagtgttagaaagagcttgtgaaatttatcggcaacaaaatggatccccttgtgttaaaaccctaatgaatgaagctggggaaggccatgaaggagggttctaacacatattcctgataagatgaactgtcataaatagactctgcacagccacaaccttttacacggagaccaccacagccttaaaagctttatttctccaagtaaatctgccctgcaactgcctgttcaaccttacaccgctgtctcaaaatagctgctgtcaccctcctcatttttccttaattctcttttttattattttttaaattatactttaagttctagggtacatgtgctcaaagtgcaggtttgttacatatgtatacatgtgccatgttggtttgctgcccccattaactcatcatttacattaggtatttctcctaatgctatccctcccccttcccgccaccccatgacaggccccggtgtgtgatgtttcccaccctgtgtccacatgttctccttaattttttatcttccttttcctacctgaatgtacccatacatattttaattgaaatgcacatcctggaaaaaatattattatactttagagtctctttctgtctgttattcaggttgacaagctgcagacggacatgccacatttctgtgagacatagaggatgacagtttttggagatgtctaggaatctccaatgtccataagatcagccatcaataaatgcagactggaggtcccagagagaagtgaagctgctgaatcgccgtggaatttcattttctccagttctgctctgatggaatcaggcccaccaattttatcaatgacaatctacctaacttagagtcaattgataacagtattaatatcatctattaagtaaattcataactatatatatagtaagagagggagagagagagacagagtctcgctctgttacccagggtggagtgcaatgtcatgatcttggctcactgcaacctctgtctccggagttcaagcagttctcctgtctcagcctcctcccagtatctggaaatacaggcacacaccaccatatccggctaatttttgtatttttagtagagacagtgtttcaccacattggtcaggctggtctcaaactactgacctcaggtgatccacccgcctcagcctcccaaagtgctgggattacaggtgcaggccaccaagtccggctaatttttgtatttttagtagagatggggtttcacaatattggtctggctggtctcaaactcatgatctcagcctcccaaagtgctgggattacagatgtgagctactgtgcccggccaacatcacctatattaatgttggattgaataactacaaagtctaccctaaccaagtgtaccatcaaacttaccattacccagagggaagaatctttaacatgagatcgatttcttaagtgttttaaggtgcaaaactgaccactgtacaatcacccaattatgattttgctaatgagttgtagaagttgcatgtacattttggatattaacactttttcagatgcacagcttataattatattctctctttctgtgggttggaaattttttccatgctttgcagcatctttttgctgtgatgtagttctgcttgttcaattctgcttttattgtctgtgcctttaatttgaaatataggaaatcattcttaatattattttctgggtgggggaaattttacaattgcaagccatacgtttaagtatttcgcccatttagagtaaattttggtatttaatctaaactaaaattcttaattctttgcatgtgtagattcagtttttctaacaccctcttagggagagactttgattcatccattgtatattgttagttctcatgctgaaaatcagtttgctgtagatatattagtttatttctgagctctctctatatattaatgccaataccatcctgttattatttatggatcaaaatgtgcatatttgtgaatttcaaaatgttgttcagaacttgtgcatgccaacaactgtgtttctcctgcactcttgggctagtgaagctctcacagaccctctctctcacctgtgctgtctctgcattctccatcacaaccagtgcttcctgctggagctgcatccatcaccccccgcaaggaagggactggagcgaatcaggtgcacaggtcatgagggagtgcacattccaacccactcctcaagagtccagtcactatctccagatccacatccaaaaaacagtgtttcctgtagctgagctacctgagcaacaagtacacaaccatgaattttaatacaaaagacacaacgaggggaagtcattgtgagcccagatacaaacctccctgcaggggagctcagaaagagcaggaggcactcaggacaccagggaacactctggacacatcaaggcaggtgcaatggggggacaaggggctggagatggggtttggcatcaccatcgtatttcaccactggacacccaccaccgtgtttattctcatgtacctgattctgtgtattattagaaaatggcatttatataaatatatagccatatgtaggtgcatcaagttgtcctctccatcgtatgtggacctttccactaagactctgagtccctgtatttatatgagcacctcataaattatggtcaattttgtgggatctctatcttttctttctcccttcttccctccttctctctcactcacaaactcacacacacgcaaaattctacaacttcagttacgtgatgtgttgaagacagtttataatgtgcagcttttccagtttagctgatgttcatattgctgtgagaataggaacattgtgtttctcagctgtgtatttctctaaggtagcagcaacttttttttttaatttgacattttttaaaaattttattattattatactttaagttttagggtacatgtgcacaaagtgcaggtttgttacatatatatacatgtgccatgttggtgtgctgcacccattaactcgtcatttagcattaggtatatctcctaatgcatttttttaaatacccagatactgaaagcaatccaaatatcaatcagcagcttaatcataaacaaattgtggtaaattcattccctggaaaatcacccactgttacattctggtaccgctggatacgttcaacagcaaaggtaaagtcacaagtacatatgatgagtcaaataagacaaataaatacaagtacacacatacaattcctcttttataaattctataaaattaataccaatctaaagttacataaagaaaaccagtagttgactctgggtgtggtgtgagaaggaaaggtgtaggaacaagaaattacaggaaaacaagaggaaattttgagggcacttgagttttttctgtgttgagaaaggtaatggttatgtcactatttgtcaaattgtgcacattatgggatggctattatttgctaatttcacctcattaaaatatgccaaatttaaacacatataatttggtagaaaataagttagacagagatgaataaaatatatgagaaataaaaaaagaaaatcacagaacgttggcataaggacttcactcatcaaactgaagaaattttaaatttctcaacacagaattaaagatttaattaaagatatatgagaaatcaaagactcctggatatatacatgaataaaccctaagcctacctatatttttagggaaacactagaatacaacaaaataatgtcatgaattcattacataatgggcgttaatcaaaccccaccaggcatgtccagctgtgtcctggggttgattcagggaacaggtgtgtcctgtggttaggagaagtggcaacaagctcacagcatctgttctagttgacaccataaaaaggccaagagatcacaaccaaaatgtagtgtggatgtcacatctgtgagtgccgcacactcccccatgtgaatacgaaaaggttgattacctcttgaggtgtctgctgagagtagagctggtctctcaggaatgtccaaaatggctcgatagagcaagaaaggagactggctcaggttgctataccagtttggtggtggaggcagagtgagggttctcactcacagaaatgggtttgtggggtttgaacctccaaatggcatcaaatgagggagttcttgtgattcctaactagatccacctcgtgtcggaaagaaaggagatgatggaggaatgagccttaagttatcagcagtcagacatcaaaacaagtctgatgacttattctatgtagcaactataaataaatgaataaaaatagatcataatgaattattcataataaatgaataaaaatatgaataaaaatagatcagtgtccaatatgggtggacaaaaaccagtctacacaaaacaagaagactgcttataagaataagcaaatcataatgaaaaggaggaaaatgaggtgaaaggcacggggcaggggattacacaagggtcctgttccaatgtcttgtgtggagacttttcattacctaaaatcatccgcttgttctgaatgtcttaggtgagctgtctgctccaaaacatcagaagcgccagaggattcatgaggatattcagtttaatatcttctatttaaggtgccttacaatagtgtaaaattcttaattattattattataataagagatagggtctcactgtgtcacacaggttggagtgcagtggcacaaccatagctcactgtaaccttgaacctctggctcacacaatccttctttataagcctcctgagtagtgaggacatgagaccaagctgatttttttttaattctttcatagaagtggggtctctctatgttatccaggctggtcttgactactagtcttatgtgattcccctggttttgcttctcaaagtggtagaattatagacatgagccacgatattcggtctgaactgattctttagttgcaaaatatcaacccaagaattgactcccttaatttttttctgcagtgttttggttaatattgcctgataaaatttattctaatttgtttcaacagcagaattcttcctgacgttttttccaatatatgtattttcatggttgaagatcacaaaatactgttaaaacatgacataaaaaggcaaccttaaacttttggtgattggagttagtataatacaaaaattacgtccaatattgtgtaacacacacatgcaaaaagacgaaggtgagcaatgagggtaaactttctaaatgtatgaatcttccagctcccaagtcataggatagtaactgatgtggcctgagggaggtaccagagtgacacagtgctagtggcataactcttggccaagagactttcaatattttattaaagtttttatatttttttaatttaatgatgccatttttttcaacatattcagaatattgtgagtgggattgattctggatgatatgaacaatgggaatgccttctatgtttagataatattaaggaccaggttgagattgaaagtttgtagaaatgatgcaccataacattattctagtttccatactaggttttttctctttgcttgcatttcatttcaaatttatatgtcagatatctagaatgtaataatttatttaaaaatttcttttcttgtagtccattttgatggggcttccagaagatttgaaaacctcttctgcctgcaggacattttaaaattctgcactacagtaaaacatctgtatttaatcatggtcttcggtttattgacaagctctagtaagtgcaataacttctgccttctcggctgattttacatcagatagaggaatttatcttaaatgaaagtttgtactagcaatataaattatgagttaataaccaccacctttattatttaggtgttattcatcaagaaataatgttaaatcaaggctctcaacgggaatattatctaagggatgcacaaaatgttttgctaatctagataaaatagatgtgaacacactcttagtatccagtcatgtctcctgtctgtcacattattaaccacacggtaactttgacttcacttcggactcgttctaattttcaaattcgttacatattaagcttaatgtctctagactattctagcagagtgaagaaagacaagctagactgacaaacaacctaggatgacaaacttcttgtcactctctataagaacttgcttctccctgaacttcagacttgtcgcgtgttttgaaacattaattatcaaaagtattaaagaaaatttgcaaagctacatcttctatgtttatgttattgttgatgcaattgtaaaaaataaggaaaatgtattccttttctatgtgcgtttccaaacttaatagcagatttttagtaagacccagaataataaaaaattcaaatattgttcagctgcttaacagaaaaacaaattatggtaaatttgtttgctagaatgctatccagtatttagaataaataaatgtctgctatacccaactataaggtaaaatatcgaattacatatgttaagtaaaataagccaaacaaataagaatatatactgcattgatttgtataaattttaataaactaaatgactcagccgcaatgtatagctcaggagttgccagagaaatggtagaagaatgaaagggaaaaggaggaagaatgtagaagaacaaaaggaaatgttgagaattctcttgtccaccttgataacaatgatggttacattatatttatcaattgtacaatttaaatatgtgaaagtttattatctgtaaactaaaactctcaaaatttattacaagcaaacaaatggaaacttagacaaagaaggagtgatagaaagatagaaaaaatgtatattaaatttcagaaatacctaagaacttatctgcctgaaccctagttctcaccatatttttaggtgaatgctagaatgcagcaaaatcacacgtgttctcactacagaaagtgggttccacaaccacactaggcacgcccagctctgtcctggagttggctcagggagtaattggggccagtgatgaggagcacaggctcaggtactggggcttactcatccagacgtgagctcttagacacatacttagccctttctccatgcgtggttgacttccacatctgtacatggagaaacaattgactccgacaaaacataatttgcacaaatatgtaaaaataaaataggatgatgaattcaaaaagtttatcacagcataattttataataagacagcatattttctgagtaccatcgttgtcaccaaattcttgcagggcacagtcattttatctgggtactgccttctcgtcaggcttcccaccccagagcttgctatatagtaggagacatgcaaatagggccatctctctgctgaagaaaaccagcccagccctgactctgcagctctgggagaggggccccagccctgggatgcccaggtgtttccacttggtgatcagcactgaacaccgactaccaaccatatgaagtctgggctgagccggtttttccttgttgctattttaaaagataattaatggtgaactagagatacttagtgtgaggggacatgagtgagagaaacagtggatagtgtggcagtttctgatcacgatgtctctggaggtgtccagtgtgaggtgcagctggtggagtctgggggaggcttggtacagcctggggggtccctgagactctcctgtgcagcctctggattcaccttccgttaactactgcatgcagtggatctgccgggctccaggaaaggggctggagtgggtaggtttcactaaaaacaaaactaatcgtggaacaacagaatacgccgcgtctgtgaaaggcagattcaccatctcaagcgatgattccaaaagcatcgcctatctgcaaatgaacagcctgaaaaccgaggacacggccgtgtattactataccagagacacagtgaggggaggtcagtgtgagcccagacacaaacctccctgcaggggcgcgcggggccaccgggggcggtcaaaacccactgaggacaggacaggtcccaggagcagatgctggggtagttttcctttctcatcagctggagaagtcaggtttgtatttgcaggactctgcagcattctaggctgtgacattttatcacttgtatttattatgactttattatcgttagtatttaaattttagtaattattaaaattatatataagtacattttaaatatgtactttgaagatataaatattcctaattatttgcactgattcttccagagttttattaacatttgttgacatcagcaactacatagctatagggacataaatttataaacatagaaatatgtatcggcaagacatggtggtctgtgcctgtaaccccagcttgggaagctgaggcagaagtactgcttgaacccagaaggcggaggttgcaatgagccgtgatcgcaccactgcactccagccgggcaactgagactccatctcaaaaaactaaataaataaaaagaaagaaagaaaaaaagatgtacaaatacacagacctatgcatatatgtgtaggcattcatattaaacattaagataaaataattctaaaaacatgtcctgaagaatcaaaattaatgatgaactaaatataaattattagagtaattcataattgattttggttatttttaattgtttacatgttgtgattttacacaaaatattagtcatttatcctgataaaacaggtcaaaatgttatatcaagagtttatttactttgtattactaataatataaaatgttccacatatttttagccatgttttacttatctgtgaaatgtgtttattaatttttcattttaatatgtcacctttatctttctaatttcctggatttaattccactacagctgaatgcattttaataattattgtaatcacatttacattttttatttgaattttcatatatattttattaggattttaatatcaatataaatattttcctaccattgtctattttctatttttatgatataaaattaacataaaaatgcttagattttcaatgtacagcttgagggcttctgacaaatgtgcgcacaaataagaattatttgcttactttttagtgtatactgaggagtgggattgctgggtaaaatgatatctctgttttaagttctttaagaaatctccagtctgctttccaaaggggcaagattaacttatattcttctcatcagggtataagtgttctcttttctccagagtcccaccagcattcattgttttttgactttttcgtgatagccattctgagtggtgtgttgctgcacacctacaatcatctcatatttgataaggctgatgaaaacaagcaataaggaagggactccctgttcaataaatggtgctgggacaactggctagccatgtgatgaagattgaagctggacgtctactttcaacatacataaaattaactcaaaattgatgaaagacttaaatgtaagacctcaaaccataaaaatccttgaagacaacctaggaaatactcttctcgaccccaactttgacgaataatttttggctgagtatccaaaagcaaattcaaccaaaacacaaatagatgagtgggacctaattaactaaggagtttctgcacagcaaacccgccaggagatagatgctcaggacaccagagagaactcagttaaaccagggggcgctcagaacagcagagtgtgctcaggacaccagggggcgctcagaaccaccagcaggagctcagaacagcagagtgtgctcaggacaccagggggcgctcagaaccaccagcaggagctcagaacagcagagtgtgctcaggacaccagggggcgctcagaaccaccagcgggcgctcagaacagcagagtgtgctcaggacaccagggggcgctcagaaccaccagtgggcgctcagaacagcagagtgtgctcaggacaccagggggcgctcagaaccaccagcgggcgctcagaacagcagagtgtgctcaggacaccagggggcgctcagaaccaccagcgggcgctcagaaccaccagggggcgctcaggacggcaggggtcgctcagacaccacggttcccttaggaggcagctccacattaggtccctgggcagggtggggtttcctttttgaacttgctattttttgaccttgtaaagcaaaggtcttccccaggatctcttagtatttcttccttgtaactcatgtcttgtcttgttttgtttttgtttttgttttttgtttttggtcatctacaaaaacttaaacttagaacagttgattcagaaaggcaggaaagcaggcattcctctaagtctcccctgagacaaatacatatatgatttcttcctccccactataatttatgtaaaaatgaagattcactgagtcagactaaattgtgtattcagtggaaggataataaatgacacaaaagaatgcaacctattgtctcttatcttcttctaacctgcaagcccccattttcatttgtcctggcttacaggaaaaaaaaatgtacatttcacatgtattgactgatgtctcatgtctctgtaaaatgtataaaagcaagctgtacttcaatcaccttgtgcacatgtctcaggacttcctgaggctggttatggttgggttcttaactttggcaaaacaaatgtattagtctgttctcctgctgctgataaaaacataatcaagactgggtaacgtataaaggaaagagttttaattgactcacatttccacgtggctggggacacttcgcaatcatgtcagaaaaggaagggacatcttacatggtggaagactagagagagcttgtgcagatgaattcccctttagaaaaccatcagatctaatgaaacttattcactatcatgagttcatcatgggaaagacctgcccctatgattcaattacttctcactgggttcttccaatgacacatgggaaatgtgggactacaattcaaaatgagttttggatggggacacagacaaaccatattaataaacttcctaaattgactgagacctgtctcagatatttgttgtttatcctactcatgtacagccttcagagttccaaagcctatatcagttttccaggattgtttcccctttttgttggttatttcctcctttattttctatgtttagttccctttttctcccactattttttcatcattgggatgtgagacttcacaacatttgaaaggtaggtaacaatgagctatcttaacaacatgggacctgtttatctaagagtaatccattctatcaatgaaagataaaacaaaacaggagaccagaaactcatttggttgtaaaatgcttcctctgaatgattttgaaaaggaacaggtggggaaaatataaaaggaaaataaaaacttgtgctgtcaattcattatgtcatgaggggggaaaatcctaaaggatgatccatgcaagaaactgattttcctttcattcctaagagaatagctacaaataaaaagttaaatatcttcacagatagctactctttgttcattttactttatataaagtgctaacttagttcaggagaactacataatttttctgtttccctatgtgcttctctctcattacaacatgtaaattttcatactgtccctctttcccctctatccagctttccccccttttttgtattgaaagccctgaaaatcatctttggggaacggcactgaccacaaatttttctgtgattacttgtattttcattccaggcatgccctaactttggcaaaattaattttaatttgattgagatctgtctcggaaacctttggtttacactaggaaagatcccaaattacgagtcaattactataaagctcagccttcccactgtgtatgtgtgtgtgcatgtgtgtgtgtgtgtgtgtacacgtgtgttttaatttttgtgggctttgagccatgtagttctctctgtggacatactatttggcgtgatctttgaatagagaattctgaaagaaataagaggctcctatgagttctctgaaagtttctggactcaccatggatcttgactgtgtcattgcatctgacagtcccagggaacagactctctggtggtttcaaagaatctgtgcttgggctccccctgcagtttactgggtacagtaatgttaaatcactgtttcgagagacaatttcgaaagcattagatgctgctgagagaggattgtgaaccaggggacagccccttcattctgggggagcgacattgggagaatatgctctgtgagcccaaacagcatcctcccctgccgggtgagggcagagctgcaggacaggcccagaaaccactcaacacagatgtcagccctggagcagctgcagaggagtctgaggagaaaattttaccagcatctgaattacacttatttcaaaacaaaaatgcaattaaaaagttaaaataagtaattaatgtccaggcacagtggcttacacctataatcccagaaatttgggaggctgaggtgggaagatttccaggagtttgagatcagtctgtgaaacatagtgaggcttcatctttacttttgaaaataaaataaaataaaacataaataatttagcaaaaactaccgatgtgtcttccatatcccatcgtacttagagcattgatgtaacccaatgagtcaatgagaaccaaatttgaaaggagaaaattttagagttttcagatatcttaagagttggaagatgtagaacaaaactaattttatcaattcaatgtgtgcaaacatggagagacacactcatgccagtagttcaacttgcaaagggcaaaaaccaaaaaagtttgaagttgctagtgatccatttgtaggtgagatcattttgaggatcatgtcctgtgagaggctgtttctctattagaggagttctgtgctcatgaagtgctggacatgctaggggacaaatatcagtaaacaaacatcagaacttgaatgtcagcttccccctgctgcattctccgtgtgtcatctctctgttatttctcatgctagatcaggtctttagctatgaaatattccacctaatttacatgtcaatagcttgaagtctactgagtttaattcatattttttctatatgttacagttacagtttgtccacaaggacaaggtttgtccacaagtttgtccacaaggttacagtttgtccacaaggactcaatcatagaagtgcagagtccttttcgggccacatttaattcactttatcagtgcccttcagtatgtggttcctgagaatttcacatgacaacacatttaccacactggaatttaagcaatccaacacatgtttgtagctttatcttgtaataggctgtatttcatatggcagcctctgcttcagtttagctaacactatggctttgtttctctctacaagaacttgtttctcccaagatttccatgtttgtgaaaggaaaagaaatctctgggacccccaaatcactaagccaaagggaaaagtcaagctgaaaactgcttggggcaaacccacctccattctttccctaaaatgatagctactaactgtcaggcctctgagcccaagataagccatcatatcccctgtgacctgcacatacacatccagatggccggttcctgccttaatggatgacattccaccacaaaagaagtgaaaatggcctattcctgccttaactgatgatactatcttgtgaaattccttctcctggctcatcctggctcaaaagctcccctactgagcaccttgtgaccccctctcctgcccgccagagaacaacccccctttttcctttacctacccaaatcctataaaacggccccacccctatctcccttcgctgactctcttttcagactcagcccgcctgcccccaggtgaaataaacagctttattgctcacacaaagcctgtttggtggtctcttcacatggacacgagtgaaactaaggttttaaaaaactacatacctccttcaaaatttgaccacaaggaaaaaccttgtggaccaacaacagacagagtcatttctctgctcacataagtcaaatgcctatctgattgccaccatttctctattgttttgctaagccagactaaggcctacgtgactattcctgtaaattgtgcattcagttaaaggctaatcagaaactcaagagaatgcaagcatttgtctcaaacctacctgtgatctggacgctctctccccacttcagaaagtcctgcctttctgaaccaaaccaatgtacatcttacatatattgattactgtcccatgtctccctaaattgcataaaatcaagctgtgtcccaccaccttgggcatatatcgtcaggactccctgaggcggtgtcactgccatgtccttaatcttggaatacgaacttcctaaatctattgagattagtctcaggtactctttggattacaggtttgttttttatttcataacttcaattatctgaaatactaaacaaaatttgccaaagtgtacattctcttgttgctgttgttgcaaaaaatatatttatgtaacttatatataatttatcatctatgtgtgttaccaagctgagtagcagatttattagtaagacttagagagagtaatgaaaaattcaaatgccagttagtaacttaatagaaaaacaaattatgctacatttgtttgctgaaatgctacccattatttgtaagaaataaacacatgcaacataaaagatttaattctcagtatttctattgagagaaataatccacatacataagagcatatactatattttttcattcttataaattctagaatataaaagctagtcaaaagacatgtgaaaacatcagtagatttataaagaaatggtagaagaagggaaggagaaaaaccaaaaaaatataaaagagcaagaggaatgctgaggggagttgacttgtcaccttcttaaaaatagagattttatttttcaaagtttactattgtacagaataaatatgtgaattttcttatctgtcaattaaacctcataaaatttattacaaaaaaactgaaattttagacaaaaagagggtgataggaaggaacaaataaatatgttaaatgtcaaatatacctaaaaatttatttgtctgacccctagttttctccgtatttttaggtaaatgcagcaaaatcacacaagttgtcgtggcaggaagtggattctgcaaaccacactaggcccgtttatctctgtcctagagttggttaaaagagcaactgaggccagctgtgaggagcataggcccgggtactaggactcactcatgccagatataagcccttagacacatacatagcccctccatgtgtgggttcacttttacatctgtacatgaagaaaccactgattcctaaataacataatttatacacataggtaaaaataattaaaaatgtgatagttattaagtgtttatcacacaacaatttcacaataaaacagcattttcccaaatgtaatcattgtcatcgaaatccccaaggacactctcatctgccctgggccctgccctctcctcaggcatctcaccccagagcttgctatatagtaggagacatgcaaataggtccctccctctcctgatgaaaaccagcccagccctgactccgcagctctgggagaggagcccccgccctgggattcccaggtgttttcatttggtgatcagcactgaacacagaagagtcatgatggagtttgggctgagctgggttttccttgttgctatttttaaaggtgattcatgaggaaatagagatattgagtgtgagtggacatgagtgagagaaacagtggatttgtgtggcagtttctgaccttggtgtctctgtgtttgcaggtgtccagtgtgaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagagacacagtgaggagaagttaatgtgggaccatgcagaaacctccctgcgggaacgctggggaaagtcatctgcagggggcgctcaggagccactgatcagagtcagccccagcggcaggtgcagatgaaggctgatttcctgtcacgatgtgggacttcatcttcttaaagtttctctactgaacctaagttcggaattctgtgattactagggtcatttctacatatttttaaaatgattgttttaatatgaaaacctattctcctatgcagaaaatgcagattgatcctcacagaggagatgaaaagttctcaaccatggtcaccactgtcagagtcctgaggaagctcagggcttcctggtgagtcttctccagtcagactgaggacaggaactccagaaagaatcctgactagaactgaggtattgctcctcacaagagaactcaagctgcggggggtctgttcctgcagacccctgacccggtggcggatgaataaaacgtacactgacacacagatattctgttttgccagttcagctgagggtccgaggcaacttacagactccaagaagaatcctgtaaagaacggcagcagtggccctgagcagctcgcactccaggcgtgtattgagtatagaattaacaacagaagctctgacaacacacttgtggataattaacatggttaagagagtagttctacgaatgattaaagctcagggactgcggtctaaagtaaataccattagggggcaataccctggttagttaatggaggtagggtaaccagacttaactggggagccctctattgtccctagtatttaccctatgcctaacgctctaaggtaagagctgcccaccttcagcctgttcaattattacaagctatgtaacctttcggccttctagagaggtatatgactattccctataactttccttaatattcccctttaatatttccgccaccatcctgagtgaatcccagcaaggacagtctttggggattctgattacagaaaaaagagagcctgggccagggtcagtgtcatgtagaacctcacaggtttctcgtaggacccttctcctgacactgaagaatgcaaatcagaatcaatactgatctggagcttcttttcctaattcatttactgtcttttttagatgttgttctcatttttccatttgcttttcctgctttccgaaaaaggaagatgtttttgctgtggtcaaaattccagacctcaagcccttttcttggcgctcaggtgggtctcaggctgtggctgctgcagtcacgcaggagagtctggtgggactttcttcactcttcgtcactcaggaccctccactgtgttgcatggagactcatctggaaatgcaagttgccagtgggaactgaagggacaagcttgtctggttaatgtgggatgtggatgtgtttctaatcctgttctgaaaaaccgtcacacagtaacgttcttcactagtggagaaggaagtgggtgtgaacgttgtcagaataaaaatggagccacgtgtgttataatctttacaggcgaagctggaagaggtcatgaatagagggttctcatgcacacatccctgataacaagaattaccctaaaaatactctgcacaaccacaatcttgaacaaaggctaccacaacaataagagaattaatactgaggggatatctgccctgcaactccctgttcagccttaaactgattctacccttgttattgattcttctaccccaggataattgtctcaaaatagctcaggtaatcttctcatttatccttcagacacttgtctttctttaccaacctaaatgtgaccatggataatcccattgcaatgctcattttcaaataaatacgatttgattttggagaatctctttctctctgatgtttaggtttgacaagctgcagagggacacaccactttcctgtgagatgtaggggatgacagttttgggggatggctggaaacgtgcagtatccttagggtcagccatcagtaaatgcaggctggaaatcttagaaagatctcaagctgcttaatcaccacggagttttaccttctccagatctgttctgatggaatcagggccaagtttgttattgatgataatctacctaatattgagtcaactgatcacagttttaataacatctatttaaaaattcacacctggattagtgtttgatcaaataactacaaagtattgcccaaccaagcataccatcaggcagactgttacccacagagaaaaacattgaacatgagtttgaggttctcacattgttaaaggtgtaaaaccgattatgtttaaattatgctatttttattattgttattgagttgtagatgtttcatttacattttggatattaacgctttttcagattcatggcatattatccaattctgtgagttggaattattttgttactttgcggaatctttttttaaatctagtcccacttgtccaattctgtgtttttttatttgtttgaatgtaaaatccagaaaaagattgctaattttttgagggttgagagttttacaattgcacgtgtttcatttaagtatttaatgcatttagaattaatttttttgtttattctaacctaaaattcttaattctttgcatgtaaatatccaattttcataacacgctctttggaagacactataatttagcaattatatattgatggttctcacgctgaaagtcagctggccatcaatatgtgggtttatatctaagctctctgtatgaatttatgcgaatgccattctgatttattactgtatgtttctaataaatgttgaggcctggaagtgtaatacctcaagctttattcttgccttgttacagatattagaccaaaatattctaaaattttactattgagtataataatagctgtggcttttgttaattggtttcattatgtacaagtagttttcttgtcttcctactttgttcagagtttttataatgaaatcctgaatttttttcaagtgttttctgtgtctgatgaaatgttactgagatattttttctttagttttttaattaatcaactgaattgattgatttgagaatgtcaaatcatctgtgcatctcagaataaatttgagttgatcatggtgtatggtcttctataaaatctttagaatttattttactattgttggggggttaatttatgtctactaatgatattggtctatgattttcttttattgtggtgcctttgtctattactggtagtactctaacggtagcctcatagaaagagtttggaaggtgtgttgcagactacctttaaaatagattttatcagtggagaaacggtgatagtttttttcttcagttttctgttgggaagagttttgtttgtttgtttgttttttgtttttttgttttgttttgtttgttttttgagacagaatctcgctctgttgcccaggctggagtgcagtggcagaatctcggctcactgcaagctccgcctcctgggttcatgccattctcctgcctcagcccccaagtagctgggactacaggcgcctgccaccacgcctggctaactttttgtatttttagtagagatggggtttcaccgtgttagccagaatggtctcgatctcctgacctcgtgatccgcccgcctcggcctcccaagggaagagttttatgttgtttaaaagatattctgaataacttaacctgcttaatgggcttacataatattcctttcttccattctttttaaagaactgcttacctttcctaattatttttagggtgatttttcacataaagattgtgcaatacattttgaggtgagacttagtggattttctctaatgaattagaaataataaatcacttaattgactattgtattaaggttgatttgttgaatatttgctaaaggccagttctttaagctgtgccatgtactaaatccctaaccgactattttattcaggttggtttgttgaatatttgttagagaccagttctttacactatggcatgtaataaattccaaatggcagtacgtcattgtttacttagcttttgtgcttatatttttcagaggaaaaaaaatactgtaaattgtaaatacccaatacctaacagtattgtatgcaaatctgtgactgttggcagtgtcatctctgagaaacagataaagtttatttactatatataaaaaaagagtttggaaggtggactcctcaccaatttttgaaagagttagagaagcattagcattaattctttaaatgttaagactaattttatgatgtaacatataacctatcatggagaatgttcaatgggtgcttgagaaggatgtgtattacatggctcttggttggaaggttctgtaaatgtctttcaggtaaatttgttcaatactgttgttcaagttcagaggcttattaagaattttctttctggatttgcaatacattattgctaagtgaggtattaaggttttcccttatttttatatagttttctatttctctctatatatatatcttaaagtttgcttaatgcatttatatttgtatttgtactgtgtaaaaagtaaaataaaataataattgcttagtgagtttcatggcacaatcacgttatgaataatcatattttcccaaatgctgtcattgccactaactcctccagatacatggtatattatccaattctgtgagttggaattatttcgttgctttgcagaatctttttttgttaatctagttccacttgttcaattatgctcctccgggagtctcacatctgctctgggcactgccttcttctcaggcatcccacactggagcttgctatagaggaggaggcatgaaaacagggccctccctctactggtgaaaacaagcccagacctggccctgcagctctgggagaagagccacagccctgggattcccaggggtttccatgtggtaatcagggctgaacacagagctcactatggggtttgagctaaccagaatttttcttgttgctattttaaaaggtgactcatagagaaatagagtgagtgagagtgagtggatataagtgagaaaaacagtagatgtgtttggcagtttctgaccaggacgtttgtgtattttcaggtgttcagtgtgaggtggagctgatagagtccatagagggcctgagacaacttgggaagttcctgagactctcctgtgtagcctctggattcaccttcagtagctactgaatgagctgggtcaatgagactctagggaaggggctggagggagtaatagatgtaaaatatgatggaagtcagatataccatgcagactctgtgaagggcagattcaccatctccaaagacaatgctaagaactcaccgtatctccaaacgaacagtctgagagctgaggacatgaccatgcatggctgtacataaggttccaagtgaggaaacatcggtgtgagtccagacacaaaatttcctgcagaaagaagaaaggattctgggccgaaggggacactcagcactcacaaaacaggtggagccccagggcaggtacagaaaagcagtcaagggctgctgtccttcaggatctgtgctttcctctgcatgtagcagttcccctcgaatcctctgcacttttatgtttctgtgcccaccatgaggtccctggattacaaaactttaatttaaaagaggaaacattcttatatgtcccaaaaacaaaagtaagtattagaggcacaaaagtgcacaggcggccaggtgaggctgtagacactgccaccccgcaatgccagtctcacaactagcactggagagtagtgggcattcagtggagcttcctacctatcctgtggtccgagctaagtccagcaaggccattggtgccttccagagcacagtagtccatcaggaatctcccatgtgtcccagcagcagccttgcctcagtatctccactgtgcacagccattgtctgggagggagctcccaggatgagtgtctttggcacacaccaggtggcgggtgttagagtgcagtacagcagctggctgcctggtctattgggctccctgatgttggagggatttgaggtgcattctcaggcccagcaccctctttgtgaatttttatataaaaaccctgattttacttcattttctcagatgacatagataactaaaaacagaatctgcaaagaaattgtaattttcaactttaccccaaattcattgtttcttaattctgtgcaagatccaaacatatttttggcttccacatgagaaattgttctgtttaaactgaaatcatttcttctcatattctttcttttgggccaagtacagagatcttgttgaaaataagttgggttctttccacacactaaccctcacctcccctagagaaagagcagagattgtcctcactctgagtctaggggaggagctgttcctgtacaattcagagcctgcagagaccccccccccccgccaggtgcagcttcagtgagtcagacatttctccatgtgggcgacctccagtgcctgtgactgcttctcaggcctaattgtgggttaagaattaggacactctttaagttatcacatctgaatcctattctgaaaatcaccataaagagagatagttcaatggctattctcctgacataagtttctctttattacttggttccaagtatggagaaacatgtgacccaatatttgtctgaatccaacatcagaatcccctgcatttctctgggaaactcccggatcgaacacaggtgagctctttattctcacagaaatgtatgtagttgggaatttcaacaaattgtccagaacctgtgcctgccaacaactgtgtttctcggtgcactcttggcctggtgaagcccccaaagaccctctccctcatgtgtgtcatctctgcattctccatcacaaccagtgcttcctcctggatctgcatccatcaccccctctctgggagggaatggagtggattgggtccatagatgatgaagggagcacacattactcccctttcctcaagagtccagtcaccatccccagatccatgtccaaaaacagttcttcctacagctgagctacatgagcaacaatcacatagccatatatttttcagcaatagacacagtgagggaatacacagtgtgaactcacaccaaaacctccctgtggggatgcataggacagaaggggttgctcaggtccccagggggctctcaggacaccaagggtcactcaagaccattgtagaggcacgcaggtagccgggggctctcaggaaccatgggggaaaatcaggacaccaaagggtgcttggtacagcagggggctcaggacaattgtggggattcagaaagaacagcttcaaggctcagcttcagggcaggtgcagctggtgtgaaaaggggctggatgaggcgttttgtgtcaccatcatgaaacaccaccagacaccctccactacatctgttctaatgcatgtgtttgtatgattaggaaatgatattgatataaatatataaccatagctaggtgtgtctttttctgccttccgtcctcccttcttctctctctctcacacagaaatttacatacacccaccccacaacacacataaatctataacttttattacctgatgtattcaataaacctgattaatgtgttttgcagcttcattgtttatggtgttgtagcaataaaaaccatctgtttcccagctgtgtacttctctaagctgagtagcatctttgttcataatacccagaatgaaaaacaacccaaatgtcaatcatcagcttaactggtaaacacattgtggaaaagtcattcattgacatactacccactactaccatcagctaatgttggctatgctccaaagcatggttaaattcacaagtacttcagatgagtaaaatgagccaaagtgataaaagtgcatacataggatacaactttcataggttctatagaaccaaaagtaatctaaagttgccaaaaaaaaatcagtagttcactgtgaatattgtaggagaagggatggtctaggaaggaggaattatggaacaagataaaatgttgagggaattgacttgttatctatgttgatagtgataatgtctatgacaatatttgcccaattgtacacttcatgtggagattattgtttttagtttagccccattaaagatagtattaattagaacaggtataaattggtatcacaggaattaaagataaataaaatacatgtaaagtcagagaatcctgaatatacacatgaatgagcactggacatctctgtatttttagagaagcactagaatacagcaaaataatggcacaattttacatcactaagaaagtttatcaaacccaccaggcatgttgtattagttcattttcacactggtataaaaaactacttgagactgggtagtttacaaggaaaagaggtatagttggctcacagttctgcatggctggggaggccacaggaaacttacaatcatggtggaaggtgaagaggaagcaaggcacgtctcacagcccagcaggagagagatagaggaggggaagtgacacatacttttaaatcatcagcggttgttagaactcactcactatcatgagaacaacatggggaaactgcccccatgatccaatcacctctcacctggtccctcccttgacatgtggggattagaatttgagatgatatttaggtggggcagaaaaccaatctatatcacatgtccagttctgtcctggagttgtttcagggatccagtgtgtcctgttgatagaaacagtgacaccaagttcatattatcagttgtagttgacaccatgcaaagccaagagatctcaagtgagatttagtgtgtatgttgtgtctaatgaagtcacacactcagagcaagtgaatagggaaaagttcattatctacactgtagaggtgtctgctgagtgcagggcaggtctcccaggaaaatctaaaatggcttgaaagaaaaccaaaggagactggctcagggtttttataatggtttagtggtgggggcaaagtgaagcttcccactcacagatgggggtttatagggtttgaaactcccactggcatcaaatgaagaagctcctgtgagtctgaactagattcatcttgtgtggcaaaaaaggagacgatggaggagtgagccttaagtaatcagcagtcatgcaccaaaagatagagtgacaacttattccatgcagcaggaataaaaataatgaataagaaagaagacaagggttcagtatgggtggacaacacccagatctgcagaaatgagatgactttagaaatgtaagcaaagaataatgagaaaaagaagaagtggatggaaaattaaacaggggcctggtctaatgtcttgggtagaagcttttcacaatcaaggactatcagcttattctgcaggtcttaggtcagccatctgcttaaaaacatcagaaacgccagagggtctatgaggatgctcagtttaacatctcctatttgagtagctttacagttgtgtggaattcttaattgattcttttttgtttgtttttagggacaggctctcacactgttccacagcttaaagtacagttgtgtgatcatagctcaccttaaatttgagctcctgactcacacaacctttccatcttagctttctgagtatctacaactagatgggcacaccacccctaccctccttattttttaaacattttttcatagaaatagcatctctttatgttgctcaggttggcttcgattgcctggtctcataggatttccctcactttgcttctggaagtggtgtgattatagggaagatccactgcatctgacctgaatttattctttagttgtaaaatatgaagccaataattaactgcctgaatgttttctgcagtgagttagttaaaagcatctgataaggttccttcctatgtgattcacgagcagtattttccgctgatgttccttccagtttccttgctgaagatcacagggaattgtggaaaatatgtagcaaaaaggcagccttaaactcttcattgttagagtggatatcacacaggaatcactttcagtattttgtaacacatgcatgcaatagagcaaacatgatctctgggggtaaagtctataaacgtatgggccttttagctaccaagtcatagggtaataactgatgtaccctgaggactggaccatgattccatagtgctagtggaagaacccttgaccaagggagttttacattttattaaaatatgtagagatgccactttttaaacattcccagaaggttgtgagtgggattgactctgtctcgtatgaacaaagacaatgccctccatgattagataatattataaactagattgagctacagtgtttgctgtattgaatcactgtatattttattttttagctccatgttagttttgtgtctgcgtgttagcgttggctttaaaatgatattaatcagctctgtagtaagtagaaattcatctgagagtttctttccttgttttccagtttgataggatttccagaatacataagaaccctctctgtttgtaaaaatattccaggccaggccagtggctcatgcctgtaaacccagcactttgggaggccgaggtgggggggatcatttcaggtcaggagtttgagaccagcctggccaacatggtgaaacctcctttctactaaaaatacaaaaattagccgggcatggtggtgcttgaggattgcttgaaccctggaggctgatgttgcagtgagccgaaattgtgccactgcactccagcctgagagacacagcgagagtccatctcaaaataaaagaaaacaaaacattccaaagttatgcacaatctagaaacatatgtacttaattctcatttttaatttattaaaaagctctaataagttcaatgttttctgccttctcagttgatttcacaacacatataataatatatcctaaataaaagtttgttctcttaatacaaattactagttaataacccttactttattattgaggtattatccatcagtgttcatcaatgctctcaatgggactcttacatagagaatatacaaaatattttcctgatcatgacataaaacagatgtgaacacattcttagtattcagccatgtctcctatcatgttataaaccacatgctaactttgactttattggaacttgttctaatttcaaactagttattttttatcttcatgcagctggattattatgtgtggttatttattccgagagtgataaagacaacattaacaattttcactgcaggcatgtctaggcaaccccctgtgcacaatgaccttggtgcattggagattctatggggactcttccctacctgcctaggagagttctctgccttctacctctatcattttcctctttgaagaaatacatctaactgtcgttagaatagagacaaagacaaatcttaactgcttccagctgacgggggatgctgtttggggaagatctctcttggaggcctgtctaagggaccccaggaaaagggagccattatcccaggcttcagttgcatgagcatttggagtttgatggtctgaaaacgagaaaaggcaaatcagattattagaagacatgtatccaaacctaacaaggtggtcaaggtggtaaggacagtttgaaagaaaattccaaggctgctgacatgcccagataactgcggctgtagttatgcctgctaaggtttgggcgcatgaggcttggcttttgtcagctccctgggatttattttcccaaacaaagaaacctccaggttaggggcaccctattcattcccatcacctggcatgatttaaaggataattgcttagaattaaaatattgatacagatttttttatattccccatcgctttttgtttcttctgggctgtagccagagatcattgattggcgctcaggaataagcagtcagtctaaaatgcaggcaaatacttaaacaactgaagagattagaatttaaagatgatcgtatgatatgttttgaaatacaatttttctctttccagttctggtttttgtcagaatcaagtaattgtaagactgagttgtttgcaaaataaactttagtcttaaacttggcctgattatttgcataaagtgcagcaagaatattaataataattctgtaggaaaagcctgcaagcaccaggagtttcacagtctaacactatgagcacgtgcatcctcacgcaactcgctgaatatttccaagccagcctgttcctatcttaaatgccatccagttgtatctgccccaggtacactaatatatgggtcctgcttctctgcagcctcctctctcctcagatttcaggttttgtttattgtttgttttctctctgatataaactcaaatatgttgaaggtttttttgtgtgtggttgttcaggtttgttgttaatgagatcagaataagataatactttactctttttatttatttatttatttattttttgagtcggagtctcgctctgtcacccagactggagtgcagtggccctatctcagctcactgcaagctccgcctcccgggttcacgccattctcctgcctcagcctccagagtagctgggactacaggcgcccgccaccatgcccggctaattttttgtagttttagtagagacggggtttcaccgtgttagccaggatggtctcgatctcctgaccttgtgatccgcccgcctcggcctcccaaagtgctgggattacaggcgtgagcctccgcgcccggcccatactttgctccgttttatattcccatgctttagtagctgcttttctctatcaaatccattaactgagagaacaaatcacatttagttacaggtgaacaattaaatagtttggcatatatttatgtactggaacataacgcagcttgaaatcaaggcatgcctcactcatataaacaacatggctaaattctcaagtaattctgtttagtgaaagaaactaaggagttaagagtaaattttatatgatacatttgtaggaattttagaagatgccattattgtaaattaacacggagaagatttgagtttgtctgacaatacgctgttgggagtaatgtggatgtgagttgaatttcagagaaataaaagaaagatttagggattaatttaattattcaaaacttgattgaagtgctgagcaaatggctgcaaacataggtcaacatttttcaaatccttcactataaatttgaattaattacttattaattacacttgaataaagcaataacgaagaaaccaataaaataacatttgactaaaatggagcaataaacagatcgatgttaacacaaggaatatgactgacttatgaaaacatgcacatgaaccatggttcactctacgtattttggtaaattacagaaagttgtcataacagatggggaatcctgcagacttcactaggcatggtccacgctgccctggagttgtctcaggggagctgcctcctccagtggttagagcacaggcccaggtaataggactaatttttttagatgtgtaattttagacacactgcacaactgctgtgttctctgtgtaaattatctcctgtaaaatgtaacattgaaacctgcattaaacatattgtataaatatgtaagaataaaataagattatgagagctaaatattaatcaaggcacaagcacataatataaaattatattttcctgaatgatacaattattccaatctgtcccaggacacttcatctgccctgagcccagcctctcctcagatgtcccaccacagagcttgctatatagtgggggacatgcgaatagggccctccctctgctgatgaaaaccagcccagctgaccctgcagctctgggagaggagcccagcactggaagtcggcggtgtttccattccgtgatcagcactgaacacagaggactcaccatggagtttgggctgagctgggttttccttgttgctattttaagaggtgattcatagataaatagagatgttgagtgggagtggacatgagtgagagaaacagtggatgtgtgtggcagtttctgaccttggtgtctttgtgtttgcaggtgtccagtgtgaggtgcagctggtggagtctggggaaggcttggtccagcctggggggtccctgagactctcctgtgcagcctctggattcaccttcagtagctctgctatgcactgggtccgccaggctccaagaaagggtttgtagtgggtctcagttattagtacaagtggtgataccgtactctacacagactctgtgaagggccgattcaccatctccagagacaatgcccagaattcactgtctctgcaaatgaacagcctgagagccgagggcacagttgtgtactactgtgtgaaagacgcagtgagaagtcagtgtgagcccagacacaaacctcctgcagggtacctgggacaatcagggaaagcctgggacactgtatactgggctgtccccaggggcaagtccaggtgatataagcctgggtttcctgtcatgatctagggttgcattgttagcaaattaccccagggaccatctctagatttccaattctgtaataacatttgatgtcgtctctgactgcacaatgtcccctcaactttgtatcttttttttttttgtaacaggaggacacatcctcaccctgcagaagcctgagtgtcactttgggggcagaaatgacctgccttgatcacattgatcactgtcctgaggaaaataccccacaggggaccccgatgactccagcaaaggctctgcctcaaaaccattgaagagtccttcctttcattagaattgaccacagcacctgggcttcagcacaagccataccacagacgtcacaaagcagcagcttgacacctgatccaggtgcattttctcacctttagaagctgagagaggggtgtattctcaaggtcaacacactctttgtgggtttttacacagaaaacctgcttttactttatttcatttgaagataaatgaacaaatgtgcatctataaatgattgtaattttcacatttattccaaatccaatatttctgaattctgcatgatgtcctggcacagggttgtgttttctacaggtatttttcatcaaaccaagaaaatgcattttccactttccgtggtttttctccatgtgcagaggccttgagtagagcacgtctgactgtgtttgttttcacgctgctgataaagagaccttgagtagatcacgtctgactgtgtttgtctgttttcacgtggctgataaagacataccagagactgggaaacttacaacagaaagagttttattggacttacagttccacgtggctggaaaggcctcacaatcatggtggaaggtgaaaggcacatctgacatggcggcagacaagagaagagagcttgtgctgggtctcccctttttaaaaccatcagatctcatgagactcattcactattaagagaacagtgcaggagagacacaacccccataactcagtcacctcccactggtccctcccacaacattgagaattatgggagctacacatcaaaatgagatttgagtgaggacacatccgacccatatcattccaccccaggttccctcccaaatctcatgtcctcacatttcaaaaccaatcatgccttcccaacagctccccaaaggctaaactcatttcatcattaactcagaagtccacagtacaacatttcatctgaggcaaggcaagtcccttccccttatgagcctgtaaattcagaagcaagttacaagcattgggtaaacacacccattacaaatgacagaaattgcccataacaaaaaggccccatgcaagtccaaaatccagcagggcagtcaaatcatagagctccacaatgatcacctgtaactccccttctcacatccgggacatgttgatgcaataggtgagttccgatggtcttgggcagctccacccctgtggctttgcagggtacagcctccctcctggctgctttcacaggctggtgttcagtgtctgtggattttccaggcacaaagtgcaaactgtcagtggatctaccattccagggtctggaggatagcagccctcttctcacagctccactaggcagtgccccagtaaggactctgtgtgggagctctggccctatatttcctttcctccttgccctagcagaggttctccatgaatgatccaccactgcagccaacttatgactggacatccaggtgttttcatacatctcctgaaatctaggcagaggttctcaaacaccaattcttagcactctgtcgataatggttcattttggtggcctgttcattactggtattttccaaaggaatctcacttgaatctttactcttttgcattttgtctccatgacaatgttgggaagttttacctccaccatcataacatgatctagtgatctcacacatttgtggcaaacaatacctacaaattcagaagctctttgcttttctttccatgaaatataattctttctgttctgtgtataagcatatcttagcaactctgtgcacacccacatagatgtccacaagcctatgaattattctctgtaaataaaaatttatatcaatttccctcaatgttcataattctcctgagggtgaggaagctccttctcgatctgttcaaacaaaatgcccagaaaccatctggtaggtaaggagttcacctggctctggtgtggggtctgtctctttccctctgttgtcacacaggtcagcccagttgttcaggtcctaagaagaaagcccaggtttgtcctgattttaaaacacatcaaacttctgatgactctcctgttacccacatccatggaggatagattatttattatataattcaccaaactaatgtcaaatgcccaagttgcaataccacacatcctagggtatgttcatgcaattcactggaggagaaagtctttcagagacagatggatctgaaatgataaatatgtgggtaaggactctgggcttgagtatcattgtccagccatgtttcacaagtgtgtcctgtcaggggaaggacaagagttccttgtgttctcagagggaaggggtcacagagttcctctctggttcccaggaaagataatcgcactaatcttcatgatcttcatgagactatcctccagtgctgacctgttatagagtttttgtctgaagttctcactgcaatccccaatctacatattttcaatcagaagtgtttagagggcaggacatatcttcacggacacacattgagaaggatgtagatatgtcccactaccttctcctgagatctcagacagaatcccagatttcaaaaggacacagaaggacagctctcaggtgcttttaaaaaatgacccacttccagggacagggagcttccctataaccatggtggatgttctgaactacaataaacattggatggatccaggattgtttgaagtcactgtcattattacattcagctgctgtttcaatgtgtctgaagtagtaaatgacaatttagatgacaatttatatgaatcttcaagggtagaacaatattgaccatattccaaaatctgtccttgatccatgatcacactcatctcccagaccaggtccttcagcacgtctctttacctgaaagaagaggactctgggcttggagaggggagaccccaagaagacaactgagttctcaaagggcacaggcagcatcctactcccagggcgagcccaaaagactgggggctccctcctcctttttcacctctccgtacaaaggcaccacccacatgcaaatccttacttaagcacccacaggaaaccaccacacatttccttaaattcaggttccagctcacatgggaaatactttctgagagtcctggacctcctgtgcaagaacatgaaacacctgtggttcttcctcctcctggtggcagctcccagatgtgagtgtctcagggatccagacatgggggtatgggaggtgcctctgatcccagggctcactgtgggtctctctgttcacaggggtcctgtcccaggtgcagctgcaggagtcgggcccaggactggtgaagccttcggagaccctgtccctcacctgcactgtctctggtggctccgtcagcagtggtggttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagacacagtgaggggaggtgagtgtgagcccagacacaaacctccctgcatggacgcggaggggaccggcgcaggtgctgctcaggaccagcaggtggcgcgcggggcccccagagcatgaggccgggtcaggagcaggtgcagggagggcggggcttcctcatctgctcagtggtctccgtcctcgccagcacctcgctgtcaccagggctcctctttctttattatctgtggttctgcttcctcacattcttgtgccaggaaagaaacgaggaagacaaattttcgtctatagttgaagcttcaccaattactaggaacttgcctacaagttcctgcatgacccattataacttatcgattaaaaaatatatattctaatgcttctcaccatctcttgatttgtatcatcaactgaattgtaccctctttgaaattcatatgatgaaaccttaaattcaatggatctatattggaattttaatgaaataattaaggttaaatgtggtcataattgtaagaccctaatgcaatagacgtgttgtctttataagaagaggaagagacaccagagacctctcacttttcacgtgcaggcagagaagaggccatgtggagacatagtgcactagaaggtggcccagtgcaagccaggaagaagccgcgccaagaaccagccctgccagcacactaatcttcaacattcagactgcagaattttaagaaaatcagtatttgttgtttaagccacccactcctgttgtcttcttatgaagatccagacagactaataccacataactctgttagtgctgtcccctggatggagaattagcctcctgaggctgggcacatctctcagatttccacataaaacaggtaaaaaatagtagttctgatataaaaacttgtcatgtccctgttggccaatttctgggcaaggtcttttaaataagccaagtttgcggggaaatggagaccatatgtttgtgggactctaaccgtggaatctactgcattgctctagcagaatcaaaaattgaacaccagtgagctctttattctcattaaaatgtgtgtctttggaaatgttaacattctgtccagaatctgtgctcacaaacaactgtgtttcttagtgcactcttggcctggtggagccctcgcagaccctctccctcacctgtgctgtctctggattttccatcacaaccagtgtttcctgctggagctggatccacgagtccacatgggaaggactggagtggaccaggcgcacacgtcatgaagggagcaaaaattcccacccactccttatgaatccagtcaccatctccaaattcgggtccaaaaaacacttgtttttacagtggagctatgtgagcaacaagctcacagccatgttttaaagaagagacagagtgaggggaccacggtgcgagctcacacccaaaccttcctggaggggtgcacaggacagcaggagtcccgatgatggaagggggtggtctggattccaggtcactctcaagatcattgtagaggcactcagctcacccgggggctctcaggagccatcgaggtaaatcaggacaccagaagagactcggtacagcagggggctctggaccattgtggggattcagaaacagcaggttctaggctcagccttagggcaggttgagatggggtgaaaaggggctggatgagggtgtttgtgtcaccataatatttcaccactagacacccgccactacatgtgttctactgcatatgagtgtatgattagaaaatcatacttctataaatatataaccatacgaaggtgtgtcaagttttcctcttcaacttctatcggccttgttcgtaaggactaattccctgtaattacttgaggacctcataaattgtggtcaggtttgtaggtttcctctctttccttgtctccctttccccttattctctctcacacaaatggacataatccccactccacacgcaaagaaatctataactttcattacctgatgtattgaataaaattgattaatgtgcagctttcccatctttgttgttgttcatgctgctgtaagtataagaaccatgagattctcagctgtgtacttctccaagctgagtggcagctttgcttatcatactgagatggccaacaatccaaatgtcaatcatcagcttaactggtaaacaaattgtggaaaagtcattcattggcatactactgactgtgaccacaatatactaatgttggatacgctcaacagtatggttaaattctcatatggtgagtaaaatgagccaaacaaataaaagtacacacatatgataccacttttatacattctcccatccaagtactaaccaggcccgaccctgcttagcttccgagatcagacgagatcgggcgcgttcagggtggtatggccgtagacacacttttatacattctatagaataaaaactaaagttacataaagaatcagtagttcactgtgaatattatagaagggaaagtgtagacaggaggaattacagaaaagagaaaattttaagcataattgacttgttatctatattgataataatgatgtctatgataatatttgtacaattgaacacttcatgtgaagatctttttttttagtttaacatcattaaagatagtactaactgtaacgtgtgtaatttggtagaaacggagtcagacagagataaaatacataaaaagtcagagacacctgaatattcacatgagtgagcctgcacttctctatgtttttatgaaaacactacaatacagcaaaataatgacatcattttatgacgtgaagggggtttattaaaccactccaggcacgttgtattagtttgttttcccactgctacaaagaactacctgagtttgggtaacttataaagaaaataggttattgactcatagttctacatggctggaaaggcctcaggaaacttgcaatcaaggcagagtgtgaaggggaagcaagagacatctcacatggcagcaggagaggtggggagaaccaccacacactttaaattatcagatctcctgagacctcaatctgagacctcaatcatgaaaacagcatggaggaaccaccccatgagcccatcccctctcaccaggtccctccctggacgtgtggcaattccaattcgagatcagatttgggtggggacacagaaccaaaccatatcacatgtccagttctgtcccagagttggttcaggaatcagatgtgtcctgttaacaggagctgtgacaccaagctcccagcaccacttgtagttgacgtcatgcaaaggccaagatatctcaactaagatttagtgtggatgtgatgttggatggtgacacaccctcagaccaagtggatatggaagggataattatctctattctagacgtgtctgctgagagcagggcagttctctcaggaaagtgcaaaatggcttgatagaacagggaaagagagggcctcagggtttggtggtgggggcagattgagtctttccactcacagaaaggggtttatagggtgggaaactcccactggcttcaaataaggaagctcctgtgattctggaccgatattcaccttgtgtgtaaaaaaggaggtaatggaggaatgagccttaagctatcagcagtcacacaccaaaatacagtgtgacaagttattctatgtagcaactataaaaataatgaataaaaaacgagataagggttcaatatgatgggcaacactcaggtctacagaaaatgagatgagtgtttataagtcaaagcaaataataatgagaagcaggaggagggtgtgcagaattagacaggggtccaggtccagtgacttgggtggaaaccttttgctattaaggattatcagcttagtctgaaggtcttaggtcagctatctgtttaaagacatcagaaacaccagagaatctttgaggatgctcagattaacatctcctattttagtagccttgcagttgtgtgaaaaccttttttatcttatttcattttattatttatttatttatctgttgagatggaatttcgctcttgttgcccaggctggagcgaaatggcacgatcttgactcaccgcctcttccacctcccagattcaagcgattctcctgcctcagcctcccagtagctgatattacaggcatgcaccaccaggcccagctaattttgtatttttagtagagatggggtttctccacattggtcaggctggtctcaaactctcaacctccggtgacccgcccaccttggcctcccgaagtgctgggattacaggtgtgagccactgctccgggccgaaaatcttattcattcttttttgtttgtttttagagacagagtctctctctgttgcacgttgaaagtggagtggtgtgataacagctcactgtaaatttgaactcttggctcacagagtatgttcctatgtatcgtgcaggtgtgtctgtgtgtgtttacccggcttggggtcctctaatttttggatctgtagttaggtgtttcacattcttaagatatttttcttaagaaatatatcttaagatataagtatatcttaagatatcattaattcttaagatattttctctgtttctaatttctatttttgaaatttgaaatatatctacactatactttttgatgttagttcttaaatttcttcactctttttccctttgaaattcactttgtgtaatttccagtaacggagttgaagtccctggtttcatttaagagctgagcgaattctactgctgagcgtgcccaaggtatattcaactttatactgcatcacttttgataattttatgaatttccatttgattctttcttagtatttctctctgtcagtcacctatctagtcttgcactgtgtccacattttctttcagatacttttaacaaattcaattactttaaatatcctacttaataagatagttctagtattgtgtcatttacaaatatcaattctgaggatttttccattatgactttggtgttttttataacttatatgactttgatgaatgttataatttttgttgataaccagccatatttggacccttgatattgacgtattattttattttgtgcatttctgcctgtatttgaccacaccctatctgtgctgggccttgattgtggagatgtctgtgcatctcttcagagctacatttgacatttacttttgcaacggctgtagcagttgaagtgtgttcttctatgtccactggagacttcagatactctagtgataccttgttttcatgcctgcttggctttgtctattcacctcattccattctacagagaatctccttcacattcctagggtggattaaagtgttatatttaactgccaattgtgaaattggcggaaggcattagactaaaggaagaaactgacctctcgttgggccataattctagaaagccgttgtgatcctgagtctgagtgtgaccttccaagttttcccgaccctcctgcaagtgagatactggtctgtgtgttcttgcctcttcccctggggtagagtcctcctgttttccccagttgttccctcccacagctctcacaatctctgttggtgtccccatcttccagatctgctgccatgacctgcagattaaggctctgattccataagaaactgaggggagctgcttctcaatagatctttgatggggacctctgttcccatatcagttcatgaggggctgctccagtgccctaggatgctgattttcatggcttgctcctgcagggtaatatctgagtttcatagtgggaatcagagagttgggtctggatgcatttcagaagtgtgggctctcattctctcccagacagtcactttgggaaggatagattcttgtgactgtaaaggttcttcaagagaatagcacaactcttcagtatgttgtcccttagaatttctcactacaacacgcttaacacactcgacttcaagcaatgcaatgtgtatttgtgctccatcttgtaatggcctacgttgaatacgacagactgtgcctcaggtaatttcatatcttgactttattactctgtacaagaacttgcctctccctagatttcaattttttttgttttaaaccttcagttatctgaagcatttaataaaatttgcgaacttccatcttttctgtttatctgttattgctgatgttattgttttaaaaataaatatatatttctcattcatgtacatttttaagctgagcagcatatttttaagtaaaacctggaataataaaagaatccaaacatttttcagctgccccaaaaaaaccaaattatggtaaatgtgttcactggaacactactcatcacttataataaatatatttctggtacacagagcaacaaagaaaaatatctaagtgtttatgctgagtaaaatacgccagacaaataagaatatgtaccatattactccatttatgcaatttcttttaagtgaaaaagaatctaaagcaatatccagaagatcagtagttacctggaaaaagggtagaccaaaggaaggggaaaggaggaaacttacagaagaacaagagaaaatgttgaggggagttcacttgtccagcttggaaatgatgggttacatcatgttgatcaattgcacactttaaatatgtgaagtctattatctgccaattaacactcgcaaaatttattgcaagcagacaaatgaaaaattagacagagagaggatggtataaagatagaaaatatatattaaatgtcagaaatgtctgagaatttaactcctgaccctagttccgtccttatttttaggtgaatggtagcgtgcaccaaaatcacacacattctcagtacaggaagtgggttccacaaagcacacgaggtatgtccaattcttaccaagatttggttcagggagtaacagtgatgaggaatcacaggcccagataccggggctcactcatctcagacatgacctcgtggacacacacttagcccctcctccatgtgtaggttgacttccacatatgtaaatggagaaaccattgactcctacagaacataatttacagaaatatacaaaagataaaatagtgcaaatacttatcacaacaaaatttcctaataagacagtgtattttccaaataccgtaattgtcacccaactcctgtggggccgtgtcattttatctggggtctgccgtctcctcaggattcccaccccagagctctctatgtagtaggagacaagcaaatagggccctccctctgctgctgaaaatcagccaaatcctgaccctgcagctctgggagaggagcccccgccccgggattcccagctgtctccacttggtcatgaacactgaacacagaagacacaccatggagtctgggctgagctggattttccttgttgcagttttaaaaggtgatttatggagaatgagacacactgagtgtgactggacataagtgagagaaacagtggatttgtgtggcagtttctgaccagggtgtctccgtgtttgcaggtgtccagtgtgaggtgcagctggtggagtctgggggaggcttagtaaagactggaggggtctctgagactctcctgtgcagcctctggattcaccttcagtagctctgctatgcactgggtccaccaggctccaggaaagggtttggagtgggtctcagttattagtacaagtggtgataccgtactctacacagactctgtgaagggctgattcaccatctctagagacaatgcccagaattcactgtatctgcaaatgaacagcctgagagccgacgacatggctgtgtattactgtgtgaaagacgcagtgagaagtcagtgtgagcccagacacaaacctcctgcagggtacctgggacaaccagggaaagcctgggacactgtatactgggctgtccccaggggcaagtccaggtggtataaggctgggtttcctgtcatggtctagggttgccttgttagcaaattaccccagggaccatctctagatttccaattctgtaataacatttgatgtcgtctctgactgcacaatgtcccctcaactttgtatcttttttttttttgtaacaggaggacacatcctcaccctgcagaagcctgagtgtcactttgggggcagaaatgacctgccttgatcacattgatcactgtcctgaggaaaataccccacaggggaccccgatgactccagcaaaggctctgcctcaaaaccattgaagagtccttcctttcattagaattgaccacagcacctgggcttcagcacaagccataccacagacgtcacaaagcagcagcttgacacctgatccaggtgcattttctcacctttagaagctgagagaggggtgtactctcaaggtcaacacactctttgtgggtttttacacagaaaacctggttttactttatttcatttgaagataaatgaacaaatgtgcatctataaatgattgtaattttcacatttattccaattccaatatttctgaattctgcataatgtcctggcacaaggttgtgttttctataggtatttttcaacagaccaagaaaatgcattttccaatttccctgtttttcctccatgtgcagagaccttgagtagagcacgtctgactgtgtttgtctgttttcacgctgctgatgaagacataccagagacgaggaaacttacaacagaaagagttttattggacttacagttccacgtggctggaaaggcctcacaatcatggtggaaggtgaaaggcacatctgacatggcggcagacaagagaagagagcttgtgctgggtctcccctttttaaaaccatcagatctcatgagactcattcactattaagagaacagtgcaggagagacacaacacccataactcagtcacctcccactggtccctcccacaacattgagaattatgggagttacacataaaaatgagatttgagtgaggacacatccgacccatatcattccaccgcaggttccctcccaaatctcacgtcctcacatttcaaaaccaatcatgccttcccaacagctccccaaaggctaaactcatttcatcattaacacagaagtccacagtacaacatttcacctgagacaaggcaagtcctttccacttataagcctgtaaattcaaaagcaagttacaagcattgggtaaacacacccattggaaatgacagaaattgcccataacaaaaagaccccatgcaagtccaaaatccagcagggcagtcaaatcataaagctccacaatgatcacctgtaactccccttctcacatccgggacatgttgatgcaacaggtgagttcccatggtcttgggcagctccacccctgtggctttgcagggtacagcctccctcctggctgctttcacaggctggtgttcagtgtctgtggattttccaggcacaaagtgcaaactgtcagtggatctaccattccagggtctggaggatagcagccctcttctcacagctccactaggcagtgccccagtagggactctgtgtgggagctcgggccctatatttcctttcctcactgccgtagcagaggttccccatgaatgagccaccactgcagccaacttgtgactggacatccaggtgttttcatacaccttctgaaatctaggcagaggttctcaaaccccaattcttagcactctttccataatggttcatttttttggcctgttcattactggtatttttcaaaggaatctcacttgaatctttactcttttgcaatttgtctccatgacaatgttgggaagttttatctccaccatcataacatgatctagtgatctcacacatttgtggcaaacaatacctacaaattcagaagctctttgcttttctttccatgaaatataattctttctgttctgtgtataagcatatcttagcaaccctgcacacacccacatagatgtccacaagcctatgaattattctctgtaaataaaaacttatatcaatttccctcaatgttcataattctcctgagtgtgaggaagctccttctcgatctgttcaaacaaaatgcccagagaccatccggtaggtaaggagttcacctggctctggtgtggggtctgtctctttccctctgttgtcccacaggtcagcccagttgttcaggtcctaagaagaaagcccaggtttgtcctgattttaaaacacttcaaacttctgatgactctcctgttacccacatccatggagatagattatttattatataattcaccaaactaatgtcaaatgtccaagttgcaataccgcacatcctagggtatgttcatgcaattcaatggaggagaaagtctttcagagacagatggatctgaaatgataaatatgtgggtaaggactctggacttgagtgtcattgtccagccatgttgcacaagtgtgtcctgtcagggaaggatcagagttccttgtgctctcagagggaaggggtcacagagttcctctctggttcccaggaaaggtaatcgcactaatcttcatgatcttcatgagactatcctccagtgctgacctgttatagagtttttgtctgaagttctcactgcaatccccaatctacatattttcaatcagaagtgtttagaggccaggacacatcttcaaggtcacacattgagaaggatgtagatatgtcccactaccttctcctgagatctcagacagaatcccagatttcaaaaggacacagaaggacagctctcaggtgcttttaaaaaatgacccacttccagggacagggagcttccctataaccatggtggatgttctgaactacaataaacattggatggatccaggattgtttgaagtcactgtcattattacattcagctgctgtttcaatgtgtctgaagtagtaaatgacaatttagatgacaatttatatgaatcttcaagggtagaacaatattgaccatattccaaaatctgtccttgatccatgatcacactcatctcccagaccaggtccttcagcacgtctctttacctgaaagaagaggactctgggcttggagaggggagaccccaagaagacaactgagttctcaaagggcacagccagcatcctactcccagggcgagcccaaaagactggggcctccctcctcctttttcacctctccatacaaaggcaccacccacatgcaaatcctcacttaagcacccacaggaaaccaccacacatttccttaaattcaggttccagctcacatgggaaatactttctgagagtcctggacctcctgtgcaagaacatgaaacatctgtggttcttccttctcctggtggcagctcccagatgtgagtatctcagggatccagacatggggatatgggaggtgcctctgatcccagggctcactgtgggtctctctgttcacaggggtcctgtcccaggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagacacagtgaggggaggtgagtgtgagcccagacaaaaacctccgtgcagggaggcggaggggaccggcgcaggtgctgctcagcgccagcagggggcgcgcggggcccacagagcaggaggcccggtcaggagcaggtgcagggagggcggggcttcctcatctgctcagtggtctccctcctcgccagcacctcagctgtccccaggggtcctctttctttattatctgtggttctgcttcctcacattcttgtgccaagaaagaaatgaggaagacaaattttcgtctgtagttgaagtttcaccaattactaggaactttcctagaagttcctgcatggcccattatagcttacagattaaatatatatcaagcttctcatctcttgatttgtgtcatcaactgaattgtgccctctttgaaattcatatgcagaaaccttaaattcaattgatgtatattggaattttaatgaaataattaaggttaaatgtggtcataagtgtaagactctaattcaacagacgtgtcgtctttataagaagaggaagagacaccagagacctctcacttttcacgtgcaggcagagaagaggccatgtggagacgtaatgcactagaaggtggcccagtgcaagccaggaagaagcctcaccaagaaccaaccctgccagaacattgatcttcaacattcagactgcagaattttaagaaaatcaatatttgttgtttaagccacccactcctgttgtcttcttatgaagatccagacagactaataccacataactctgttagcgctgtcccctggatgcagaatcagcccgctggggctgggcacatctctcagatttccacataaagtaggcaaaaaatagtagttctgatataaaaatttgtcatgtccctgttggccaatttctgggcaaggtcttttaaagaagccctgggggctttgtcacaaaagttgccttttatcatttattaggacataactgatgaacaatgagtaccagttggatggagactgaccactgaccatcttctgctgtctcctaagtatgccacagaaaaccacaccaacattactctatgtcttcaactttctaaatttgcactgattggtatttaaggcaggcccagcgttgaataactcctttagtttttgcttctctgggaaaggtcttatctatcctggccttggtcttcaagtttcagcaattctgggaagccaaggacgcctctatctcctcctccatgctctgcaactcacctgagaacagctttctcattggaatgtcttctgtttaaggaataagagtccctgtttcaggcttgggtgcctgagtacacctactggatccagcccaggattggagaaactttccagaacacatcacctgagaaatgaccagtcacactgttacactttcacaatttccgcttcctcatgagaaaattaaaattgcagagactttttcataagcgttgtgccatgtcctttcttgttttcttgcctgttcatttatgtcagaccaggtgccacatctatgtaatcaggttagaatcctgcctccagtaacacatgaaaaggacctatggttgtacttttggtctttgctccaaagtgtaaagattacaaaagtcatcaccctcattcttatgccaagagtcatctgcacaatctgatcttcaatacattttagaatccatcaaatgaatgaaattccattttttaaattaccaccccaaaaactagagagatgggcatgtccagaatagcagttgatggttgcttaactggaagagaagtttcagaagccacaagctgttgaaggcacttacgtggttagcactatagacgtctgcaagacagatgtggactagggtgaaatgacagttccagagggccgcactctcctcagtcttctggaatttccctctagaaatctccagaatctaaaaaatacaatccaaatatgtttcctatgggtcataactggggaagtttaattactgaaaaatataccaggagccttctccaaaagatcctacagggaagaacttttccagaacctcatactatgtgaagggaagaaaaatctgcccattccagatccctccccacttcctccattattatacaaatgagtaaggttagccaatagggtaagatgtaagcaaatagtccagggaaactgaagccacaaaaaggagtaaagatgaaaattcagcttttcccctggagatgcctggtcaaggtcacagcccagaaaaggaatctgattgagtctctaggtttccatggtcagaacaagcagtgctgacccgcactgcacaatcctttctaaccaggatgatggctctggattaaatatgagagtgtgccaatgcacagtctctgaggagaacatagggacactaaaaaagcaatggcagggagttagacaaggacagtagagcaatatgaagcctctgacgtgaacatttttaaaaacaagatcttggaaactccctcattcacctcagcttcttttatcatgaagactttccaagattcttaactgagacaaagaaaataacaacctgcatgcacttccgaagtctccgcttgtatcctgtttgctttagatctctaggagaaaaatgtcagacacctgggcctagtgtcaatgtgggaggcactttctacagatgaggcgcaagaaggaagggaaaacgtgtgttattggaatagtggatatgaagtgtgctctcatctgaaagcatctgcacctgctggaaatctcagatgcaacattcaactgcaagaaccaaggcacacccaaatctcctgtaagattttggattcattatccactgattcagtgcaactggagcttcagagaaggggctccctcctgtgtcatagcatccttgctttgagttcattagatttagtaaggctaatcaattgtttgaagagatggtgtcagcagcgtatgctgtcactgaaggagtattctaaaccaggacaaagccatttcatgttaggcgagggaagctggcggaaaatgctttatgagccccacaggaacttccttgcaaggcaagggctgggctggagggggcgcgcaggaaccgcccagcacaggttccatccccggaggggtgcacaggaggctggggacgaggttccctctcagcgcctgtgtcttcctttggcaacaaaaaaaatcctaagtgttcaagaagttgctgatgtgtctttaagtatcctgttccgtcagagcctttcctataactgaaggcaaccagaactgtgttttaaagtcggttccgaggactgcaagtatcttaatagtgaggatataaaggataggaatggttttactaattgaaaggatacagaattgtggggttccgaggactgcaagtatcttaatagtgaggatataaaggataggaatggtttcactaattgaaaggatacagaattgtgggagtcactatgttcctatgaataaaaaattcagatttcagtgttaagtaatgttgcctacattgtgtgagtgacagggcagtggtggatctgagagtgtggcaggtgcacagacctagtgagtcagaaatcaatatggaaagatgaggatctatggatatgaactgaaagtaagtaaacagttcatgaaattctattaaatggagtaggaaataaaacccaaacttatccaaaacacaaattccttggcgattattttgggagcagtgagttcatcaggaaccccaaacttctcttacgtcttctgattcctgttgtccatgagatgagaaattcagctctaattgtgcatcacagggcaaatctgtaaaccaggagtgtttctattgaggatcatggtggatcaggattccaggcaggtgctggagacactgtctcaggagcgcccagatgatctcagggggacctgctggacactcacgtggaacatcagcagtcactttctcagagtaaccagtgagctgtgctggtgcctgatgggactaggatggggtcaaggcaccttctcagtgtcatggagagtgattgttccagaaatcatccaggtggtctctacgctaatcaaatatgggttcacagggaggaacatgtgctctgggtgcttggtcttcagtgaaaggacgtctggccaccaaaagtttgtaaatggagcagggcatgcatttcctcaaggaggattagggcttggagcatcagcatcccactcttgtaaggctgatgtgtcatttaccttccctttcttatcccaaatcagggtcttcagctatgaaatgctctgactcatgaatatgcaaataacctgagatgcactgaggtaaatatggatatttgtcagccctgagagcatcatccagaaaccacatccctccgctagagaagcccctgacggcacagttcctcactatggactggatttggagggtcctcttcttggtgggagcagcgacaggcaaggagatgccaagtcccagtgatgaggaggggattgagtccagtcaaggtggctttcatccactcctgtgttctctccacaggtgcccactcccaaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcagacacagtgtgaaaacccacatcctgagagtgtcagaaacgccaggaaggaggcagctgtactggcatggaggggatgacaaaggttattagattgaagattttcttagaaaacgacttcaagtcattaaagaagaggaacaacataaatgtgtatttgtgaaattttaattgagagatttttcatacaacatttattctgtaagctatttcagggattggaatatgaatcaaattaataaagctgatatagacatcctctgaaggcatcttcgtaaacatcaatttctgaatcagtgttgtaaatattttggaacacagacacaagatcacatttttactctacttttatctctatttttaaaaaatgccaaaaagaatcttattttgtgcatgccccattttgaattcccaccgtcaatgcatgatagttcttggttttcctcattcaagttgtcatttgtcattaagagtgttgtgtgttttaaccattctaataggtgagtaacggtatctaatttttatttaaatgcacatgtccctaaaaaattcatatttaacaatttttatataatttttggtgagatgcctctcgtgatatttggttcattttttaaatgcattttttatcagttgtaagtatgcttgcatattgattataaaagtcatttaacaaattaaaataattcatttaacaaatatgcatcttggaatttttttctccaagtctgcagttgtcttttactcccttatccctgtgtattgcagaaaaatgtttgtgtgtgtgtgtgcctgtgtatgtacaaatttagattttaaaaatgtacatttttattcatttaaagatcatgtctttggcagtatatctgaaatctcattgtaaaagacacaatagtcattattttttccatgtctctaatcttaggacacaatcaactcatgagtgtttaaccttccctacctgattggaggactatccacctgagacatttggaatacttctgtaaggagatgtgtccttcccattatttctttatttagtcatctattgatgttcctattggtttatggatgtctatttcatactccgaagaagatccttgttacattacttgttttattgttcaaaacaccacagctttattaggtgctgggagctcatttagtttggatcctgcatccttacagcacacctcatctttttgtttttagacatttccctgtttccaagtattacaataaattctaagcttgttctctacgttaccttttttgtacatagaatcagccatttttctaaagactgctcgtttttcatgttaaagaacagtattgaaatttaaaaatgtgatcctgggtatgtgtgttgttaatgtggtatcagtacttcttctaggatatctccaccaattggcctagtaaatgggcatgtttataggaacccaagtttatggacacatcgaaactatttatgtatctaatcctctgtaatgtgattacattaaaaatgagaacacactggtgtctccatccaactatgctaccatatggatgtttccagccttccttccctcactgtccataaccacccactgcaaagtgaggaaccccatcccaccatatgccattttattacttagctgcacaatttcaggacacatgcatagcagtatcagaaatgtaaagctcgttggaaacatgtttatctactagaacagactgcttatgtgcagtttctttacactgtaaacttatagaatttcttcattttcaaagttgcttaggtcagcaacttcattttccactctcctcagtgaagtcatttcaatgacaatgtataatgtcatttatttgaaattctttcaaagccaaaactatagtccggtaaacatatagaggatattcaaggaatttagagagtgggtataaaataagtaaaaatggcactgtttaagaagagtaaaattgtttttagtgatatacaatggttgagacacaacacaattaatttggctaagctcatacttttgtgacagaaaatataaacctaaatatatacaatttttgtaaaaaaactttagcagttcattaaccccagggttaaacaagactgtgtaaaattatctaataacttatttgatgagggtggggatatcatgagacatatgcaacaaagaatgaaggcattttcctcatttgcatgtaagatgttaccattcactaaagacctttaataaaaaaaaatttctacgtgatccagtatttttttccttctgtcaagcaaataactcataggattcttttctttccttggttgagaaagattttcctacaagcttcagcacacgtcaggcatacactgtccctgaatgggcatttaccctcagatgggtacacacacctgtcaacatgggggctcttctgtcagacaaacacacctttactcatgtggattcttccctcagacaaacacacatgtccccacgtggactctttcctcagattacaacatttgtccttacatttactatttcctcagaaaacagacattgcatcatgtggtctcttgtctcagacaagcaaacatgtcttcagtcagataagtctgtggatttccacattgactgtttccttacacaagcacctatatccaatatttaactgttttgtgagaaatttatcccttttctctggaaatgtatttttatgttcttactggacatattttttaataatgtttggtactatgaagatacccgaacactgtccatacgagagaataagaaagagtaataagcagattaaccctgtgcatccagacccaggagtcctttgatcctgcccttccgaaatggagacacagaggaaggatgagcaatgctgagcagtgcacccatgaccacaaaaggaaagacatggcaatgtgtcccctcccctcctcatgaaaggcagctcatcccctgttccttcaggccctggtgaggagccaccccatgtatattcccttgatcagtgtccacaccatggggtctgcactgatctgggcttcccttctcatcaccctcaatattagtgtcccttgtgaatcaggtccagctgcggctgttccacatggggccgttcttccatttcctcagtgtttgcagaagtcctgtgtgaagtttattgatggagtcagaggcagaaaattgtacagcccagtggttcactgagactctcctgcaaagcctctgatttcacctttactggctacagcatgagcttggtccagcaggcttcatgacagggattggtgtgggtggaaacagtgagtgatcaagtgggagttctcagagttactctccatgagtacaaataaattaacagtcccaagcgacaccttttcatgtgcagtctaccttacaatgaccaacctgaaagccaaggacaaggctgtgtattactgtgagggacacaggagagggaatatctgtgtgagcccagacacaaaaatctctgcagagagacaggagggaactgcatggtagatgctcctcataaccacaaaggggcagtcaggaccatcaggaggagctcaggacacctgggggtgctcagaaccatgaggggtgctcaggacatcgggggctctcagaaccatgaggggtgctcaggacatcagggggctctcagaaccaccagggggcgctcaggacacctgggggcgctcagaagcatcaggggtgctcaggatatcagagtgccctcagtaccacgagggggcgctcatgacaccaggggcactcagaaccaccagggggggctcagtacacgggggttctcttaggaagcagctccacatcaggagcctgagaggctgtgattgcgttttaaacctgggtgattcccgacctggtcaagaaaaagtctcccccaggatctctcaccatttcttcttggtaattccatgatttttttttacctacaaaacattaagttagaacagggatttaattcaacttttaattctgcagattttccgagtaatagtagcaatgttccctcaggacaatttttaaaattggctatttatatattttatttatgtaaaatgatactatcttgaaaatagtaaaatttttaaaatcatacctctaatcccagcactttaggaggttcgggcaggcagatcagttgcgctcaggagttttagaacagcctggcaacacatttagatcttttccatacaaaaagaaaaagaaaaagaaaatagctaggtgtggtgctacctctggtaccagctatttgaaagtctgaggtgggaggatcccttaagcctgggaggttgatgctgcagtgagctgtgattgtgccactacactccggcctggttgacagagtgagaccctttcttaaaaatacaaactgtttcaataagtagagctttgtgtctttgtgctgtaataatcagttgtatatattttctaactgtaactcagcatatgcatggtgttctgtttctttttctttcatttgctgttggtggaaattaaacacctctttaaacgctcttgttctcccctttggttcgcttcgggtgtcctgtttaacagactatttcttcatcttccctttttctttgaaagtctttttctttctcagtttccatgcaggataaagaaagtccctttactttctgtcctccaagtctggtgaacagctcccttctcttcataaccactgaagccaaccaagtttaggaggataacagctctccttagaatatgctcgtctacctggagactctctgccctcctcacccttttctagggtcctgcacacatcacactcatcccatcccctcccttccctaagtaccacagagtgggctctgcagttcctgcttccctgtgtgtgctcagccctggggctcactagtgctttgatgatgacgttcaaatccccatgtgcttagactctctaagaccaccctctaggaagatgccattgtgagtgagtcctggaaatcatgggctgtgttcagtttcatattgctggatcttctctattttaaaggaatactggcaattaagattagagtttgtattgaatattcatgccaaaaaagttttctttcaaaacttttcaaataaaacaatttttcctgcctagtttgaaaactacaatgtaaattcaacaaataatataatacaattttaaaggtgacgtttgtcttattggttattcaatttattaaaaacagaagatatttaaaataaattccattgcacatttaagtgatgtatttgacaagaatggcatttacatacatttttaccaaaacacgtatttaaatatatttgtctttttaatattggtagaggcagacatacacgtagaaaagcatcattttgtactacaatctcaaactgtaaacacaatttaaattcagttaaataattagaataatatgaaacaggccgggcgtggtggctcatgcctgtaatcccagcactttgggaggccgaggcgggcggatcacgaggtcaggagatcaagaccattctggctaaaacggtgaaaccccgtctctactaaaaatacaaaaaattagccgggcgcagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaatgaaacaaataggtgcgttgttttggtgtttagatatacattcacttttgcatgggcacatgtatgtgtctttgctgggctgttgtgtatgtatgtgtgcttgtatgaccatcaagttttcaaatacatcattaaatttcatagttacattcgtcttggccaggcacggaggctcaggcctgtaatcccagcattttgggaggcttaggcaagcagatgacttggagttaagagttcaagaccagccttgtcaacatgccaaaaccccatctctacgaaaaatacaaaaattagccaggtgttgtggcacgtgcctttagtcccagtgcgacagggaaatgctgggtcagaaatcccacacaaagtctctacttggttaccacctaatggaactgtaggaagaaagccaccatccttcagaacccagaatggtagatccactgacagcttgcacagtgtgcctggaagagccagaaacactcagtgacagcccatgagtgtagccagaagggagattgtgccctgcaaagccacaagggcagaactgtccaagaccatgggaacccaccagttgcatccggtaacctggatttgagacatggagtcaaagaagactattttggaacgttaagatttgactgcccagctggatttcagacttgcacgtggcctgcagtttggaccaatttctcccatttgcaatggctgtatttacacaatgcctgaacccccattgtacctaggaagtaacttgcttgttttttattttacaggctcatagatggaagggagttgccttgtctcagaaaagaccatgggctgtggacttttgagttggggctcaaatgagttaagacttcaggggcctgttggaaagtcatgaatggttttgaaacgtaaggacattagatttaagaggcgccagtgttggaatcatatggtttggctgtgtccctgcacaaatctcatcttgaattgtatctcccacaattcccacgtgtcgtgggagaaacccagtgggaggtgattaaatcatggagggagttcttctttgtgcgttattgtgatagtggatgactctcatgagatctgatggttttaaaaaacgggagttccctgccctctctttgtctgctgccatctccatgtaagataaaacttgctcctccttgccttccaccatgatgtggaggcctcccaagccatgtgtaactgtaagtccattaaactttttcctctataaattactcagtctcatgtatgtctttattagcagtgtgaaaacagactaatacagcaaatatcaatctcttaaaatattttgttgttctgcatgtaatatagcacagtctaatatgggaggtaaaataaatcatccatggaccttcagatataagtcatagggtaattatgcctgtgtccctgaaggagtgaactagaggttatacacactagtggcactacctttggcaaagggtgttcaggggtttctgaaagttctgataattttaattttaaaattgaatttactatgtatttcttcatcaacctttccagaagatttttggcagtaagaacagcctagtattggagtaatactgatgaattagagagttattttgtaattattctcctgagatttgcatgaatcaattgatatagaagttcgtatgtcccaagttgaaacatcagaatcaagaaggcttcatcacccttaatggctgtggtttttggcaaggcagtacttcaattcagccagaaagagagacaacaataaaactttcaaatgcaggggagtctgacctcagtctctctctcttataaaggcaaaggcaaagctgtgccacatcaagatttttcttcaagccttcagagtcaacattgggaatggaaaagccaatcactttgtccttagagaaggcgaagatctgagaggaatgcagagttgtgttcatgaaggtgatgacattgttatttcttctcctttgcccagtgactgctttcaagttgagtgtttcagatgtcagacctgacttatagggatggttgtgactgcacgtgtctgacaggggctgagactctatatctctaagtgtcctgtcctaggagcagctacaggagtcagccctagactggaagtgccctcactgaccctctgcctcacctgtgcagcctctggccagttgaagaaagttttatccctggaacatcttttgtcaaaaccactccaactagtattcatgacctatggtccacaccctcaagtacacagacatgatcatgctatgacttggtgtctagaagatccctgcacttttaattttacctctaatattagactccactttatcacatgcggacacagcagaatattttaagactttcatatgttatgctgaaaaattcaatagttcataaaagtctacttcccatcactgccagtgtttactactgagtaaggatctgccatcccctagggaggaactataatggatggtgtgccctgttagtggttatgggaatgaatccatcttgtggcaaatggcagcatcttcttgttttgcaagattaaatagttttctatggtgtataaatacaacattgtctttatccatttgtctatctactgacactcagattgtttccatatattggctaagattaatagtgtttcaataaacataggattcaactatcttaacaaggtggtaatttcatctgctttgggtatatttctaaaagcagaatttctggtcatataacatttccagttttaattcatttggtgcctttatattgctttccataattgtgaaaatatagagtggtatagccattatgaaaaacagtttcagttttgaggtatgatccataaacaaataatgtttgattatggctctccatgagaatttctaataaatatgatagaagtcaagaaagcgtctcacattaaagcaaggattaattttatcccttactccctcaaaagcaaaagattggaagcatgcatgatggaggctgttagcagggttcagaatgatatcataaaaggaaactcagttggataaaaatgttgggctttcagtcataggtatgtcgatactcaatatgaaaccgcgaagtcaaatgaggatctagaatgtgttcacttgaaccaacagcacattctcagacgcacctattgctgcatcacaagggtgatgaacttttgaaacaagtaaagtgtgagtgcacagtaagtgataaagttatcacctttacatgaagtttgttcaatatgccaaaggcttgtacagattaatcatacacaaatatacacaatgtatttttgcatacacagatgtctagaggatgattcttttagggaaaattcttcaggtcacagaaatctgtgtaagttggaggtcccatgaaaaagtatctctttataaatactggtctattgctcaattagggaaaatgatctctgttggagaaagcttccaatttgggagatttcttcattgcttcttgagttgtaagacatgaaccaaaaaattgactggagttttttggagtttcatggctggagtttcatggctgtgttgttaaaaatttcttatacggtttctttcaattatttgagatcagtttttctgatttttttctccagtagataaattttcacaagatctcaggaaaccatgtctctggtgctttagtttgaaaaactaacttcctaggtaaagaagcttctgtctaaccatgatgagctcatttcttctgcataccatgaagtttgagaccccattgtccagaatcatgaaaattttacactccagtttactgaaaatcttgactttgaatttaatattgattggcattgacaaaaatggttcattcttggatgtgtcctaagttgctcacccaacatatcagtggactgagaatcttccattagctccctctgtccatagcactgagtctattgacaatctttgcagtcctctatgaaggagagtcctgaggttcatcagattcttgtagacactcagatgaaccaaaggaattaacggaattgaggactgccagccatttccacaacactaggaataattaccatctaagtgtaaaggtctacatcattcagaataccctgcatgacaggctgatgcaaaaaaaaatccaaccctgcagaggcttcacagcaaccctcacagttccttcagggaagaaataatctccaagttcagtgagtcagtaaagctgttctgagctacagtaaacattggattgggcccagttttgtctgagttcaatgtgattgttatactcagctgctgatcctatatggactgagtatggataatttaaatgagcctggctgcgtggtttgttatatgaaaacctgaactaaatataaataaagggcatgtctggactagcatgagggtgagagattctgggagctccaccccccttactcttattgccctttcctccaggaacctccaggtcctcagggtgagaatccacacagatcccttcatggctctattgccaggagaccaaatctctgataaaatcactcagaccttcttcagacagacaacccagggaaagggcatttttacacccttatgtatgtggggaaaggtaatccatacccattagaagcccctgccagcagcctaactttatcatgaaaatgggtaaaattagccaataggggtacatttaagaaaattttcctgtgatgttccatccagaaaagagcaaaaatcagcttcacacctggagacttcctgtatcgggcacagctcagagaaagaagatcaccacagaattaaaatgcaactgtaagaacatgtaatgcttccgtgttccacacattatgtctcaccagtttagtcaatatggattaaatatgagagcgtggcaatgcacaaactctatctgaggaggaaagtcagagaaaaaatgttaaagaaaatatggcaatttgaagcctctgacaccagcaacttcagcaccaaggaaatgatttcaccctcattggcctcaaatttacttttcatggagcattttcagggttccaaagtgagaccaggtgaattcaatgtgcatgcacttctcaggtgtccacgtgtattttgtttattttatttctatttgcagaaagtaaacacatattcagccttagtgtcagtgtagggagtgctttccatgacatgaataccagaaaaaaaggaaaaacatggggccaattaatgtaaaaattagccactgtgtgtgtgtgtgtgtgtgtgtgtaggtgtgatttgaatactagagttggagtgggcttctatccacatgcacctgcacctgcaggtagtctcaggtgcaataatcaactgcctgaccctaaaggaaacaagaatctccccaaacccctgaagagtgtttgggtttaccgtgtgtccagtgattcagtgcctctagagctccaggaaggggctcccccggtgatgcctgagatcttttcttcaggtctcccctgcagagttcctctgggtttcctaagggcaattcactatttcaaaagatggtgtgagaagcacatgctgtcactaaaggagaattctgagccacggcacagccactttatactgggctagagacactggtatgaatatactctgtaagtttagacagaaagcctcgtgcatggtaggggctgggctgcagggggtgctcaggataaacgcagcacagtctcccgccccagagcaggtgcacaggaggctggggaggggttcctctcagggcctgggacttcctttgaaaatatctaaaataagtatttcacaagggctgctgttgtttgtataaatatcctattcaattgtgagcatttatcaaactggatgttgtaatgacaaccacttttacaatggggatttcaaactcccctagatatcttaatagtaagcagctggaggtcaagaagagatcctttcttttaaataagtgcaatttttggagaaacatactcattcccaaaataacgcattcacatattaaggtctagaaatggctcaagttgtccctggtgcattcgaatgtgggttcaaagtgaggtgcgtgtcctgagggagcttgttctccagtggaggaagctctgtcaacacagagttcagggatgtgtaggggtcgtatcgcctctaacaggattacggcttgaaccctcagcatgtacaattgtgtcgtccatctgtcatgtatttgctctatctcatcctggctcaggaattgggctattcaatagcatccttcgtgaatatgcaaatcactaaggttaatacagatatctctgtgccgtgagagcatcacccaacaaccacacccctccttgggagaatcccctagatcacagctcctcaccatggactggacctggagcatcctcttcttggtggcagcagcaacaggtaagggactccccagtcccagggctgagggagaaaccaggccagtcatgtgagacttcacccactgctgtctcctctccacaggtgcccactcccgagtgcagctggtgcagtctgggcctgaggtgaagcagcctggggcctcggcgaaggtctcctgcaaggtgtctggttaaactgtcatcacctatggtatgaattggatacgacagaccccaggacaggggcttgagtggatgggatggatcatcctaccctggtgaacccaatgtatgcccacagattcacacacggtttgtcttctccatggacacctctgtcagcacggcggatctgcagactagctgcctaaagactgaggatgcagccatttattactgtgtgaggtacaccgtgtggaaacccacatcccgagagttttagaaaccctgaggaaggaggcagctgtgatgagctgaggcagtggtgcagcatgtctctaaacttccattttatctaagtttgcattgagttccgctttaatattagccaggaatgtgggatagacgggtgctcctaagaggtccttaatttgcccattttgatgggttttccagaagacgtgagaagccactttgttaacaaagcatcccaaagccatgccctgctccagaaacacgtgtacccatttcctggtctttggttaactgacaagctctcatcagcgcacctgggctaatttctcatcaggtagaaaaatgtgttgtaaagcaaggctaacgttgtgatagcaattcctgctcaataaccttcagcatcgttgttgttgtgttctatcaactaattacgtgacttcaaggttctcattgggagtgtcttataaatttaagggatatatagaagttcccctaattaaaataaaacaattgtgagcacaacctcagtgttcaaccatgtctccacccttcccaccattcaccccaaagaaatgttcacctctcctggaagtcgggttcattttcaaattagttattttttattttactatatcaagattattgtatgtgactactgtagcagaaagtgaattatgggaacttgaagtaaccaacgaaagataaattcagaactaattaaacaagatgtcagaacgtgattggctctagtcttttaaaattcagcaggttatgtaaccaggctttaaatttacacatcttcctgttaccttcacggcacagtcaactcccattatgtaagaaatggcaactgcattcccaagcgtcatccaaaattgtaaaaatagactgggtgaggtgaggagttgattgtttaaattccgctctgaagaagcagcatcaactcaacaaaccaccgcttttccctcagtgactagagctatgtcgcaggccacatggacctaaatatccttgatagagataataggactacataaattgggctgatcatttttatgctgtaaaattaataggtgagtctgcactccagcctgggcaacaaaacaagtcttgcctgtaaatacaaaagaaagataaattaataggtactgactttgacatttcggataataatattttcataaaccgaatttaattatacccacattgttacctacaccttcactgaaaagttcctagttatcatgagttccatcaacactccacgtgttcaaatctggacatccaagagagtctggagaataaaatgcaatgagggcagtgaaacttgcatatattcagcacctcttaactcaggaggactcaatacaccctggaacactctgcttttctgaatggctcacaatgactccagctcactctccaacctcctcaaacatctggcttctgtttgccctaagttcacgctctgctcttagtctgtgctctgaagtctttgcaaaggtgaaaatgagctgtcagatggaacttccttctcacctcagcatggaatttactgtttcatttaatgaccactctttccataatggttgatttctttcagcctgttcattactggtgattttcaagggaatctctattgaatttttacatttttgcatttttgtctcggtgacaatgttgagaagtttttacctctagcatcataacatgatctagtgacctgacacatttgtggcaagcaatacctacaaattcagaagttctttggttactttccacaaaatataattatttctggtctgtgtatgagcatatcctagcaaccttgtactccacacaggtagatgtctacaagcctatgaattaatctctgtaaataaaaatttatctcaatttctttcaatgttcataattcttctgaggatgaggaagatctttctggatctattcagacaataggcccagagaccacctggtatgtaaggagctcacctggctcacctggttccccctgttgtctcacataaggtcaagcccacttgttcaggtcctaagaagagagctcagttttatctgattttacaacactcccaatttctgctgactctcctgttacccacatccatggagatacattatttattatacaattaaccaaagtaatgtcaaaggcccaatgtgcaatattgcacatcctagggtatgttcatgcaattgaatcgaggagaaagtctttcagagacagatggatctgaactggtaaatatgtgtgtaaggactctgggcttaagtgtcattgtccagccatgtttcacaggtgtgacctgtcagggaagaaccagagttccttgtgttctcagaggggaggggtcccagaagtcctctctggttcccaggaaaggtaattgcattaatcttggtgatgagactatcatccagtgatgatgtactatagagtttatgtttgaagttgacactctatcgcaatctacatcttttcacacagaagtgtttagaggtcaggccacatcttcaggatcccacattgagaaggacagagatatattccactaccttctcctgagatctcaggcagaaacccaaatttcaaaaggtctcagaagggcagctctcaggggctatttaaaaataacccacttcgtgggacagggagcatccttctaaccatgatggatgttctgaactacaataaacattgcatggaaccagggtctgaattcactgtgattattacactccactgctgtttcaatgtgtctgaaggggtaaatgacaatttagatgacctgggtgtgtggtttgttttacataaatcttcaaggatagaacagcattgaacctattccaaaatctgtccctgatccaagatcacactgatctcccagagcagcatcttcagcacatttccctacctggaagaagaggactatgggcttggtaaggggaggccacaggaagagaactgagttctcagagggcacagccagcttcctactcccagggcaagcccaaaagactggggcctccctcctcccttttcacctgtccatacaaagtcaccgcccacatgcaaatcctcacttaggcacctacaggaaaccagcacacatttccttaaatttgggatccagctcacatgggaaatactttctgagactcatgggcctcctgcacaagaacatgaaacacctgtggttcttcctcctgctggtggcagctcccagatgtgagtgcctcagggatccagacctgaagatatgagatgctgcctctcatcccagggctcaccgtggttctctctgttcacaggggtcctgtcccaggtgcagctgcaggagtcgggcccaggactggtgaagccttcggagaccctgtccctcatctgcgctgtctctggtgactccatcagcagtggtaactggtgaatctgggtccgccagcccccagggaaggggctggagtggattggggaaatccatcatagtgggagcacctactacaacccgtccctcaagagtcgaatcaccatgtccgtagacacgtccaagaaccagttctacctgaagctgagctctgtgaccgccgcggacacggccgtgtattactgtgcgagatacacagtgaggggaggtgagtgtgagcccagacacaaacctccctacagataggcagagggggcgggcacaggtgctgctcaggaccaacagggggcgcgcgaggccacagagcccgaggccgggtcaggagcaggtgcagggagggcggggcttcctcatcagctcagtgatctccctcctcgccagcactcagatgtccccagggctcctgtttctttattgtctgtggttctgcttcctcacatccttgtggcagacaagaaaggaggaagacaatttttctgtttactgttgaggtttcaccaattactaggaactttcctacaagttcctgcgtgactcattttaccgtatatgtgtgtgtgtataaatatatacacatacacacacacaccatatatatacaccatatatattatatagatacacaccatatatattatatatatacacaccatatatattatatatatacacaccatatatattatatatatacacacgatatatataatatatatatacacaccatatgtatattatatataaacacaccgtatatatatatggtttctcaccatctcttgatttgtgtcatcaatggaattgtgccctatttgaaattcatttacccaaaccttaaatccaatggatctataccggaattttaatgatgcaattaaggttaaatgtggtcaaagtgtgagaccctaattcaataaaccagttgtctttataagaagaggaagagacacccgagacctctcacttttcgcgtgcacacagagaagaagccgtgaggagacgtagtgcactagaaggtggccctgtgcaagccaggaagaagccgcgctaagaaccaatttttacagctccttgatcttccacattcagactgcagaattgtaagaaaatcaatatttgttgtttaacccacccactcctgttgtcttcttatgaagatccaaacagactgataccacgtaattctgttagctctggttcgtggagggaggagcagccccctgaggctggacacttctctcagatttccacgtgaagtaggtaaaaatagtagctctcatataaaaatgtgtcatgaccctgttggccatttttgagcaaggtctctgaaaccagcccttgtgtgtgtgtcacaaatgttttcttttatcttttatttggacataacacatagacaaggcgtaccagctggatggagactggtcactgcccatcttctgttgtctccttaggatgtcacagaaaaccacaccaacatcaccaacgtcactgtttttcttcaaccacctcaaaccgactatagaaatgatccctgcagtataagtctatttcttcaaactttctaaatttgcactggaatctcttcctaaatggggagctacatggggtctgagttttgttcctttcttcccagtcttccccaagtgccaaggacagaatagacttaaaataaaatttggccgtcagtggccccaaccccacatcactttctaaaacccacatcctgcatccatccttctctggacacccctcatcgggctacctacgaatggccagaagctgccatcaccttctgggctgaggccacgagttatacacacgtgtgatttcagtcacacacactctactgcaggacacacctgtgttcttgaggcactcaggcaccctgctgatctcagtcattctctaataaattacacatctcttattaataaaggtccagatggtcccatcagctgcagagcagtggagtaaagctcatgggtgggtccgtcaggtagaagtcagacaatggatgggatggctggtcacttcccttttcactgatgtccccagtgaatattaatggaataaaaccatattaactacagagggacagaaaagaagactagctcatcaaggtatttaaggaccaggaactttatttggggggaaagtgaagacacttttaaatggaaagccctaaagcacatacaacagctgacagagtggccactgtgcacatgaaggctgaggagacggatggcagcgtccgttcctccaagatgtccctgggtgtgtgatggttggactccttatgcatatgaatataagagctggactcagggagaaaaaagggccatatctcataggaaaggaagcccaaaaaagcagatgggcatccctggagagagctcattagatttggtgtgtttaagacaaaaatttcttccaaaaattgtaatgttctaagctaaatatgaacctcttcaataaactgagaattaacaggagaatagagctatgagttgagagaagaaacaaatcatgagagagcagaaagcaaatccacaaaaaactgtcatatgacagaagtcagaatggagctggggcagctacttcattattctgaagacttgttgaccatgtggagaaggggcttgaacaaatggggacgttctccaaccttctgaatcagcctccttcttatgcatgagtaaaaatcatagttctgggtgtgaccttcccaaatttcctgtctgtacctcttcccccaggggtagagtgtcttcccaccacaatggtttctcaccagtgtcctcagcttctcctccattgaacttaccctgcagattaagaatttcttctagatgtagttctttgggaattttctgttttctttagtttctgttgactccaccacaccccataggtcacaggtttgattgatttcccctggagacagtggaggtggatccaggcgttcaacagtcctcgctgttcctcccttcctgtcagcaccacaggacagcagataagggagttgactgtagatttttcgaattcttgggaaaatcctgcaaggactagtagattcacactccaataccattagcacatgcatccaaaaaaaatactcacgaaatatttccaggttagcctgttcctctctcaatgccatccagtggcacctgccctgggttcaccaacatgtgggccccactcctctctgctggcatctctctcctcacatttcagtcttctcgttagctctgtgaaagcaactcagatatgttaaaaggttttcttcttcatttattcagtttttcaggtttgttgttaatgaggtcagaataagaccatagttttctcatttttcacattcccacactgagtagccactttctatataaaagccagaaactaagggaacaaatcaaatatccatatccactacaggtgaacgttaaacaatttgacatatgattatgaactaaagtacaatgcagaattagaatcaaggcatcctcattctcataaaagcatgtctacattctcaaataactctgctgagtgaaagtagctgaagaattaagagtgcaattcataaacttctaattgtataaactgcaaaaggtccaactattctaaagtaacagagcagatttgaaatttgtgagaaacgggtgttgaaagtaattggctggtgagatgaaattacagagaagtgacagaaagatttaggggttaacttaattgtacacaacctgattaaagtttgcacacatacgttaccattttccaaattgtgcagtgtagatttgaattaattattaattgtacttaaaaaaagcagtaacaaataaacacatgaatatgtttactgaggaggaacaaaaaatagatgggtatgaacactggaaacatctcagactcttgaaagtacacaggcttgaacactggttctctccgtatacttccggtaaacggctgaatacactaaaagaaaacagagatgtcctggcaggggtggaatcctgcagacctcactaggtgtgtcccacactgccctggagttgtctcaggggagcagtctcctctagtggtcagaggcacaggctgagataatggggttaactctgtccagctgtgtgactttgaatgcattgtataaacactctgttctgtatgtaatttatcttccttaaaatgcaacattgacacttacattaaatgtattctacaaatatgtcaaaaagaagatgatgactgctaaatgattatcaaggcacaatcacataatataatgatattttcctgagtgataagatgactaccaatctcgggggcactttgtctgctctgagccctgcccctcctcaggattcccatcccagagcttgctatacagtaggagacatgcaaataggtttctccctctgctgatgaccagtcctgaccccatagctctgggagagaagcgccagccctgggattcccaggggtttccatttggtgatcaggactaaagacagaggacccaccatggagcttgggctgagctgggttttcactgttgctgttttaaaaggtgaactagagagattgagtgtgaatggatacacttgagagaaacagtggatatgtctggaactttctgaccaggacacctacaagtttgcaggtgtccagtgtgaggtacagctggtggagtctgaagaaaaccaaagacaacttgggggatccctgagactctcctgtgcagactctggattaaccttcagtagctactgaatgagctcagattcccaggctccagggaaggggctggagtgagtagtagatatatagtaggatagaagtcagctatgttatgcacaatctgtgaagagcagattcaccatctccaaagaaaatgccaagaactcactctgtttgcaaatgaacagtctgagagcagagggcacggccgtgtattactgtatgtgagtcaccaggtaagaagacatcagtgtgaacacagacacagaatttcctgaaataagggaggagtctgggctaaaagggcactcaggacccacagaaaacaggggaagctctagggcaggtgcagatggtcatcatgggctgctttccttgagggtctgaggcttcctctgcatctaacagtttccctgggagcctctggacatttatgcttctgtggccacccctgaggtctctggacattctcatttgttgcaaaggcagatgtaagtattggaggcataaaaatgcacaggaggccagggagtctgtagacattgttaccccagaaggtcaatctcaccactagtgctggaggagggtgggagtttgatgaagctgccctaagtatcctgtggtctaagctaagtccaacgaggccatttgtgcctccctgagcacagttatccatcagagatgtcccatgtgtcccagcagcagccatgtctcagtgtcttcactgtgcacagccagtgtctgggaggagctcccaggatgggtgtctttggcacacaccaggtggcgggtgttagagtgcggtgcagcagctggctgcctgttctattgggctccctgatgctggagagatgggaggtgcattctcaggtccagcaccctgtttgtgaatttttatataaaaaccatgattttacttcattttctcagatgacatagataattaggaacagaacctgcaaagaaattgtaattttcaactttaccccaaatttattgtttcttaattctgtgtaagatccagacatattattgccttcctcatgagaaattgttctatttaaaatgaaattagttttttctcacattctttgtttctgttcaagtacagagatcttgattaaagtaagttgggttctttccacacactaaccctcacctcccccagagaaagagcagagattttcctcactctgagtctaagggaggagctgttcctgcacgattcagagcctgcagagaccccccccgccaggtgcagcttcagtgagtcaggtatttctccttgtgggtgacctccaccgccagtgattgctgctcaggtctaattgtgggttaagcattaggacacccttcaggtgatcacatctcagtcttattctgaaaatcaccatgaacagggatagttcaatgcctattctcctgacattagtttctctttattatttggttccaagtatggagaaaaatgtgacaataaatttgtcagaatctaacctcagaatccactgcattactctaggatactcacaaattgaacacaaatgagctctttattctcataaaagtatacgtatttgggaatttcaatgtgttctccagaacctgtgcatgccaacaactgtgtttctcagtgcccacttggcctggtgaagccctcacagaccctctccctcacctgtgctgtctctggattccccatcacaaccagtgcttcctgctgtagctgcattcataaaccccccaggaagggactggagtgaatccagtgcacaggtcatgagggagtgcacattccaacccactcctcaagagtccagtcaccatctccagatccatgtccaaaaagcagttcttcctacagccgagctaagtgagtcacaagcacacagccatgtatttttaacaaaagacacagtaaggtaaccacagtgggaactcacacccaaacctccctgtgggggtgcacaggacagccacagttactcaggaccccaggattcctcaggacaccaaggggcactcaaggccattgtagatgccctcaggtagccaagggttctcaggaaacatggaggaaaaccaggaccccaaaaggtgctccgtacagcaggggactcaggacaattgcggggactcagagcaggctcaaagctcagcttcagggcaggtgcagctggggttgaaaggggctggatgaggggttttgtgacaccatcatatttcaccactagacacactccactttgtctattctaacgcatgtgagtgtatgattagaaaatgatatttatataaatacataaccatagttagctgtgtcaagttgtcctcttgctaggtgtccatagctaggtgcatcagccttgtccataaggactaattccccgcaattactggagaatctcataaattgtggtcaattatgtcagattcctctctttttctgccttcctttctcccttcttctctctctctcacacagaaacttacatacacccaccccacaacacaccaaaatctataacttttattacctgatatattcaataaacctgattaatgtgcagcttttccagcttcgttatttatgctgttgtaacaataagaacaatgtgtttcctagctgtgtacttctctaagctgagtagcatctttgtttataatacctagaattaaaaacaacccaaatgtcaatcaccagcttaattggtaaacaaattgaggaaaagtcattcattgacatactatccactactaccatcaactaatgttgggtacactcaacagcatggttaaattcacaagtacttgtgatgagtaaaatgagccaaagtaacaaaagtgcatacataagatacaactttcataaattctatagaacaaaaagtaatcttaagttacataaaaatcagtagttccactgtgagtattgtaggagaggggaaggactaggaaggaggaattatagtacaagacaaaattttgagggaattgacttgttatctatgttgctcgcgatgatgtctatgacccatttgtaaaattgaacacttcatatggagattattatttttaatttaactccattaatgatagtactaattatagcaggtataatttggtatcaaaagaattagacagagataaataaaatacatgaaaagtcagagactcttgaatatacacataaatgagccctgggcatctctgtatttttagagaaatgctagaatatagaaaaataatggcataattttatgtcactaaaaaagtttatcgaactccaccagtcatgtggtattagttcattttcacactggtataaagaactacctgcgactgggtagtttacaaggaaaagagatttagttggctcaccgttcttcatggctggggaggccacaggaaacttacaatcatggtggaaggtgaaggggaaacaaggcacatctcccagggcagcaggagagagagagaggggggaagtgacacatacttttaaacaatcagtggttgttagaactcactcactaccatgagaacaacatggggaaactggacccatgatccaatcacctctcacctggtccctcccctgacatgtggggattacaatttgagatgatactttgatggggatacgaaatcaatctatatcacatgtccagctctgtcctggagttgtttcagggatccagggtgtccggctgatagaaccagtgacaccaagctcacaccctcagctgtagttgacaccacgcaaagccaagagattacaactaagatttagtttgaatgtcgtgtctgatgaagtcacacactcagagaaagtgaatatggaaaagtttattatttgcactctataggtgtctggtgagtgcagggcaggtctcccaggaaaatctgaaacagcttgaaagaagaggaaaggagactggctcagcatttttatgatggtttggtcctgggggcagagtgaggcttcccactcacagaaaggggtttgcagggtttgaaactccccctggcatcgaatgaagaagctcctgtgatttcaaactagagccaccttgtgtggcaaaaaaggagatgatggaggaatatgctttaaatcatcagcagtcacgcacccaaaaatagtgtgacaacttattctatgcagcaggaataaaaataattaataagaaagaagataagggttcagtgtgggtggacaacacgcaggtctacagaaatgagatgactttagaaatataagcaaaggataatgaaaaaaaggaggggaaggggaattaaacagggtcctggtctgatgtcttgggtagaagcttctcacaatcaaggactaccagctcattctgcaggtcttaggtcagccatctgcttaaaaacatcagaaacgccagagaatctatgaacatggtcagtttaacatttcctatttgagtagctttacagttgtgtggaattcttaactggttcttgttttttcttttagatacaggctctcaccctgtcacacagtttaaagtgcagtggtgtgatcatagctcgctgtaattttgaactcctgactcatattcttcccatcttagcctcttgaatatctagaactagaggggcatgccactcatcccctccttattttttattttattttttcatataaataaggtctctttgtgttgcccaggctggttttgattgcctggtctcatgggatttccctcacttcccttctgaaagtggtgtgattatacagatgatccagtgcatctggcctgaattgattctttaattgtaaaatacgaacccaataattaacttcctgaatgttttctgcagtgagttagttaaaaggatctgacaagattccttccaatatgattcaagagcagtattgtccactgatgttccttccagtttccttgttgaagatcacaagagtctgtggaaaagaggtagtaaaaaggccgcctcaaactcttcgtggttggagtgggtaccacacatgcaagcagtaggacaaggatgatctctggggtaaagtctataaacatataggccttttagctgccaagtcatagggtaataactgatgcagcctgaggagtggaccatggtttcatagtgctagtgggagaacccttggccaagcaagttttacattttattacattttattaaagatttgataattttaatgtaaagatgacattttttaaacattcccagaagattgtgagtggtattgattctgtctcgtatgaacaatgacagtgccctccacggttagattatgttataaactagaatgaggtagagtgtttggtgtgttaaatcactatttttttagcttctatgttagttttttgtttgtgtgttagcatttgctttaaaattctattaatcagatctctagttggtagaaattcatctgaaagtttcttccattgttgtccattttgataggatttccagaagatgtaagaaccctctctgtttgcaaaaatattccaaagttgtgcaccatctagaaacatagttacttaattctaatttttaatttattaaaaagttgtgataagtgcaaagttttctgccttctgaattgatttcataacacacagaataatatatactaaatggaagtttgtactagtaatacaaattactgattaataacctctacttttattattgaggtattatccatcaatatataatcttaaatcaatgatctcagtgggaatcttacctaagtaatatacaaaatattttcctgatctcgacacaaaatagatgtgaacacattcttcatattcagccatgtctcctgtctatcacattatgaaccacatgctaactttgatttacttgggacttgctctaaattcaaactagttatcttttatcttcacgcagctggattattatgtgtggctattttatcagagtgataagatacaatactaacaattttcactgcaggcatgtctaggcaagccccctgtgcacaatgaccttggtgggttggacattctatggggactctcccctgtctgcctaggagagttatctgcctcctccctctatcattttcctctttgaataagtgcatctaactgccgttagaatacagacaaaggccaaccttaactgcttccagctgacaggggatgctgtttcgggaagatctcccttgaggtctgtctaagggacccagtaaaagggagccattatcccaggcttcacttggatgaccatttggagttgatgcctgaaggtgagaagagacaaaccgggttattagaagacatgtatcaaaaccaaacaaggtggtaaggacagtttgaaaaaaaattccaaggctgctgacacacccagatatctggtggctgtagttatgcctgctaagatttgggtgcatggggcttggctttcgttagctcccttggacttattttcccaaacaaagaaacctccgggttagggggaccctatttattccagtcacctggcatgatttgccggataattgctcagaattaaaatattcgtccagatgtttatatagcccatgcctgtgtttcttctgagctgcagccagagatcattggttggttcacagcgataagcagagttagtctaaaatggaggcaaatacttaaaacttatttcttctctcagttaatggattctatagagaaaagtagctactcagcatgggaatgtaaaaaaatgagtaaactatgatcttattctgaactcattaacaacaaacctgaaaaaccaattgaagagactgtaatttaaagacaagtgtatgatatgttttgaaacataatttttctctctccagttctgatttttgtcagaaactaatcattataggactgagttgtttgcaaaataaactttagtcttatggttggtctgatcatttgcataaagtgaagccataataattaataataattctgtaggaaaagcctgcaagcatgaggagcttcacagtctaacactatgagcacatgcatcctccagcaactcactgaatattttcaagtcagccggttcttagcttaaataacatccagttggtatctgtcccaggaacactaatatatggttctctctgcaggcccctttctccacagattaagggttttttttttttctctgtaatatcaactcagatatgttgaatgctttttccttattagtggtttttcaggtttgttgttaatgatttcagaataagatcattgtttactcattttttttaaattcccgtgccgagtagctacttttctctatagaatccattaactgggagaaaaaataacattttcttatgggtgaacaattaaatagtttgacatatatttatgtactggtatataatgcagcttgaaatcaaggcatgcctcaatcataaaaatcatggctaaattctcaaagaattgtgctgagtgaaagaagctaaggaattaagagtaaattttatataattcattgtagaaatattagaagatgccactaccataaattaaaatgaagaagacttaaatttttctgagaaaatggtgttgggaatgatgcggatgtgatttaagtttcagaggaataagaaaaaagatttagggattaatttaattattcaaaacttgattgaagtgccgagtgaatggctccaaacatagtctacatttttcaaatcattccctataaatttgaattaattatttatttttatacttgaataaagcaataacaaagaaataaatgaatatttttgctaaaatggagcaataaaaagactgatattgacagaagaaatatgactgacttctgaaaatacacacacatgagccgtggttctctctacatatttagataaattacagaaagttgtcataactgatggggaatcctgcagacttcactaggcatagtccacactgccctggagttgtctcaggggagctgcctcctccagtggttagagcacaggcccaggtaataggactcatttttttagatgtgtaattttagacacactgcacaactgctgtgttctctgtgcaaattatctcctgtaaaatgtaacattgaaacctgccttaaatatattgtgtaaatatgtaaaaataaaatcagattgtgagagctaaatgctaatcaaggcgcaatcacgtaatatacaattatattttcctgaatgatggaattaataccaatctcccccaggacacttcatctgcacggagcccggcctctcctcagatgtcccaccccagagcttgctatatagtcggggacatccaaatagggccctccctctgctgatgaaaaccagcccagctgaccctgcagctctgggagaggagcccagcactgggattccgaggtgtttccattcggtgatcagcactgaacacagaggactcaccatggagttttggctgagctgggttttccttgttgctattttaaaaggtgattcatggagaactagagatattgagtgtgagtgaacacgagtgagagaaacagtggatatgtgtggcagtttctaaccaatgtctctgtgtttgcaggtgtccagtgtgaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagacacagtgaggggaagtcattgtgcgcccagacacaaacctccctgcaggaacgctggggggaaatcagcggcagggggcgctcaggagccactgatcagagtcagccccggaggcaggtgcagatggaggctgatttcctgtcaggatgtgggactttgtcttcttctgacggttccccagggaacctctctaagtttagcattctgtgcctatgaacgtcttctctaagtatttgaaagagattattttaatatgaagagcagttctcactcgcccaaaatgtggattgatgcttactgggatgaaaagtccccaaacatggtcaccccgataagagtctgagtgagctcagggcttcctgctgagtctcctcctatcagaccaaggacagggacctcagtgaggttcccccgtcaagaacagtctttatggatactgattgtgggcggcaacccacccaggtgccgacgcaagagaccgaggacacgagctgttccagtacaataaaatataaaacaagaatagttataccagatatagatcttagatatgattatatatgaatatcattaatcattagttggtagcaattactctttattccaatattataataatcctcactctacaatcataacctaggaaaagccaggccatacagagataggagctgaggggacatagtgagaagtgaccagaagacaagagtgcgagccttctgttatgcctggacagggcgaccagagggctccttggtctagcagtaatgccagcatctgggaagacgcctgttgccaagcggaccatggtctagtggtagactcagtgtcaaggaaaaacacctgctacttagcagaccaggaaagggagtctccctttccccggggagtttagagaagactctgctcctccacctcctgtggagggcctgatatcagtcagacccgcccgcacttatccggaggcctaacagtctccctgtgatgctgtgcttcagtggccacactcctagtccgccttcgtgttccatcctgtacacctggctctgccttctagatagcagtagcaaatcagtgaaagtactaacagtctctgataagcagaaataatattgtaagctgtttctctccttctcctctctctctctgcctcagctgccaggcaggaaagggccccctgtccagtggacacgtgacccatgtgaccttacctatcattggagatggctcacactccttaccctgtccctttgtcttatatccaattaatatcagcgcagcctggcattcagggccactactagtctccgcatcttggtggtagtggtcccccgggcccagctgtcttttcttttatctctttgtcttgtgtctttatttctatgctctctcgtctccgcacacggggagaaacccactgaccctgtggggctggtccctacactgatcacagacaatagagggtaggccaggatcagtgtcatgtaggacatcacaggtttcacctctgaaccttttcctgacactaaatatgcaaatcagcatcagcactgatctggtgattcttttgttcctaatccatttacttcctttttcagtcgttgttttcatttttccatttgcttttcctgctttctgcaaaaggaagatttttccctgtggtcaaaattccggacctcaagccctttcctggcgctcaggtgggtctcaggctgtggctgctgcagtcacgcgggagaggctggtgggactttcttcactcctcgtcactcagggccctccactgtgttgcatggagacttatctggaaatgcaagttgcgactgagaactgaaggggacaagcttgtttggttaacatgggatgtggatgtgtttctaattttgttctgataaactttcacagagtaactttctgcactagtcatgtgaggaagaggatgtgaacgtagtcagaataaaaatagaacaacttgtgttataatctttacaggtgaagctggagaaggtcatgaatagagggttctcatgcacacatccctgataacaagaactaccataaaattactctgcacaaccacaactttcaacaaaggctaccacaacaataagagaattaatattgtgaggatatctgccctgcaactcccagtacaatcttaaactgattccacccttgttattaattcttctacccccaggataattgcctcagaacagctcatgtaagtcctctcatttatcccttaaaacaacctttaccaacctttactaacctgacttcctttacctacctaaatatgcccagggataatcccactggaatgctcattttcaaatacatattatttgattttggagaatttctttctgtctgatattcaggtgtgacaagctgtagagggtcacaccactttcctgtgagatgtaggggatgacaatttggggggatggctggaaacatccaatatcctcagggtcggccatcagtaagcgcaggctggaagtctcagaacgagttgaagttgcttaaccacggaattttaccttctccagatcagctttgatggaatcagggccaaactggttatcaatgataatctacctaacattgagtcaactgatcacagttttaataacctctattaaaaattcacaccaacacttggattagtgtctgatcaaataactacaaagtattttccagccaagtataccataaaacagaccattacccatggagaaaaacatttaacatgagttctaggtccttacattgttaaaggtgtaaaactgattatttttaaattatgctttttatttttgctattgagttgtagaagtttcatttacattttggatattaacgcttttttcagatacatgatatattatccaattctgtgagttggaattatttcattgctttgcagaatatttttttaatctagtccaacttgttcaattctgcttttttttaaatgtgctttgaatgtaaaatccagaaaaagattgctaatttttgaggattgggagttttacagttgcaggaatttcattgaaatatttaatgcatttaaagttaatttttgtgtttattctaacctaaaattcttaattcttcacatgtgaaaatccagttttcataacatgctctttggaagacaccataatttagccattgtatgttgatggttctcatgctgaaaatcagttcgccatcaaaatgtgggtttatatctaagctctctatatgcatttatgctgaaaccattcggatttattactctgtgtttgtaacaaatgttgaggactggaagtgaaatgcctcaagctttattcttgccttattacagatattagacccaaatattctaaccttctactagtgagtataataatagctgtcgctttttttttttttttttgattcagagtttcactcttgttgtgtaggctggagtgcagtggtgtgatctcagctcaccgcaacctctgcctcccgggttcaagcgattctcctgcctcggcctcccgagtagctgggattacaggcatgcaccaccacacccggctaattttgtattttcagtaaagatggggtttctccatgttggtcaggctggtcgcgaactccagacctcaggtgatcctcccgcctcagcctcccaaagtgctgggattacaagcatgagccactgcacccagcctcttcattttttttttattcatatgttcattcagcagccactatgtcttcccattgatttctttggtttcctctttactatctttttctttttagtaaagctgttactcctaagggaagatgggaggtgggcctggacagggatttggtgcattcctctcttcactcacagttcttattgatctctccagtgtctctagaacactggttttcctggcattaccgctgcagataatttctcttgcaatgtagtgctgatgaggaggtgtgtctggatgcatttcagctatagttgctgttttgctttccctgacacaaccgtcccaaggggtagaggctggagcattttgtgatgtgtccccagtactgaagaaaaagccttcaatagcaggaggaattcctcaactgtatacactctgagaatttaaacaataacttctctatcacactcaaatttaaaccatccaatgaatatgtctactttaatcgtgtgttaacttaaatgatatttggcagcctctgtcccagaaaagattatcatctgctcctgtttatttccctgcaagtctttatctctcttcagatttcagatatcttgtttgtcttataacatcaaaaatctgatgaatttaagaaaatgtgctaatttgcagatcagtaagctttagtagttgtgagaataataacaaatttttatgggatgcctgcatctccaagctgagtagcatctttatttctaacactcagaaactagaaacaatgcaaatatcaagaagatatatagataaagagtaatggcatgctaatttacggtaatcatagccatcactagaatcaatacactgttgatgctcaatgtggttgaatcacaagtagttataatgagtgagaagccacacacataaaacacatactatataattcctgtataataaattcttgaaactcaaaaccaaagtattcaatatgaaggattgactcagaatatggcaagggaaaaaaataattgggaaggaggaattgtagagtaacacaaggaaacttttaagtgtaatttatttgtttgttatctggatggtttttggggatgcacaggtgagcacgagtggaattacattttgttgtgtttgtttttttctgaagagatgtggtcctactctgtgacccaggcaggactgcagtggtgggatcatagttcaatgtagcttccaacttctggtcaccaacaatcctcctgcatctgccatctaagtagctgaaactacagttgtgtgccaccaggctcagcttgagtacttattaaatcaaacactttatgcaatatttaatgtatggcaataatgtctcattgagagtattacaaataaatgaatggataatttgttcagtacagattgatggaaaatagacactaacatgaggaatgtctgacatttatgaacatacaactgcataaaatgtgttctcttacattcattaggtaaacacaatagtgcatacacatcaaaccatgctttcattacaggaaggaagttctgaaaatgtcactgggggtgacccacgctgtgctgggcttggttcgggggcagtcaggcccggtggtgagaagcacaggcccagatacccaggcttactctgcaaatgtgagctctggggacattgtaccacccatctgtgcttctgctggtaattttccatctgtaacgtggaaataacattgatactacataccgtgatttctccacatatgtaaaaataaaataagatgattgctgctaagtttaaataagggcagttttcataggtccattgtacctcaataaaattactttaaaataaaaattacaaatacagttgtaggtttaaagagtttatcacagaacaaacttataataagaaactatattttcaaaaattgtatcaatatctctaaactcccccaggacacactcacctgctctgggctctccactctcctcaggattcccaccccagagcttgctatatagtaggagacatgcaaacagagccaaacctctgctgatgaaaagcagcccagccctgaccctgcagctctgggagaggagccccagctccaggattcccaggtctttccatttagtcttcagggctgagcacagaggactcaccatggagtctgggctgagctgggttttccttgttgctattttgaaaggtgattcatggggaatgagttgaatgtaagtgaatatgagtgagagaaacagtggatgtgtgcggcagtttctgaccagggtgtctctgtgtttgcaggtgtccagtgtgaggtgcagctggtggagtctgggtgaggcttggtacagcctggagggtccctgagactctcctgtgcagcctctggattcaccttcagtagctcctggatgcactgggtctgccaggctccggagaaggggctggagtgggtggccgacataaagtgtgacggaagtgagaaatactatgtagactctgtgaagggccgattgaccatctccagagacaatgccaagaactccctctatctgcaagtgaacagcctgagagctgaggacatgaccgtgtattactgtgtgagaggcacagtgaggggaggtcagtgtgagcccagacacaaacctcctgcaggggcatctggagccacaagggggcgctcaggatacacagaggacaggggcagccccagggcaggtgcaggtggaggtcaagggctgctctccttcagggtctgtggcttcctctcatctaacagttccgcagggagcctcttgtatttacagtgatgtgctactgaggtttctaagtttgtaaagtttattactacaggaggaaccactatcaaacgcccttaaggcaggtgtcactaatggagaaaggaaagtgcacaggaggctgggtgaggctgtggacactgtctgcctatgattcaagtttcacaagcagtgacggagaaatgggagtttgatggagctccctaactaccatgtggtctaaactaagtccaactaagtccctgagctctgggtgcccatcagggatccgccatgtgcccggcagccgcgtgcctttttgtctcctctgcgcccaatcactgtctgtgatgagcttccaggatgtgtgtgtttggcacaaaccaggtgatggacgtcagacagcagcagctggtgcccggatcatgggctccctaatgctggaggaatgagaggtgcattctcagggacaagacattgttgatggatttttatgtagaaaccacgattttacttgcttctctcaggagacatagaagaagcaaccatgcagtcagcaaataattataatttccacaattaccccaaatggttaatccttaattctgcgcagggtcccaccgtagagtcacctttctcatgaggaatggttgaatctagaatgagtccacatgattttcatatttttggcttctgtccatgttcagagagttagagtagagtaagtttggacctttccacacactaagcctcacctcccccacagaaagagcagagacttcaactattcctgagtgtggggtaggggctggtcctgcacacctcagagcctgcagagactgccacgtgcagtgttatagacttgggtgttttctcattcaggaggggtgacctccacggcctccgatttctgctaagatataactgtgagtgcagaattaggacactattaggctatcatgcctcacttctattctgaaaatcaccctctttatagtaaaagaaaacaattcaatgtccatgcccctgaaagtcatttctttttaatttggttgcgagtttaccacatagtgcctgaatttattctcagaatctactgaattgtttataaatctcacaaattgaacaaaagtgaattcttcattcttactaaaatgtgtgtatgtaggaatttcagtgtgttttccagaagccatgcacaccaaccactgtgtttcatggtcatttattggcctggtgaggccctcacagaccccctccctcacctgtgctgtctctggattctccatcacaactagtgcttcctgctggagctggatccgccagtcctcagtcaagggagtggatcagggcataggtcacgagggagcacaaattctaacccactcctcatgagctcagtcaccatctccagatccacgtccaagaaccaaattttcttttagctgagttctgtgaccaacaatgccacaaccttgtattactgtgagaggaacagaagagatgtcagtgtgatcccagacacaaacttccctggagaggggcccaggaccaccaaagagcactcaggcccatgaaaacagggcccaagctggagaacgggtttcctgtcaccctcacctttcaccattagatactctacactatgcctatgctgaggtgtgtgtttaatataattagaaaatggtatttatatacgtgtataatcatatctagtgtaagaatttgtagtttccaccttatgtgaccattaaagacaacatctctcacgttattcaaggaccttataaagtataatacttttacataagatttatctccttttgtgtgtttctccttctgtctatattctctctctctcttcctccctctttctctctctctctccatctctctctctctgtctctctctcacacacaaatacacacacatgcaatcggtgacagtatataggctaattaagaatatattcccatatgatttaaaaataacagttttacaaatatttgcctttaatttttcaaagaaaattaaatccaaatgccagtgattttttatgtgacttttaaaatttaaattgttaatttgtgttttcatcaatgcttgtatgtgtgcttgtgtattctcacagattatgtggtgccttcacagaattaaacatgtgaaactctccacttgaatttctgtgactcaggactggtgagcaaaaagttagaagtcactctcctgatccttccctacagctgcagattcctgaaggtaatgacctcacagtagaccaaggccctcaaaggtgaccttgagttccagcacatcttgggaggccaagcggatgtttgtgaaagaaatagtggctatgtgacagtttctaaccagaatatctctgtgttttcaggtatccagggtgaggcccagcttacagagtctgggggagacttggtacactgagaggggcccctgaggctctcctgtgcagcctcttggttcaccttcagtatctatgagattcactgggtttgccaggcctcagggaaggggctggaatgggttgcagttatatggcgtagtgaaagtcatcaatacaatgcagactatgttaggggcagactcaccacttccagagacaacaccaagtacatgctgtacatgcaaatgaacagcctgagaacccagaacatggcagcatttaactgtgcaggaaacatcgtgatgggaagtccacgtgggctcagagacagactgccatgcaggacacagggggtggcttggctgaagggggcactcagcacccacagaagacaggagcagcccagggcaggggcaggtggagttcaagggctgctttcctgtcaggttctgtggcttcttctgcatcaaatgcgttctcctgggagcctctctatatttatggttctctgcctaccactgaggcctctggattggaaaagattactactagaaaaaaaaattctcatatacccctgaagaatacatcattaattgaggcagaagatgtcacaggaggccagggaggctgtggaaactgtgcgacgtggatgcacatctgacaacaaagacatgaaaaatcagggaacactgataaaacctcctaattatgccatggccctctctaagcctagtaaagccattgatgccttcctgggccaaacccacccatcaggggatcactcctgtgtcccagcagcagacatgccttagaatctccactgtatgtaatcactgtctgggaggagctcccagggcatgtgtctttgcattaaccaggtgatgggtgtcagagaacagcagctggatgcctggtctatgggttccctgatgttgaagaaatgggaggtgcagtctcagagccaatacactgtttatgcatttttatatagaaaccatgatttttcttgcttctctcagatgacatagaggatcaagaaaacagtctgtaaacaattgtaatgtccccatttcttctgaataaatgcattatttcttaattctgagtgggggtttgtcagaccatgcccttctcctaagcaattgttcaatccaggctgaaaccacatggggatcacatactttggtttggttcaggtgcagaggtcttcagtagagcaaatttggtccttcccacacagtaagcctcaccttcctcagagaaagagctgagattgatccaactttgtctgaggtgggagctgcttctccacaccttggagcttgcagagacccctaaatgcagctttattgagtcaggtgtgtctccatgtgggggacttctgctgctagtgatctctgctcagttctaaatgtgggttcagaattaggacacttaggttatcacgcctcaaaaattaccatcattgtagatagaaataatagtacaatgccaattgttgtcacttgtttcttattattattggagtataagtttgaagagacaaattgttaccatatatttgcataaatctaatgtcagaatctcttgaattgctcttgaacacttacaaactggttagaagcagattcttatttttttctatactagtgtattttgggatgtcaacattttgtccagaacatgtgagtaccaataactgtgtgtttcagaaatgactgtgagattcagtcatttctatcgagtgggaaaaccagttaactttgtctttgatatatggatggaagcccaagatagaggcttgtcagtcattgtttctgtgccttctcccttgggaatgtctgtatttttttatgctctgtcctgggtctataccccaatggttcccctactccatggcacctgcctgtgcctgtgcatgcccctgcccacactctccgtgaaacatctgctttggctcaggaagaacccctcctctgccttttttcctcctgcccctggtccacattcttctccatccacaggctctcagcagcacctcccatccacactaaccctacatggggtcataccttgtccaccacttcctctctcttttcttctgagctttgccttttattccaacagcctgtttccatctcacctggacttgtgtacaggaaaggatttaccgagcagtcttgggttgtgcaaaccctgaacattcctgaaaaagtgctttctcaagctaggcccatattcagctcctgggagatgatatctgcctttttggcatactcctcctggtagtattattaaaccacttgattaagataaggtttacatctgtaaaactacacattatttaacatacttaactcattgagtttggagtaagtatacatctgcaaagttatccccatcatcaaggtcataaccatagaaatcacttccaaaacattcctcttatctctcttaatattgtgattattttattagttaaaatgtatttttgtttgtgtttgtctgtgtctctgtgtgtgtagcctgggtgcacgctatactacctgttttcataatgacttatggtgaatgcctattagtgctcaagaggccggcgtctgagcactggaggtcaattgtgcaggtgtcacacacatctgtgatgggcccaataaacagccctgggcacaagcactcaggtgagcttccctggtggacaatgcttcacacatgttgtcatgcatcactgctgggagaactggggacaagagactcctcagggaaagaacacctgggagctcatgcctggattctcagggccttctccctggtgcctttgctcattttaattcatattcattcgctataataaagctgcacccatgagaataacagcttttcttgtgtcctttatttgtactgattaaggggcctgaggatggtcttgggacactcaacacaattacatcagagttggagaatgctagaaagttcctgattgctgacgcatggctagaggattttttataacatcaaaggatgagaaagtgcgggataaaagacattcaatgcccagatggctacagaatcatatggcatgagatggcatgtacactccaataaggagcaggaagtgaaagtaatccatggaatttagaaacaacagatacagcttcctaggagttgttccctgaaaaaggaaaagtaaaaataatgaggaacaacccgaatatgcaattcatatctgtgatagctaaaataatagtaaaaagatgcacatccagccctgcagtgtgccctgtgagccgaggctgctagactcccattcaccaccaaagggtacagttgtccagaaacaacacacaacacataagagtgacacagaaggtagcccagagtttgggctggggagaggaatccactagacaactataacaaggaggacagcatggaaagtggcatcattttgtgatatgattgatatcattaatttatatcatcggattgtgaacaaagttagccaatggactatgagagtgactgacgtagcagcttctctggcttcgtgtgctgcagatgagaggagaatgtttgggaggatgctggacccacagctcacaacagacatatgacagacgtagctgatcccaacctcaagtaggatgttcttgatgagacagcttccctggtgcactggatatcagatcctgtatagtttcagaacttgtgtagtttgtgttgctttggctttttctctggatcttttaggtgctaatgaaatgagagtgcttcacaaaaaaatggggcagacaaaggggatagttaagggcctcctccaagcaatgtggatatcataaaataaatgttaaaaaatgaaagaactaaacaagaaggtgctggggttgacacaaaggacttaaaacagcactaccaggagttgggtgcagcaatgggcatcccttcaggtccatcagcaagtcagagacctaaacaaatattccctattcatgttgaattggcagagtgtaaaaatctagaagacaaaatggccaggaaaaatgtgcgattttgcatgggtgaaggtctggcaagttaatcatcttgaggactgttgaggtcctgaggtggtcctgcccttgcttgatgcccaggccgtagtccaactcacacgaaattgccagggaatagacagtagtttttttagtagttcttgttatcaggcataagtgcatttgaattttctcttcatggcctttcctggcactatttctcattttttttaacacacatagtttcaactagatttatcaccttcacagggtcacagagaagggtggaagaagggaggccctggtatgggtctcgaagaaacatggaaaagagtggagagggacaatagcagggtgtaaggaattattgagaccttactctgcccctcccaggaggctcaggccagcctttttctgcatttgaggttctgggttataaacgctgtagactcctcccttcagggcagggtgacaactatgcaaatgcaagtgggggcctccccacttaaacccagggctcccctccacagtgagtctccctcactgcccagctgggatctcagggcttcattttctgtcctccaccatcatggggtcaaccgccatcctcgccctcctcctggctgttctccaaggtcagtcctgccgagggcttgaggtcacagaggagaacgggtggaaaggagcccctgattcaaattttgtgtctcccccacaggagtctgtgccgaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacacacagtgagagaaaccagccccgagcccgtctaaaaccctccacaccgcaggtgcagaatgagctgctagagactcactccccaggggcctctctattcatctggggaggaaacactggctgtttgtgtcctcaggagcaagaaccagagaacaatgtgggagggttcccagcccctaaggcaactgtataggggacctgaccatgggaggtggattctctgacggggctcttgtgtgttctacaaggttgttcatggtgtatattagatggttaacatcaaaaggctgcctaacaggcacctctccaatatgacagtattttaattagtgaaaattttacacagttcatcattgcttgcttgccttcctccctcctgtccactctcactcactccttcttttattttctacttaattttacaaaatcatttaacccctttttgaactattaataggttatctttgtttggtgattgttttcctttcaataatatgtactgaataattcatctttgtgccaattcataagtattctggtgtaataaagacttctttcataaaaattggataaattaaaataaagataaatttttaaaaacatacgatctatcaaaactgaaccataaagaaataaaaactctgggttgggtgtgtttgctcattcctgtaatcccagcactttgggaggccatggccggtggatcacctgaggtcaggagttcgatatcggtctggcaaacgtggagaaacgctgtctccactaaaaatacaaaaattagctggacatggtggtgctcgcctgtagtcccagatacttgggagcctaaggccagagaagagattgaacccgggaggcagaggttgaaataagccgaaatctagccactgcattccagactgggcaacagagtgagactccatcccgaaaaaaaaaaactgaacagacctatgagtaaagagattgagtcagtgatttttcaaacatctcaaatcaaagaaaagtcaagaacttcatggcttcactactgaattttatcaaaaatttaaaaaaaaactagaatctctatacaaatttccaacaaaataaagaggaaaaaatacatgcaagcttattttggaaggtcctatttccaaagcaaggaaaagacactccaaataaataaaattacaggctaatatccctgattatctagtttcaaaaactctcaagggtggtgagaaaccaaattcaacagcacattaacaacagaattcaccatgatcaggtgtggtttatctctaggaagcaatgaagtttcaacctgcagaaataaatgtgatatatcaaatgaaaatattgaaggactaaaaccatatgcaccatatgtccatgtcaatagatgcagaaagagcctctgtcgaaatccactacactctaatttttaaaaatctgaacatattatgcataaaacatatatacctcaacataataaagaccacatatcacaagcccacatctaacatcatacacagtgatgaaaattttattttcctctaagactagaaactagacaagatgcttcactatcaccaatattattaaacacagcactgggtggtctagacaaaacaggccagaagaaaaaaatagaagtcatccatatagtaatgaataaatataaaatatatttttacatattacatgctcttatttatacaaagccttaaacactccaccaaaaaagattgaaactaatgaagaaattcaataaagttgcagaatccaaaatcaaacttacatttcaagatggcaggttagaggcattgctagtattcctcttccacttggaaggacaaactgatgtggagagatgaacatcgcggacttattttcaagaagcaatgcaggaactgaacagaaacactgaaataatctacaaactttctgaaaaagcaggaagctgcagcctacactgtgagtcaggtgaagggctgggagtccccagcatttgagggagaacagccaaaaatttcagccagtggtcccaagttgaaagtagctctcaacaggggtgtgtaatataacctagggttgggacgaactcccttggccagggcctgggtagggaagtgttaaaagtggtctctgcaagtttaggagccatgggtgcaggagctggtgccctgctttgcagcagacaggaaggggcatggcatgaaacccatggctgcagtctccatggggacagcctatgactcctggcatttggaggtattgatcacagattgactgaaactcatctcactgctgccagtggaacaccacgggagtggatcagcctcaccaagtatgtgggaactgtgtggggcctaccaccacctgccactccccaccccctgcccaaacttctgtggaggagaggcagccatggtcccatctggaacatcatcccagtggcctgagaaccacccctgtcccccacacccacaggggctgctgcttgccctgcatacagagactcagaggggaaacccacctggcccaaccctcaccttgctttgtgcagccacctgccctggcagcttaacacaaaagacagcatcttttgggagctacatagccacacccactgcctaagaatccatagtagcccccatacctgggcaacacaaggcttgcaaaaatcccaccgctaataatgcagctggtgctcttttgcaagcaccacctcttagctggaggccaaccaactatgcattacagcatctcctagtagactaacactgcatcctggaaggagaaaatgactgtgcgatctcagttatcaccatggcctgcaccactttggatgaccaggagatcctgagtctctccatgtgaccagttcattgctactatacccatcattcaagaaagccagtacacaaaggctatcaatatccatggaatttcacagagtctccttcactctcctgcctgccactcccatcagacccggttctgctgttcactgttgaaaaatatgaggacagttcacatcactggatcacttagagacatttgcccacaccagcctgaagtgtgtcaacgtcactgggcagctagacctagagaagaaacataactcacagtaccatggctcccaggttctcctcctcttaggggaagggagtgcaccacattgagggaacacctcatgggacaagagaatctggatggcaggccttggacaccagatccctccactggtgggaaacttcttctagcagaagtacagttgcagcactgggctcagctgggaaagtcttcagctctttctcaacagacagccctgttgcttgtgaagaatcttgaagaagaggaagcctttcccccttgtacaccactgtaggcacacttggggtctctcccacaagacctcagcatgggtgcaactatagacagcctttctggaacacatcattgtgactgcatcccccagaaacagcactttctggattcaggcttgcatgagacagagagtcacagttcctctctatttggcacatgaacatttgtacagatgaaaaaacatgcctgtcttatctgaatagccggaatactgggacagcagtatgtctgagaggtggataaatttcctactgacttgacaagagagctgaggtggttccaacccttcccaccgataagacctcagtgggactcactaaaacctctttcagccaactctgtcaaggctgggacttaatttacccacctgctttagccacaactagtttctacccaaggaaaagtcctccactgatgtgaagcttgagccatcaagcaaataaataaatcactggggacaaataaaataaacatgtgcatgccacagaggaatgagataaggtttaagagacctctaccattctaaccccatagaagacagtgaacttgctcacagaccgagcagatttctactgcaatcaacacataggaaagccatcatacaaagattctccataaccccggaactcttacagagtcttcacccctctaaggaccaaaaaccaaatcaggttgtaattaattataagcattaaagtctcattcttaagggaaaaaaatccatttaaaaacaaacacaagaaacagtcaaatcaaacataaattcaataataattagaaaatctaccaaaatgagaggaaatgagaaaaataactggggaaaaatgagaaaacagggtgctgtgccagtgccaaaaggtcacaaggtcacactacctctccagcaataaaccataacaaaaatggagtctttgaaatatcagaaaagaaaatcagaatgttgattgataagctactcaagaagatatcagaaaaaggcaaaaatcataataaataaatttataaaactgttgagaatatgaatacaaatttttacagagagatagacatcctaaagagaaaccaatcagaactcctgaaaatttaaaaaaatgcagggaattggaaagggaattacaaaatgccatggaaagtttgaaaaatagactagaaaaaagtagcagaaataacaatagactagaaacagtacaaaataaaagtagaagtaaaatattcgaggaaaaagaaaaaggaaacagttaaagaaaaaagtagaaagaccagactattattgaaataaccaaatcagagaaaaataaatttaaaaagagccaaaagaagtgaaaaaagtctccaggaaatatgggattatgtaaaacaaacaaatttaagaataattggtgctcctgaagaagaaaaaataataataagtttgggaaaacttctctgaaggaataattgagaactacttctctggcctgactaaagacctagatatccaaatccaaaaagttcaaggaactcctggggaattcattgcaaaaataccttcaccaagcatacagtcatcaggctacctaaagtctacatgaaggaaataattctaagagcagtaaaacgaagaaacccatcagaataatggcagacgtctcagcagaaacttgacaagcaagacagattagggttctattttcaaactccttaaacagaaaaactttcaaccaagaattcttttttatcccgccaaactgttttataaataaaaaagaaataaagtcattttcagaaaaacaaatgctgagggaattcatcactatcaaaccagcactacaagaaatgctagaataagttctaaaccttgaaacaaaaggccaatatgcacaaaaatggaacctcttaaaaattaaaaactcacggggcctataaaacaataacacaatatcaaagaataaacaaaattaggtaacgacatgacaaagagaatagcaactcatatctaaatattcacattgaatgtaaatcataaaaggcatggaagaaggaatttcacaaaaatagaaaccaggagtgagcaggactagctatttttgatctcagacaaaacaggacttcaaagcaaaaacaatttaaaaagacatagatgatcactatacaatgataaaaggatcaattcaacaaaaaattacaattacatatttatatgcaccaaacactggaggaactagattcattaaacaagtactgctagacctaaaaaactgagagagttagcaaaacaatcataatgggagattttagtacaatcatgacagtactaaacagatcttcgagacaaaaagtcaacagataaacaatgcacttaaatgactcactggaacaaatggatgcagcagatatttacagaacattctatccaagatctgcagaatatacattcttctaatcagcacatgcaacattctccaaggtagagcatatactaggccacaaaacaagtctcaataaatttttaaaacaatgaaatcatatcaagtatcttctcagaccacagcagaataaaactaaaaatcatctcgctaaagaactgtcgaaaatgaacaaatacatagaaattaagaaatttgcttctgaataatatctgggttaacagttacatcaagatgaaaatttaaaaattatcttaattaaattataataatgagacaagttattgaaacctcaaaaataaaggaaaagcagtgataagaggaaagtttatagtgccagctgcctgcatcaaaaagtctgaaagagcacaaattcacaacctaatgtcacaccttgagaaattggagaaacaagaacaaactaaacatagagccagaagaagaaaagaaataacaaagatcagagcagaactaaatgcaatccaaacaaaaaaaagcaatgaaacaaacagttggttatttgaaaaaataaacaaattcatgggtcattagctagattaacaaagaaaagaatatcaaagatccaaataagctcagaaatgaaacgagacattacaatctacaccactaatataaaaaataatttgagactactaagttcaccttcatgtgcacaatgtagaagacttagaggaaatggaaaaatttctagaaacatacaacactcctagattaaataaaaaagaaacagttactttgaatagacaaataacaaacagtgagattgaatcagtaattcaagaattgccaacaataacaacaatgaaatagggccaggtgaattcacagctgaattctatcaaaaaatttaaagaagaattgctgccaattttgctgcaactattttttaaatttagataaaaaagaatcctccctaaattattctatgaagctagtataaccaagataccaaaaccaggaaaacacacacacacagacacacacacactctacagatgaatttccctgataaatatagatgcaaaaatagcaaaaaaaaaaatagctagttgagttcaacagcacatcaaaaagataattcctcatgatcaagcgtgtttcatctcagaattgcagggattatttgaacatactcaagtcaataaatgtaatacatcacataaacagaattacaaataaaaaccttacgattgtctcaatagatgcagaaaaagcattcaacaaaattcagcattttttaatgataaaaactgtaaataaatgaggcatagaagaaacctgcctcaaactaataaaagttacatatgaaaaatccacagctaatatcatgctgaatgtgaaaaagttaaaagcatttaccctgagaacacaaacaatacaaggatgcccaagttcaccaattctattcaacatagttctggaagttctagccagagcaattagtcaggagaaaaaaaataagggtatccaaatttaaaaagagaacgtcagactatcactgtttacagatcaagggattatatatattaaaaccctagactcctccaaaatactaatagttttagtaaatgaattcagttaagtctcagattacaaaatacatgtacacaaattagtagcacggctatatatcaacaacagcaatgctgagagttaaatcaagaactccatcccttttacagaagctgcgaaaagatagtatatttaccaatatacttaaccaaaagggtaaaagatctcaacaaggagaactacacaacactgctgaaagaaatcatagatgatacaaacaaatgcaaatgcatcccctgatcatggattgcaagaatcgctattgtgaaaatgaccataatgcctaaagcaatctacagaatcaatgaaattcttattaaaataccaacattattttcttcagaattcaaaaataataacgctgaaatttatttgaaaccaaaaaaaagccaaaatacccaaagaaatcctaataagataaagaaaattggagccatcacattactgaacttcatattacaccacaaggctgcagttaccaaaacaacatggcactgacataatagtaggctcatagaccactggaacaaaatagagaacccagaaataaagccacatatgtaaatccaactgatgctttgcaaaatgtaccaaattttaaattgaaaaatagacaccacatttaacaaatggtacaagaaaaactagcaagccacatgtaaaagaataaaactggatttctatctgtcaccatataaaagaccaactcaagatgaatcaggtactgaaatataagacattaaactcaaaaattctagaaaacaatattggaaaaacacttttagacatcagggtaggcaaagaatttataactaagaccccaaaagcaaatgcagcaaaaacaaaactaaatttatggaacccatttaaactaaagtgtttcttcacagcacaactaagagtcaatggagtaaaaagacaactcacagaacgggagaaaatatgtgcaaacttcacatctgacaaaaaattggtatattcagaatctacaaaatactaaaacaagtcgccaagaaaaaacaaacgatcccatttgaaagtggacaagggacataaatagatagttctcagaagaagatatacaaatggccaacaaacatatgaaaaactgtgtaacatcactaatcatcaggaaaatacaaattaaaaccacaatctaataacacctaatcctgcaagaatggccactataaaaagtcaaaaaacaaaagggaatgcttatacactgttgatgaaaatgtaatttagtataaccactatggaaaacactattgagatttcttgaaaagcagaaaggtagatctactattttttttttcttttttgagatggagtctctctcagtcacccaggctggagtgcagtggtgcaatctcatctcattgcaacctccgcctcccgtgtcaagtgatgctcccacctcagcctccggagtatctgggattacaggcacccaccatcatgcctggctaattgttttttgaatttttgtagagaaggggtttccccatgttggccaggctggtctccaactcctgacctcagctgatcctccccgctcggcagcccaaattactgaaattacaggcgtgcagcatcacacctggccagatctactgtttgatccagcaatctcattactggagagctacccaaaggaaataaagtcattatatgaaaaagacgtgtatatgtatgtttatagcagcagaattcaaaattgaaaatatgtgaaaccaatttaaatgcccattggccaatgagttcagaaagaaaatgtgacatcgcctgtaatcccagcatttcgggaggccgaagagggcggatcacgaggtcaggagatcgacaccatcctggccaacatggtgaaatcccgtctctactaaaaatacaaaaaatttgccggacctgttggcgtgcacctggagtcccagctactcgggaggctgaggcaggagaattgcttgaacccgggaggcagaggctgcagtgaaccgagattgcagcactgcactccagcctgggtgacagagcaagactctgcctcaaaaaaaaaaaaaaaaaaagaaaagaaaagaaaaagaaaatttgacatatatacatcatggaatactaccaagccgttaaagggaatggcataatgtcctttgcagcaacttggatgaagctggaggtaatgagtataagtgaagttacacaggagtagaaaagcaaaaactgtgtttgcacacttacaagtgggagatgggctatgaacttgcaaaggcatacagagtgatataagggactttggagactcagaagggaaagaataggatggatactagagagaaaataactacactttaggtagagtgtacactattcaggtgatgaatgtactaaaatctcagaatttattgctatataattcctccatctaacaaaaaaatatttacccccaaagctattgaaattaaacaaaaatcaacctacaaaaataagcatcttctgtatacactaaaaaatgattattcaaaattaaaatcaagaaaataaatctaaatacaacagcttaaaattcataaaataaattttaccaaaataaatttaacaaggatacaaaatatctgcacattgaaaattataatatattgattaaaatgtaagaaaacacaaataaatggaaggctatcttgtgttcttgtgttactggaacatacattgttaatatgtccatcctaacctaagcatttacagattcaatgcaatcccattcaaaatttcaaagatatgcatttacataaattgaaaaaaaaaacctctctcatttgaatggctggggtgattgacccggactatcaatttgaaatcagactactactccacaatggaggtgagacagagtatgtctggaatacaggagatttcttaggacatctcttagtattactttgccatgggattaagatcaatgggaaaaaacaacctaattcaggcaggaatacaaatggcccagatacttcagaaataaaagtttgggtcttcacccagattaaaaatcctgaccagccaaggtacttgctgaaggcaaaacaaatacagaatgggtagtggaagaaggtagttgtcaataccaggaatgaccacacgaccagaagtggggaccgtaattgtcgtgagtatctccttaagctgataagcaacttcagcaaagtctcaggatattttctccatatcttgttaggaatatatttctgcatgtgtataactgtactaagaaaatatcttcattgtgccggacacggtggctcacacctgtaatcccagcaatttaggaagccaaggtgggtggattacctgaggtctagaggtcgagaccagcttgaccagtatggtgaaacgccgtctctaccaaaaatacaaaaattagcctggcatggtggcaggtgcctgtaatcccaggcttctcagaaggctgagacaggagaatagcttgaaccctgaacccgcgaggcagaggtggcagtgagccaagattgcaccactgcactccagcctgggcaacagactgagactccatctaaaaaacaaacaaacaaacaaaaatatattaattgttttcattgaatttgttttctttttatcatgtgtcacaagatttattgacttcctatcagcatttaaatgttgttaactatatgtagtggtatgtatgtaggttaaggattagtgcactttcagttgtatgaaggatagctgtattatgttaggcataattatgaccttattattgtctttatttggagttcaagcatgattgcagctagatgtgtaggggtgctaagttgacaagaggtgggcttttgatgcttgatactaggtgtcaacttgattggattaaaggatgcctacgtggctgggaagtattgtttcttggtgtgtctctgggggttttgccagaggaggctgacatttgagtcaatggactggaaatttgagtttgtcatgttgcatgatccttttaaagtcttatagaacttagttgactattattttggtgtagttcatttgtataaatatttctttgaagtttaattttcttcctttgcgtttgtctgtcactggcaacacggtaattgtagccttttagaaatagcttagaaggttggcgactcatcattttttaaaaaagttagagaacagttggcatgacttttttaaattctgagagccattttttatctaacatataggctatcatgaagaatatttatagtgtgcttgagaagcatgcgtattacactgcgcttggttggaatgttctgtagatgtctattaggtcagtttgttcaatagtgttgtttaagtccatgggcttcctaagaatttttttatgggtgttctatacattattgagggtgaggtgttgaagtctcctcctttcttattgttttctatttctcacttcatatctcttaaactcttgttaatgcggttatatttctatttttataactatgtaaaatagaaataaaataataattgcttagtaattttaatgggaaaatcacataataagaaattatattttcccaaatgctgccatcaccactaaactcctccaggagtctcacatctgctctgggctctgctctctcctaaggggtcccacatcagagtttgctacagaggaggagacaagaaaatagggccctccctctcctgatgaaaaccagccctgccctgaccctgcaactctgggagaagatctctagtccagaattaccaggagtttggatttgatgatcagctctgtacaaacatggctcaccatagagttagggctgagctgggtttcccttgtcattattttaaaaggcgaataatggagaacttgagatatggagtgtgagtggatatgagtgaaaaaacagtgattctgtgtggcaggttctgactcagatgtctctgtgcttgtaggtgtctagtgtggggtgcagatggtggagtcttggggagagttggcacaagctgaatgtgcctgagactctgccgtgcatcctctgaatccaccttctgtagctactagatcagctgaatctgccaggctccaggaaaggggctgcagtgagtagtagatataatgtacgatggaagtcagacataatatgcagactctgtgaaggtcagattcaccatctccaaagacaatgccaagcacaggttgtatctgcaaatgaacagtctgagagctgagaatatggctctgtattattgagtcaaaggtaccaaatgaagggacatcagtgtgaacccagacacaaaatttcctgcagggaggagggaggaggctgggctgcagtgggcactcagcacacacaaaaggcagggacagttccaggggcaggtacaggtgcaggtgaaggcaaaggtctactttccttccagatctgtggattcctctgcatccaacagttcgcctgggcctctgtctttatggatctgcgcctaccactgatgtctctgggttagtaaagtttgctactataggaggaaacattgtcatttgtcagaaaggcgaataatggagaacaaaagatattgagtgtgagtggatatgagtgaaaaaacagtgattatgtgtggcaggttctgaccaaaatgtctctgtgtttgtaagtgtctagtgtgaggtgcaggtggtggagtgtaggggagaggcaagaggcagaaaagcgcgcaggaggccgggtgaggctgtagacattgtcagctcactatgccaatctcacaacagtgctggagaaggtgggagtctgatggagcttcccaacaaccctgtggtctaagctaagtccattaaggccgctggttcctcctggaacatagctgtccatcaggaatcccccatgtgcccagcagcagccacgcgttagcatcttcactgtgcacagtcattgtttgggaggagctccaggatgggtctctttgtcaaaaaccgggtgatggtgtcagagagctgtgccgggtgcctggtccaggggctccctgacgttggaggtataggaggtgcgttctcagggtgggaacaccttttatggaaatgtacagaagaaaacatgattttccttggtcctctcagatgacatggagaagaaagcgcgcagcttgcaaacaattgtaatgtccttgtaatttcctactttatcccaagttcattgattcttgtaaaccttggtttctgtccaagtacagagatattgattagagtgagtttggttctttccacacactaaccctcacctcccccagataaagagcacattgtccttactctgagtctgagggaggagctgttcctgtacaactaagggcctgcagagacccccatgtacagctttgcagagtcagatctttccacatgtgaggcgacctccacggcccatgattgctgctcaggtctaattgtggattcaggattaggacatcctttaggctatcacaggtcaatcagattctgaaaaatcactgttatcatagacagaggtaataattcaatacccactcccctgacagcagattctctttcttatttggttgaaagtttgaagaaaataagtgaccatttattattcttattctaactttagtatccactatttgttctaggggattcacaaatttcaaaacactgagctcttcattctcatgaaaatgtgcatatttgtgaatttcaacgtgttgttcagaacctgtgcatgccgacatctgtatttctcgtgcgttcttggcctggcgaagccctcacagaccctctccctcatctgtgctgtctctgcttctccatcacaaccagtgcttcctgctggagctggatccctcagctccccagggaagggactggagtgaatcaggtgcacaggtcatgagggagaacacaacgcaacccacgcctcaagagtccagtcaccatctccagatccacatccaaaacacagtttcttctacagctgagctacctgagcaacgagtacacaaccatgaatttttacacaaaagatacagcaaggggaagtcattgtgagcccagaaacaaacctccctgcagggaagctcaggaactgcgggaggccctcgggacaccagggggcgctcaggacacacatcaaggcaggtgcaagaggaaaaggtgctggagatggggtttggcatcatcatcatatttcactgacacccgccactgtgtttattctcatgtacgtgattctttgtattattagaaaatggcgtttatgtaaataaataaccatatgtaggtgcatcaagtcgtcctctcccttttttttttttttttttttttggagtcctgctctgtcacccaggttggagtgcagtggcgcgatctcggttcactccaacctccgcctcccgagttcaagcgattctcctgactcagcctcccgagtagctggaattacaggtgtgcaccaccgcgcccggctaagttttgtatttttagtagagaccggatttcgccatattggccaggctggcctcaaactcatgatctcagttgatccgcccgccttggcctcccacagtgctgggattacaggtgtgagccaccgcgcccggcccgtcctctccatcttatgtggaacttttccattaagactctgagtccctggatttatttgagaacctcataaatcatggtcaattatgtctctttctcctctttctcccttcttcactcctctctagctcacaaactgaaacacacacagaattttctaacttcaattacctgatgtgttgaagacaattgattaaagcgcagcttttccagttcagccactgttcatattgttgtaagaataagaacgttgtgtttctcagctgcgtgcttctctaagatgagtagcagcttttttaaataatacccagaggctgaaagcaatctgaataccaatcatcagcttaatcagtaaacacaaggtggtaaattcgctcactggaaaaacaccgattgttacaatcaggtaaggctggatactctcaacagcaagtgtaaattcacaagtatatatgctgattaaaataagacaaacaaatacaagtacatacatactgttccacttttacaaattctataaaatgaatgctaatctaaagttacataaagaaaaccagtagctgactctggacctggtgtgaggagggaagggttaggaaccagaaattgtaggaaatgaagaagaaatgctgaaggtagtggagttttttctatgttgatgaaggtaatagttatgtcactattaatcaaatcgtacacattatgggatgcctattatttgtgaatttcaccctattaaaatattacaagttaaaacaagtataattttgtagaaaattagttagacatagatgaataaaatgtatgataaataaaaaaagaaaatcacagaacaatagcataaggacttcactcatcaaactgaagaaattttaaatttctcaacacagaattaaagatttaattagatatacataagaaatcaaagactcctggatatacacacaaataaaccctaagtccacctgtatttttagggaaacgctagaatacaagaaaataatgtcatgatttcattacataacgggggttaatgaaaccacatcaggcatgtccagctgtgtcctggggttggttcagggaacgggtgtgtcctgtggttaggagacgtggcaacaagctcacagcatcagttctagctgacaccataaaaaggccaagagatcacaattaaaatgtcatgcggatgtcacatctgtgggtgcggcacactcccccatgtgaatacggaaaggttaactacactcttcaggtgtctgctgagagtagagctgtctctcaggaatgtccaaaatggctcaatagagcaagaaaggagactggctcagggttcctgtagtgccttggtggtgtgggcagagtgagggttctcactcaagaaaggagtttgtggcgtttgaacatctacatggcttcaaatagggtaactcctgtgattcctaactagattcacctcgtgtgggaaagaaaggagatgatgaaggaatgagccttaagttatcagcagtcagacatcaaaacaatagtctgatgacttattctatgtagcacctataaaaatcgttccgggcgcggtggcccaaacctgtcatcccagccttttgggaggctgaggcgggtggatcatgaggtcaggagttcaagaccagcctgaccaatatggtgaaaccccgtctctactaaaaatatttaagaaaaaaaatagttgggttatggtggtgggcgcctgtaatcccagctactcaggaggctgaggcaggagaatagcttgatcccagggggcgtaggttgtagtgagctgagatcacaccactgcactgcagcctgggtgacagagcaagactccgtctcaaaaaaaaaaaaagagtaaaaaaatatcagcccaagatgggtggacaacaaccaggcctacaaaaaaggagaagactccttataagaataagcaaatcataatgaaaattaggaggaaaacaaggagagtgaggtgaaaggcatggggcaggggattagacaagggtcctgttccaatgtcttgtgtggagacttttcactatctaaaatcatccacctattctgaatgtcttaggtgaactgtctgctccaaaacatcagaaccaccagaggatttttgaggatactcagtttaatatcttatatttgaggtgccttacaactgtgtaaaatgcttagttattatcagtgtaattagagatagggcctcactgtgtcacacaggttggggttcagtggcacaatcatagctcactgttaccttgaacttctggcccacataatccttctgtctcagcctcctgagtagcatggactagagaggtgcaccaccacacacagctgatttaaaaaaaattgtttcatagaaatggggtctctctatgttgcccaggctggtcttgaactcctggtctcacgtgattccccctggttttgtttctcaaagtggtggaattaaaggcatgagccaccgtatctgctcagaaatgattattttgttgcaaaatactaacccaagaattgactccctgaattttctctgcagcattttggttaatagtgtctgataagatttatttcaatagtttcaacagcagagtgttctcctgatgtttcctccaatagtgataatttcatggttgaagatcacaaactactattaaaagatgacataaaaaggcaaccttaaacttttggtgatggagtgagtataataaaaaattactttcaatattgtgtaacacacgcctgcagtaggaggaaggtgagcaatgagggtaaaatttctaaacgtatgaatcttccagctccccagtcatagggcagtaactgatgagtcctgagagagggaacgtaatgccgtagtgcttgtgggataactcttggccaagagagtttccatattttattaaagtggttataatttttaaatttaaagatgccattttttcaacatatccagaatattgtgagcgggattgattctgtatgatacgagcaatggcgatgccttctgtttggataatattacaaaccaggttaagactgagtggtgtaacgatgcaccagaacattattctagcttccatactagattttgtttttctctttgtttgcattagtttcaaatttatatgtaaggtctctagaatgtaggagtttatttgaaagtgtcttttcttgttggccattttgatggggcttccaggagatttaaaaacctcctctgcctgcagcacagtttaaaattctgcgttacagtagaacatctgtatttaatcctggtctttggttgattgacaagctctaatacatgcaataacttctgccttctgggctggttttacatcaggtagaggaatatatactaagtgaaaatttgcactagtaatatatattattaataaccaccacttgtattatttaagtgttattaatcaagaattaatgttaaatcaagggtctcaatggcaatattacctaagggatatacaagatattttgctaatctaggtaaaatagatgtgaacacactcttagtatccagccatgtctcctgtctatcacattattaaccacacagtaaattcacttgggacttgttctaattatctaattagtcacttacttatctcaaagcctctggattattatgtgtgactattttagcagagagtgaagaaagacaacccaggctgaccaaacaatgaggaaaatcacaacctgatgaaaccagaaacctggatgtgagtggctccaggattgaataatttgacagctcatgtgcccaggctgtttcttgtctcagttttccacactgatacatccagaaaggcagcttcaccccccagaggactcccatcatgctgtgacatggtgacaacattcccaaagctcacacacatatgttaaatattggctggaaaaggggcagagacatttctggaattctcttctgaaggaccatgaatgcctcaaccaaccatctcccctgcctccatgactagaaatgcaccacgtgcccacacggatattcatccctcatggggataagactccattgatgaggctgactattttatcatataaaattactaaagactgatttaagggtttcaaaaactaattgaactctgttgttctatgtccaccagagattacaaatcttccaatgatgccttctttgttttttgtctgcttgactttgtctcttcaacttgttctgtaccccagagaatctctttcagctccctcaggtgcattcaattgttttatttaactgacaatttctaaatcagttaaagacattacgctaaagactccatattcctaggtccatattcctttttccatattcctaggaaggcattgtgacccagagtctgggcatgaccttgtgagtgttcctgaccctcctccatatgagatgctggtctgggtgttcttgcccctttccctggggtagagtcctcctgttttccccaggtgctccctcccacagctctagtgttctcaatcagtgtcatcaccttccagatcttctgccctgccctgcagactaaggctctgattccataagcaagataggggagctgctcctcaatagatctttggtgaggatctctgttcccatctcaattcctgtagggtggaaccagtgttcctaggattctggtttcagtagcttgtccctgcagagtaaattcttagttctgtagggggattaagggagttgggtctgaatacattttagatgtcgaggatcttgttctctcccagaaagacacttcgggaaagtaagactttggtaactgtcccctttcttggggaaagggattcaagaggataggttgcttttgggcatgtggtcccttaaaatttcacactaaaaagcgtttcccacactcaatttcaagcagcccaatatatatttgtattttttcttggaacagacaatattttatattccagactctgccttaggtaatttcaaaccctggctttgttactctctacaagaaattgcttctccataagcttcagatttgttgtgtgttttgaaattttatcagaaatattaaagaaaattggcaaaattccatcctccatgtttatctgttattgttgatgcagttgtaaaaaataagaaaaatatattccttttttctgtacatttccaagcttagtagcaaatttttagtaacacccagaataataaaaaattcaaatattgtttagctgcttaataggaaaacaaattatagtaaatttgtttgctagaatgctacccagcatttataataagtaaacatttgatatacccaactacaaggtaaaatatccatttatgctaactaaaataagccaaacaaatgagaatatatactgttatttcatttttataaattctgaaaaattaaaatgaatttgcagcaatgtaaagatcagtagttgccagggaaatggtagaagaaagaaaggaaaaggagaaagaatacagaagaacaaaaggaaatgttaagaattctcttgtccaacttgataaggatgacggttacatcatttttatcaactgtaatctttaaatatgtgaaagtttattatctgtaaactaaacgttataaactttattacaagcaaaaattgaaagttagacaagaaggagtgatagaaagagaaaatgtatattaaatttcagaaatatttaagaatgtatctgcctgaaccctagttctcaccatatctttaggtgaatgctaaaatgcagcaaaatcacgcatgttctcactacagaaagtgggttctacaaaccacactcggcacatttagctttgtcctggagttggtgcagggagttattggggccagtgatgaggagcacaggccaagataccagcgattacttatcccaaacatgagctctaacatacacacttagtcccttttccgtgtgtggtttacttccacatctgtacatggagagaccactgactgacaaaatataatttatacaaatatgtaaaattaaatagggtgatcagttcaaggtgtttatcacagcataattttacaataagacagcatatttcccaaataccatcattgtcaccaaactccttcaaggcacagtcatcttatctgggccccgtcctctcctcaggtgtcccaccccagagcttggtatatagtaggagacatgcaaataaggccctccctctgctgatgaaaatgagcccagccctgaccctgcagctctgggagaggagccccagccgtgagattcccaggagtttccacttggtgatcagcactgaacacagaccaccaaccatggagtttgggcttagctgggttttccttgttgctattttaaaaggtaattcatggtgtactagagatactgagtgtgaggggacatgagtggtagaaacagtggatatgtgtggcagtttctgaccttggtgtttctgtgtttgcaggtgtccaatgtgaggtgcagctggtggagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagacacagtgaggggaggtcaatgtgagcccagacacaaacctccctgcaggggcgcacagagccaccagggggcgctagggaccgcctgagtacgggacaggtcccaggagcaggtgcagggggaggtttcctttttccttggctggaaaagtcacctttatcttcccagggctcgagccttctaggctgtgatattttattacttgtatttactgttcatttattatcattagtttttaaattttggtaatttttacaactctatggatatatttttaagtgtatactttcaagaaataaacattcctaattatttgcactgattctcccagagttttattaacatttgttgacatcagcaactacatagctatagggacaaacacttttaacgatagacagttgtttaggcctgaaaccccgtttatactaaaaatttacaaaaattagcctggcgtggtgaagggcgcctgtaatcccagctactcgggaggctgagcaaggagaattgcttgaatccgggaagcggaagtcacagtgagtggagtggactgccactacactccagcctggcgacagagcgagactttgtatgaaagaaagaaaagaaaaggaagaaaggaagaaaggaaggaaggaaggaaggaaggaaggaaggaaggaaggaaggaaggaaggaaaagagagaaagagagaggaaggaaggaaggaaggaaggaaggaaggaaggaaggaaggaaaagagagaaagaaagagagaggaaggaaggaaggaagaaaggaaggaaggaagaaaagaaggaaagaaagaaaaaagatatataaacacgcagacctatgcatataaccatagggatttatattaaacattacaataaaataattctaaaaatgtgtcctaaggaatcaaacataatgatgaagtaaatataaatgttagagtaatttataattgatttgttatttttaatcgtttacatgaatttatttctatttgttcatttaaaagtagtatattggtcatttcaagagagctaacagtaaatttcagatgttgttgttacgatatatgataagaatttgaggtggtgaatgataattatcttatttctcaattatcttagttattccatattgtattcacaaatcataacattgcttcttaccttataaatataaacaaccataatttgtgaaattacaataattttctttattttaattttttaatttatcccagatcattatctttttcttcgcttccagatctcactggatcatctcgagggcccatcctcacccctgtctcccgaagacttctggagaggctgcaggacgggcagaaggaggagccccgtgtgagtccacacgacctggagcctccctctccttggattaggccatctcctcgggatcacagggctcttcattatccttaccccgctgttgtaccaaacaagcaacatcacacttcaattcatcagggtttgctttaattttctaaatcatcgtgaaggtgataattttaacagtaacgtatcacaaccaaataggataagcccttttccatggaacagggtttcttatcaggatatacatgtattatggattctcaatttatttgtagatgagatgctattatctccatattgtagatgattctgctaagtcatctcttaaaattaatttttccaaagactcaaacaaataaatgatataattacaaatttcaggtgtaatagctgagccaacattgagattatattaacatttagaacatgaacttgcaaatattgttattttcctgtcggctgtccccaattgtgattttatacagaatattagaaatttatcctgataaatcaggttaaaatattatatcactagtttattaacttttataactaataatataaaatgttccacatattttttagccatgttttacttacccgtgatatgtgtatttattaatttttcattttaagatgccacctttatctttcttatttctgggattttattctagtagatagagctgaatgcattttaataattatcataataatcacatttacattttgcattttaattttcatatacattttattaatattttaatttcaatataaaatattttcctacaaatgtcaatttttgatttttatgagataaaattaacctatacaaaatacatatattttcaatgtacagtttgagggtttctggcaaatgtgcacacatttgtctccagcatctaagttatgatgaggagcaggtccatctccacaacaagtgtcctcttcggtgcttccagtcagctctcacataaggaattttttttcaaatttaatatagatacagagggtaaatgtttggatttgtcacgggggattattgagtgatgctgaggtttggaatacagattcccaccgacctctccctcccactctccagcagtccacagtgtctatcattctcataattatgtccatgtgtgctcaatgctgaggtcttacttaggagaatatgtggtattcagttttctgctcctacattaatttgtttaggattaagggccccagcttctttcattttactgcaaaggacatgatttcattctttttcatggctgtgtagtattatacattgtagatgtaccgcattttgtatattcagtctaccaatgatgtgcatctggtttgatctatgtcgttgccactgtgaatagcacagcaatgaacatagatgtggatgtgtctttttggtagaattatttgcttacttttcagtgtataccccgtggtgggattgctgtgtaaaatgatatctctgttttaagttctttgagaaatctccagtctgatttccaaagtggaaacaccaatttatattcccctcatcagtgtatgtgttctcttttctccacagtcccagcagcatccattgttttttgactttttagtgataaccattctgagtggtgcgtggctgcacacctacagtcatctcatctttgataaggctgatgaaaacaagcaatgaggaagggactccctgttcaataaatggtgctgggacaactggctaggcatatgatgaagattgaagctggatatctactttcaacatgtataaaattaacacaaaattcattaaagttttaaatgtaagacctcaaaccataaaaatccttgaagacaacctaggaaatactcttcttgacatcaggtttgacaaaaaaatgttggctgagtatccaaaaccaattgcaacaaaaagaaaaatagacaagtggggcctaattaactgaggagctcctgctcagcaaaacaaacaaagaagcaaacaaaactaacagcacagtactcagacaacctacagaatgtggaaagatattcacaaacgttccatccaacaaagccgtaatatccagaatctatagggaaattaaacaaatcaagaagcaaaaaataataataataataaccccattaaaaatgggctgatatggtttgctgtgtccccacccaaatatcaacttgaattgtatctcccagaattcccatgtgttgtgagacggacccagggggaggtaattgaaccatgggggcctgtctttcccgtgctattctcttggtagtgaataagtctcaccagatctaatgagacttatcaggggtttatctgatgggtttatcaggggtttccgcttttgcttcttcctctttttctcttgccatcaccaggtaaggagtgccttttacctgccaccgtgttttggaggccttcacagccatgtggaactgtaattccaattaaacctctttttgttcccagttttgggtgtgtctttgttagcagtttgaaaatggactaatgcgtgggcaaatgacacagacacttctcaaaggaatacatacaagtgaccagcaaatatatttttaaaatgtttaacatcactaatcatcagagaaatgtaaatagaaaaatgttctgatttctgtcactataggtccattttcttgttttgaatttcatatacatggaataaaatattatagctcatttttgtaagaagcttttactatctgtgaggttcattcatgtgatagcatctatcaaggttttgtcaacatatgtataaatatgtatgtactcatacacatatagatatttcatatctgaatcagtccattgcattaataaatgacagattattaaataaatcagttcattaagtgaataagtgacaatatgtatatctattttcctgttgatggaatttaaatttgtttccaatataaatatcataaacaaaactgtcatacatatctttgtacaagttcttctgtttatattcacatatttttattgataaaatatgttgaaatataagtatgcattataccttttcagctttatggagctatcactgacaaataaaattttctgtatttaaggtacaccaattgatgtattgatattcttggggaaatgctcataatgatcaaggtaattggcatgcctatcatctcagagagttaacattttatgcctttaatttattgtgtatgtgtgatgaaatcacctaatatctacttgtctggcaaaagatatgtttataatgcaacattcattagtatagtcacattgctgtaggtttgatctccagaactatttcaacctgtgtattagtccattctcaccctaatgtaaggaactacctgagactgggaaatttatggagaaaagtggtttagttgactcacagttctgcaggcttaacagcaagtattactaggaggtatcaggaaacttacagtcatcacagaaagtgaaggggaagcaaggaccgcttcacatgctggcaggagagagagaaagagcaaggggagatgcaccacccttttaaaccttgagatcttgtgagaactctgtcacaagaacagcaaaagggaagaccgcccgcatgatccaatcactccccatcagacacctgctacaacacttggggattaaaatttgacatgagatgtgggtgaaaacacagagccaaaccatatcattccacccatggtctatcagaaatctcatgtccttctcacattgcaaaatatcattatgccttctcaacagtcttccaggcttaactcatttcagcattatcacaaaaatctatagtctaaagtcacctctgagacaaggtaaatttcttccccctataaacctgtaaaattaaaaagaagttagttatttccaagacacaatggagatgcatgtactgggtaaatgctcccattccaaatgggtgtcattggccacagaaaaggggctacaggccccatgcaagtccaaacaccagtagggcagccattaaatgttaaagctacagcataatttccttttaccccaagtctcacatccaggacacactgatacaagggttgggctcccaaggccttaggaagctccaccctgtggctcaacgtggtacagtccccatgactgctttgataagctggcattgagtttctatggctttacaggcacaccatgcaagctgttggtggatctaccattccggggtctggaggaaggtgcccctcttctcacagatccactaggcatctagtgcctagtgcccagtgggtactctgtgtgggagatccaacaccacattttccttccacactggcctagtagaggtactccattagggctcagccctgcataagacttctgcctgaatacccagacattttcatacgtcatctgaaatctaagaggaagctcccaaacctcaactcttgccttatgtgcacccgcagactcaacaccacgtggaagcaaccaaagcttagggcttgcaccctctgaagcaatggcctgagctggaccttggcccctttagccatggctggcaggagagggacagggatgtcccaaggctgcacagagcagtcgggtcctgggcccggaccatgaaaccatttttctctactgggcttctgggcctgtgacgggagggaccgcagcaaagatctctgaaatgctctcaagatgtttttcccatcgggttcctcattacttatgcaaatttctgcagcccgcttgaatttcttcccaggaaatggattcttcttgtctaccacatggtcaggctgcaatttttttcaaccttttatgatctgcttcccttttaaacataagttcaaatttcagaccatctcttaatgaatgcatatgacttacattttcagaaacagccagggcaaacattgaatgctttgctacttagaaattttttctgctagataccttaagtcatctctccctagttcaacattgcacagatctctagggcaggggcaaaatgccactagtccttttgctaaagcatagcaagtgtgagctttactccagttcacaagaagttcttcatcttagcatctgagaccacctcagcctggactttattgtccatatcactatctgcattttgttcaaaaccattcagtaagcctctagaaagtttcaaacttttccacagcttcctgtcttcttgtgagccctccaagctttaccagcctctgtccattacccagttacaaagtcacttccacagttttaggtatcttaatagcagtgcccactcctagtgcaaattttctgtattagttgattctcacactgctgtaaagaactacctgagactgggtaatttatgaagaaaagagtttagtagactcacagttcttcaggctaaacaggaagcattactgggaggcatcaggacacacaatgatggccgaaggtgaaggggattcaaaaatcttctttgcaagatggcaggagagagacagcaagggagacgggaggtgccacacttttaaaccatcagatctcttgagaactttatcaggagaacagcaaagaggaaggccaccccattacccaatcactttatattaggcccttccttcaacatgtagggattacaatttggcatgagatttgagtgggaacacagagccaaactgtatcaacctgcataactgaaagttataacctctgaccaacatcacccaattttttcctcctcccagcccctgggaactactattctactttgcttccaagaacatgaatattttagattctacatataaatgtgttcatgcaacatttgactctctgtgtctcactccacttagcaaagtgtcctctatgtgttgtaaatgttagaatttcctcgtttttaaaggcagaataatattcacttttaggtaggaataagccacattttatctgttgattcatagatggacattgacctattttctatatctaggctattatgaataatctcacaataaacatatatttgtcacactcactttattttctctagatgtatactcagaagtgggtatattctatgttcaattcattgagtaatcttcatgctgttttttcataatggctgtactaatttgcattttgttccaaaccatacatggataactttgtaccacatattcaggtctttgtttaagtcttaaatccatttttagctgatttatatgtattgtgtgagataaggtcaattttttttcttccgcatatggatgcccagttttcacagcacttgttgaagagactgtttcttctctattgtgtgttcttggcagttcatcaaagatcagtttattgggaagaaattggtggacttccagattgtctgtaatgttctgttggattctatgtctgtttaaatgtcagcattatactgttttgatttacatagatttgattttgaaattatagaatatgatatattcagttatattttacccaaaattattttggctatttaaagcttttgtatttttacataaattggagaactttttaatatttttgtaaaaccatgccatggagattatatatttattttataggcatataatagatatacctaatttatgggaacatgtaatatattgatgcatttataaacgtgtaaagatcagatcaggattggtatatctatcacattaaacgtgtatattttctttatgctaggcacatttgaacgactctcttctggccattttaacgtatacattagattatcgttaactatagtcaccttactcatctgtcaaacatttaggttgtatttctcctatataactgtatatctgtcttcagtaatcatcttctctttatcctcttctctcttgtatccaaccaggcttctggtaaacaacaatctactctctgtcttcaggaaatccaatgttttagttgtgacataaaagtaagaagatgcaatatttgtctttctgtgtttggtttatttaacttaacattatggcttccacttccattcatattgttgcaaatgacaagatatcaacatttatggctgaataatattctattgcctacatcgattatatttttatatccatttctccacctacagacactgaggttgctttcatatctgggctattgtgaatagagctgcaagaacttggagtgcacatgcctttatgaggcagtgattttatcttctttagaacatactcagaataggatttgctgagtcatcagttatttctatttttcttttattttggagtcttcatacaactttgcacaatagtggaaatacaaacggaaaaaccattataaaaagcagtttcagttttgaggtatgatccaaaaacacacaacatttcatcatgattctcattgggagtctctaatgaatctggtggaaaggcaggaagttttctaaccttgttaagaaaattatgagtttgcacctttttctttttgaggctggaaattggcatgattcaagatgcgtaatgttagcaggtttcagaatgatacagcgaaaatcataatgagaaggcaagagagagaataagagaaagacaggaaaacaaagaaacaaataaatttcacaagagaagaaactgctggatgtcagtgttgggttttgttcctagacatatctgtactgagtgagaaaccatgaagccaagggaagagtctagaacttgttcaagtgaagcatcagcatatttctccaaggcacctattgtcaccccatcacaagggtgatgagtttttgaataccattaaatatgagttcctagtaagtaatcatgtttccatgaaattcagttaaaatgcaaagggtgtgtccagatcactcacgcacaaaaatacaaaatttgcctttgcatttatggctgcatagaggtaaagtccattgagacttcagcaggttacagagatctgttaagttttggattcccataggagagtgcctcttagtgaaggttggactattaattaagtatgtacaaattccctctatgggagtagtgttccatttgtgtggaatttttaattccttattgaattgcaaaacaaatcccaaggactgactccatggagttttactgtagtgttcataaaaatatttaataagattccttccagtgtttcaaggaaagtttttctctaaaattttttctaatacataaattttcctgcctaaaattgaaacaggctgttgttaaaaagacatactggaatggcagctttaatctattggtgataggaatgagcataatacatgaatctctttgagtgttctgcctcatccaaatactgtatggcaaaggctagtactggaggtaaaatctctaaatgtatttgttccagccatcaagtcatggggcaataacagatacatccttgaggcagaggaccataatgccacagtgctagtaggagtacatgtcgccaagggagttcaagggttccttaaaattgtgataattttaatgtaagaacaccttattagagacagggtttcagcatgttgaccaggcttggtctagaactcttgacctcttgatctgcccgccttggcctcccaaactgctgatattacaggagtgagtcactgtgtctagccagtccatttattttcttctgcacatggatacccataaacttatgtggaagattgtgggaggttataacagtgtcatactttagtatcagccatacctcacagaatcattttataatagttcctttcatgggtgtacttcactcagttcatgcaaaacctggcaggtgacaggctaaaaacacaaaataccgaagcgtttaaccaactgaaagggctgtagccttttgtcaatgaattatttcaagacacggagaacacatatagattataaataaaatactttcacatccccttaaaggtggaaattgaggaaattttacctaaatgtgtccaaagggccctgtggcttggtttctgtctaggtcccaatgatagggttctcccaggattttgtggctgtcttgttacacttcatcaagaattaacctctgctgtttcctcaaagtgtttaattggataatgaatttgtctataaattgaagagttgaaatacatcaaatattaatttgtaataatctggcacaaattatctaagcaaattcaataactagatgttttttcatttatttttatttaaaatcaggatctaagcactgatatgctttaataacatctgtgaccctctcagcagttttctcttctgagtatatgatctgctgtggcagttttcttagcttcaatgttacctcttttggcaatgactaccgtctttatatttgccaggaatctgggataaaggagtgcttctaagagttccctaacttgcccattttggtgggtgttccagaacatatgagatgctctgttgttaacaaagcatcccaaagccatgcactgccctaaaatgtgtttgtttcctagtttgacaaattggaagttctaataaatacaatcacttctgccatctgggctgattttacatcagatagagggctgtattccaaagaaaagcttacattagtaatagcaattctagtcagaaacctagagttttatcattgaggtgcaattcataacaaataatattaggtcgaggttctcagtggcagtgtctaaatctcttaggtgtacagggtcttccctgttaacatgaagcatttataagcacagtcatagtttccagctatgcttctccctgtctcattatcaccacaaactatggcctcacctggaacttgggttaatttccaaataagtaattttttagtgtttatgcctctagattattatgtgagaaagttaacattcagtagaaagttaaaaagaacatttgaactgactaaacaacacagacaatcaagaataaaattcaaagcctagatgtgagaggctccaggcctggataatgcaatagttcatgtatgcaggcagtttctttgcccagttctacactgatacacccagaatgtcagcttcatgccagatttgactcctattatgtagagacatggcaatacattctcaagggtcacatgaaataatatgaaaattggtgggaataggggaggagacaactctgcaattctcatctgaaggaccaggaaagcctggacagaccatctccccagcctccgtgactgcaccacgtgcccacatggacactcatccctgatagggtaagaagactccattgatggggctgagcattttatgatagaaattactagagactgacgtggaggtttcaacaactaatatttataaccaaaatttaattacccccacattgttaccattttcttcagtgaaaaattgcttgccatgattaagttttaagtagatttccaatgttcacaactgagcttccaagagagtcttgagaacaaaaacaatgagggcagagaaatctaccttttctgtattcaccactaaactcaagtggactcagcactgcctttgatcactgctacttctctgcagagttcaggtttctacttctcacaattctgacacacattctacctctcctcaaatgtttggcctctgcttcttgtaaggtcaccctctgttcttaacttcttctctgagtcattttgtgaggtggtcatgagccattaaatggatattttatattttcccaacatgaatcacatgagtggtcatgaattatacttctgattatggcagttgatttttcttggcatgttcatgactagtaatatttgaagccatttcattcaaatcttcggggcttcgtttttgttgctatgacattttttcttctattgagtctttccactagtattataacatgacctagtatccaggctcagttgtcattaataataaccacatatgtcaaaaatcatgcattcttttcacagcagacataatttcctcttttctgcagatgaagacacactgctgagctacccccacttacaagaatatatgcacaattatgatatcttcatttatttgactaataagctatatcattctcccttcaaattctttaccccccagaagtcctggacaaatttctgcatctgctcaaacgataaactcagaactacatggtgagtaaaagtcacctggttctggatattgggtccatctcttcccctccaatgtcccagagcacctcagcacacctgtccaggttctatcaagaaagagtagctcctgcacactgaaggaaacaattgagttaagagaggacctgcagatgatagacaatattgaaaactattaatatgacaaaggattactaccaagcatgtgaaataagctcaacgggtgcggtggttcatgtctgtagtaccagcaatttgggaggcaagttgcgcagatcacctgaggttaggagctcgacaccagcctgaccaacataaagaacaccctgtctctactaaaagtacaaaattagccgggcatggtggcatgcgcctgtaatcccagctactcgggaggctgaggcaggagcatcacttgaacctgggaagtggaggttgcggtgagctgagatggcaccattgcactccagcctgggcaacaagagggaaactccatctcaaaaaaaaaattacaaaaaattagctgagcgtggtggtgggcgcctgtatacccagctgctagggagactgaggcaggagaatggcttgaacccaggaggtgaaggttgcagtgagctgagattgcgccattgcactccatcctgggcaacaagagtgaaactccatctcaaaaaaaaaaaaagagacttgcaaagggcaaatagatcatagacagacagatagatagatagacctattagtatacatacatacatatatatacactaatattcaggaaaatgcaaattcataatgagatgtcttttcacccttcatctctgctagaaagtttgttatctgaaaaacaaatacatacatacatacttattaaaagctggccaggatgcctagaaagtaaaactcatagaccactggtggaaatgtaaattagtgcagccatcaagggaaaaaaatagaactaccatatattccagcaatccaactgctaagtatatatctatttaaatatttaaaagaaaaaactaatattgaagagatacctgtacacccatgtttattgcagcactaatcacaatttctaagatatgaaatcaacatatgtgtccatcaacagatgaatggatacataaaatgtgatatatttacacaatggaatattattcagccttaacaatgaaattctgccgtttgaagcaacatggatggaatgggacaccactatgttgagtgaaatgagtcagacacagaaaaataaataccgcatttctcagcgttacttctagaagtaaatagtagagtagtggtgatgagatgccaggaatgagagaaggctgagataagaagaggtttgttaacaaacacacaattacaggtagacaggagggatgtgctctagtgttctacagcacagtagggtgactacagttaacaatatattgtacgttttctgtttacaagaagccagaagagagaattttctatgctaccaacacaaataaatgttagtgtctgaactgacgaatttgctcattgttctgattttggtcataccaagtggcacacatgtattcaaatatcacactgtatcccataaacataagcagttattatgtgccaaatttgaaaaatcctttaattaaaaagaattatattggcgtacattacaaatgattcaacacagagacaggaataaataccatttttctttgaaatagttaattaactaacaatgtagttacattcatttgcaccaaatcgtgtatttgataatggtatgcatagacagatttatgcataggataatatcttttaattttagactactacttaatactataaatataaataattttaaaacaactaagtaaaaagaataaagctgagaaaatgtgtgtgtggtgtgtgatgtgtgagctttttcttgtgcaccactgtgtccttggtggatgtgtggttcatgtgtttgtttttatttactctgtttggggttctctttgcttctaggatctgtagttcagtttctttcacaaaattgggaacattcttcgctattatctttttcaaatagtttctgtgtatttataatttctccttctcagatttaaaatatacacatactataattttgatattaatgtttagtttctttcttcactctcttttcgtttgcaatttactttgtgaaatttctagtgacatactaatcacatggttttattgaaaagctgagccagctctactgaggtgtgtgccaaaagattgctcgatgtttatacagcattgcttttgatttcttatgcatttccatttgatttattcttagtattttcatatttcagttccctatctatgtccacgatttctttaagagattcttgcgtgtgaattatagttactttacatatcttgtttaattagatatttataatatctgtttcatctacaaatctcatgctgatcatttgtttattacaactttggtacttctcattaatgtatgtaataattgttgatagccacagatactgggatggacagtggatactggccttattatttcattttatgcatttctgcctgtatttgaccacactttacctttgccaggcctttactgtggaagtatctgtgaatcttctcagaactatatttgacattcacttttgcagtggacatcaaagttgaagtctgttcttctgtgtccaccagagacttcagttcctccagtgataccttgtttttctttcctgcttggctttgtctcttcacctgttccctcctccagagaatcatgttcagctccctcaggtggattaaaatgttatttaactgacaattgtgaaattggtggaaagcaatagaataaagggagattttctgacctttcttgggttcatattgtgaacatgagtctgggtgtgaccttcccaatgtttctgaacttcctccagatgagatgttggtctgtgtgttcttgctcttttccctgctgtggagtcctcttgttttccccagttgttccctcccgcagctccaatgttctctttttgtgttatcaccttacagatttgctgactagaactgcagattaaggctctgattaaataagaaggaggggagatacttctcaatggaacttaggtgaagacctcttttcccatctcagttcctaagggattgcccagtgccctaagatactggtttggtggcttgcccctccagaataattctttgttctccagtggggatatggaaggtgggtctgaacacttttcagaagggtgggcactttttctctcctagacagacacaatgggacagaacaattttggtgactgtccccattttggggaaaaaggattcaataggataggaaaactcttcagtctgtggtcccttagaaattcaccctacaacacatttaccacacttgacttcaagaaatccaatatatatgtgtgttttcatcttgtaatagcctacattttacatgccatactctgcctcagttcagctcataccccagctttgttactctttacaagaacttgcctctccctagatttcacatttgctgtttatcttaaaacttcaagtatctaaagtattatttttaaaaaatggccagttgtggtggctcacacctgtaatcccaacgctttgggaggctgaggtatgtggatcacctgaggtcaggagtttgagaccaccctggccaacatggtaaaacctgtctctactaaaaatacaaaaaaaaaaaaatagcttggcatggtggcaggcacctgtaatcccagctactcgggaggctgatactggagaatagcttgaacccacgaggcagagtttgcaagtcgtaccattgcactccagcctgggcgacagagtgagactctgtctcaaaaaaaaaaattccaaaattccagctcctctgtttatctatttttgttgatactgttgttgtaaaacataagtaaaatatattattcatctatgtacatttccaagctgtgtagaagaatttttaataagacccagagtaaaaaaagaatgcaaatatgtaggggccagccctacagggtctgtggatctttctccccatgtgcagagatgagagatcatagaaataaaggcacaagacaaagagatagaagaaaaaacagccgggcccaggggaccactaccaccaagacacagactagaagtggccccaaatgcctggctctgctgttatttattggatacaaggcaaaaggggaagggtaaggagtgtgagtcatctgcaatgattgataaggtcatgtgggtcacgtgtccaccagacagagggcacttccctgtttggcagccgaggcggagagagagagaggacagcttaggtcattatttcttccattctcttctcagaaagatcaaagactttaatactttcactaattctgctactgctatctagagggcggagcaggtgtacagagtggaacatgaaagtgaaacaggagtgtgaccgctgaagcacagcatcacagagagacgtttaggcctctggagggctgcgggcaggtttgactgatgtcaggccttccacaagaggtggtggagcagagtcttctctaactcccccggggaaagggagactccctttccaggtcttctaagtaatgggtgccttcccaggcactggcgctaccactagactgaggagccctctagtggccctgtccgggcgtgacagaggctcacactcctgtcttctggtcacttctcaccgtgtcccttcagctcctattgctgtatggcctggtttttcctaggttataattgtagagcaaggattattataatgttggaataaagagtaatgctacagactgatgattaatgatattcatatataaacatatctataacctattactagtacaactattcttattttacatattctcttcattacactagaacagcttgtgccctcagtctcttgcctcagcacctgggtggcttgccgcccagacaaatattgttaagcttcttaatagaaaaacaaattatggtaaatgtgttcactggaatactacccgtcatttataataaattaatgcctgatacacagagcaacaaggtaaaatatctaagtatttatgttgagtaaaataagctaaacaaataagaatatatactatgtaatttcatttttataaattctgataaataaaaatgcatctgaagtaaaataatgaagataagtagttgcctggggaaatggtagaagaagggagggggagaggaggaggaatacagcagaacaaggggcaaatgttgagaagaattcacttgtccactttcttgataatgatagcagttacatcatttttattagttgtacattttaaatatgtgaagtttatcatctttcaattaagcctcataaaatgtcttacaagcaaacaaatggaaacttagacaaggaaagagtaatagaaagatagaaaaaataagttcaatgtcagaagtacctgaaaattaatgtgcctggatcctagttctctccatattttcagaagagtgctggagggcagcaaaaccacacatgctcttattacggaaagtgggttctgataaaaacactagacacatccagctttgtcctggagttggtttagggggatgtcagagacagtgatgaagagcacagggccagataccggggttcactcatcccagacatgagctcctagatgcatacagagcccccccatgtgtgggtttacttccacttctgtaaatggagaaaatattgtctcctacagaacatagtttacatgaatatttaaaatgaaatagggtgattagtgcaaagtgtttatcacagcacaatttcataataagacagcatattttccaaatgcaatcattgccagcaaacttctacagggcaccgtcgtcttatctgggtacagcctactcctcaagggtcccaccctagagcttgctatatagtaggagatatgcaaatagggccctccctctactgatgaaaaccaacccaaccctgaccctgcagctctcagagaggtgccttagccctggattccaaggcatttccacttggtgatcagcactgaacacagaggactcaccatggagttggggctgtgctgggttttccttgttgctattttagaaggtgattcatggaaaactagagagatttagtgtgtgtggatatgagtgagagaaacagtggatatgtgtggcagtttctgaccttggtgtctctttgtttgcaggtgtccagtgtgaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtgtattactgtgcgagagacacagtgaggggaggtcagtgtgagcccagacacaaacctccctgcaggggtccgcaggaccaccagggggcgacaggacactgagcacagggctgtctccagggcaggtgcaggtgctgctgagggctggcttcctgtcatggcctggggcggcctcattgtcaaatttccccagggaacttctccagatttacaatcctgtactaatatttgatgtctctaaatgcaaccttttttttcctttttgtgtctgtttttttttttttaaaaacaggaggacacatcctcacctccacagaagccacagtgtcactttgggggcagaaataatcctttcgtggtcaacagggtgagagttttgaggaatcccagggaaacctggggaatgttttccaattagactcagggcagagacctccatgggaatctctgattagaacaggctttgagttctgatgggagccaaaagagaggctcacccagggtcagggttcttaaaacctgatggttttcacagcaatcccccttcatcttgtgaaactgggcacatctgactcagactgattcagttgaccctctttctgctaatccattttccttcccagtagacttgattctcacagatccctttcttcttctctttcctgaaaacagaggatgtgttttctgtagtctaaattccaaggctcaggtctgcaggagctgggtaggctgaggggtcttcctcactcactattgcctggaaaatcctgctgtcttctgtgcatggaggcatttggaaaatgaagcaggcattagtcatgaagggaataatactagttttctccaatgggatgttgatgtagagctgatcttatgcttctcacactgtcacaaagtttggactctcacctgtgactttgaggagagcttgtgataccttatcttgttttaatatgaatagactctcccttagctcaggaagctggaacagactccatttggctccttcatttgtaagacatcaagggctcctcacccacccccttcctcaaggacttaacttgtttaagctgactcccagcatctcaaagagtgcgattaactgataaggtactgtggcaagctgtgtccgtagttcccaggaatttggccaggtgatggtaccctaaagcccctgcatttctgtctggcagataacacccagagcccccacacctatcatcttgtgatgaatttaaagcccctgcacctggaactgtttgcctgtaaccatttgtcctttcaacttttttgcctgttttacttctgttagaatgctacagttaggctccccctcccctctctaaaccaaagtataaaagaaaatctagcaccttcttcggggctgagagaatttccagcgttagccatctctcagttgccagctaataaaggactcctgaattcatctcaaagtgcggcgtttctctctaactcgctcggttacaacaagctgaggatggacactccattgtgcagtgagctctgggtgacagtaatcgtagggtctccccgggcagcctaaggtcaatactgctggccgtcgggaaagacaggctggaattcctgggaagacctgcatctgccatctaccacggagtcctatggtcttctgttacactctctttgaatcagcaccacctagattatctaaaacactctttgtgacttcatgactgggaaaaaataatggcagtctctactaacacctgtgttaagccatgggagcaacacctaggctagtgtgtgattgagtagttgagactgtggtctagtcaaggtgacacataaaattgattgttgccattatgatattttattttatatttgacaatataatcatgctcatattataaatatttctgttacattatttgtgtcagaggctttggaaccagaacaacttcatcttgaataaggggtaggaaaaataagactgagacctgctgggctacattcccagtaagctaaggcgttcttagtcacaggatgagataggaggtctgcacaagatccaggtcataaagaccttgctaataaagtttacagtaaagaaactggctgaagcccaccaaaaccaagatggtgacaaaagtgacctctgtttgtcctcattgctcattatatgctaagtattatgctttaacattctaaaagacactccccacagagccatgacagtttacaaatgccatagcaacatcaggaagtttccctagaaactaaagagtggaggaaacctcagctttgggaattgcccggggaattcatgaataatccttcttttgtttaacgtataatcaagaaataaccataaaaatggacaaccagcagcccataccacttctctgcctatatagtagccattctttattctcttactttcctaataaacttgctttccttttattctgtagatttgccccaattgggatccctttccagtaacatttgtgttattattggttttctaagcagaaaactctgagaggaggtgtcagccgggcttcctgggttgagtagaggctcagaaagcagtgaaactcactcatttcctgcatcaggacttactttggtcctggatgaataatattgaagatatatgcttaaaatattcctaacatcacaatttgtgcatgtgttttcttccctaagaaagctataaacagtgaaaattttgctgtaagcttccctgtgtcttctctccctctctccattccccctcccctgaaactaaaaggaatgttttaacattatgggcttttaagtctgtatttctgtgaccagcagaccttatctatgctcccaattcaaattccttgtaaacacaatttgtaaaatcctgcgagatcctgtctccttggccacgccactgcaaggtcataaagtagatcaaacttaagttacaattctgattttcctcaagatctgagacatgttaattgtctttgtttcttgctcaggtaacatctctttttgctcttttttatctctttttgcacttaaatctaagtttacattagtcatgtatctagaatgtagaaatatgtcttaaagttacttaactttttaaaaaatttatggggtttccagaagatgtgagaacctcctttatttataaaatagctgattgcacgttgctcaataatttcctctttaatttatctctctcctgtcacattatactatgataagcaaaaagaaatgaaggcataccatcaacagtttacttagatatctcctcagctaaatttctaaggtataatttactaattctaattttatccaatttaacataattaagataaattatataacaaggtacacatatgttccagttctaacaccatgtttgtgacagaaataaaacagagcttctctctgtaatgtggtcatctgagccctgaggtgatgggtcacataggtatttttatgatatttaagggtttggtcaagaacagtgataacaagtctgaacaagactggtcatacttgaaaggttacaggtaaagttactgctgttattttatattaacgccttattagaataaagctcagaggaagaggccacatcctaggtcacagtaggaggaggaatggagctgtgctctgctctccacactacttttcacatcccaggcacaagcccaggttccatgacgcacggcatctagagggcagttctcaggggatgatctcagggcacctgcttcctcgggcagggcgcttccttctctcaattgcagacttgctccttctgcaaggtctgaagtcagcacttgtattcccatgatttttacaggttctcttccctaatatggcaaaaatctttttattaaattttcaattttattttctctgaagcacactgcattagcagaaacgaatatatcacattccttatccgcccacacagccaaagattcctgaagacagagctgatgtgacgtactcataggtggatctctgcccctcagaggtggccttggtcttcaagtttcagcaatttctaggaagccaaagacacctccatctactcctccctgctcgacagctcacctgagaacagctttctcattggaatgtcttgtgtttaagaaataaaagttgctgtttgaggttagggagcccaggtgcacctaccagatccagcccaggattggagatacttttcagaagacaacatcacctgagacacgaccagtcccactgtttcactttcacaatttcagcttcttcagaagaaaattaaaattgttgagacttgttcataagcgttgtgccatgtcctttctctgttttcttgcctgttcattgatgtcatgccaggtgccacttctatgtaataggatcagaattctgcctctagtaacacatcagaggtgaggtttgattgtacttttggtttatgctccaaaacgtagattataaaattcatcaccctcatttttatgtcaaaagtaatctgcataatctggatgtcaatactttttggaatctatgaaataacagaaattgcaagaaatattacccactccaaacctggagagacaggcatgtgcagaatggcaattgacacctgcttaactggagcagaagctgcagaagccacaagctgttgagggcacttacatggtaagcactacagacgtctgaagacagatgtggactcagtaaatgtaacagttccagagggtcttatacttctaagttttctggaatttctttccagaaacctcaagattctaaaatgtacattccaaagacatttcctatagatcaaaattgcagatattaattactgagaaacataccacgagccttcttcaaaagcttctacaggaaaggacttttccagaaccttatcctatgtgaaggaagacaaatctcccactgcagatttctctcccattcttccataattgtagaaatgagtaaagttagccaatagaggtaagatataagtaaataatccagggatgctgaaaacaaaaaagggagtaatcgcccaaaatgagcttttcccctggagacgcctggtcaagatcataggccagaagaggaagctgactgtgtctctaggtttccactgtcagaacaggcagtgcttacctgcactgcacaatccattctaaccaggatgatggctctggattaaaggtgaaagtgtggcaatgcacagactctatctgaggagaacacaggaaaactaaaggacaacggcagagggtgagacaagaacagtagagcaatctgaagcctctgacatcatgatttttaagaccaatgtcttaaacactccttcattgacctcagcttctttcatcatgaagcctttgcagtgactctatctgagaaaaagaaaataacctcctgcatgcacttctcaagtctctgcttgtatcctgtttgctttaggtctctaggggaaaaagtcagatacctggacctagtgtcagtgtaggaggcacatcctaaaagctacaaactaggaagaagggaagatgggtgttattggaatagtggatatggagtgggctttcttctgaaagtatatgcacctgctggtattctcagatgcaacattcaactgcaagagcccattgaagaaacaaggcactcccaaatctcctgtaagattctgtattcatttcagataagcccacatgtccccgcattaactttttcttcagacaagcacatacatctgaaactgaacagctatgtggcaaaataagctcaggatagaagtaattgtggactccagctctgacaatttgtagatctgcatttttaaaattctaactgaagactttgctttattgtagaggacagtggtttacagctcgaattgcacagcctacaggcagatgtccatttcctctgggcaaggtttatttttatttgtttactgtacttatttgttgacaaacattgatactataaagataccctaacagcgtccacatgaaagaaaaagaaagagcaatggacacatcaaccctgaacatccagtcccaggaatcctttgaccctgccctccttgcaacccagagatatagattggatgagccctgctgagcagaacacacatgtccccaggagaaagacatggaaatgaggcccctccctgctaatgaaaagcagctcttcccctcttctcctgcaggtcctggtgaggagccacccaatatctgtgcccttcctcagtgtccacaccatcgggtctatgatgatctgggcttcacttgtcatcactctcaatattgaggttccccgttaaacagactgagtgaactgtggctgctccacgtgggggctgttctcagtctgttgcttctgtgcttgcagaggtcccctgtgaagttaattactggagtctctcagagaaatactacagaccaagaattctcagacttttctggaaaccctgtggattcactttcactgaaaacagcataagcttggtccagcaggcttcatgacaggggtgggtgtaggtgataacatcagtaattcaagtggaagttctcagtgggactctccttgagtacaaagaagattaacagtcctcagagacacgcttttcagatgattctctcttaagatgattaacctgagagctcaggaaaattccgtttattactgtgagggacacggtgaggggacatctgtgtgagctcagacacaaacctgcctgcagggagacacaaacctccctgcatggtagatgcttctcagaaccaccagggggtgcacaggaaaccagaaggtgctcaggacaccagggggtgctcagaaccaccatgactcactcaagacgccaggggcgctcagaaccaccgtggggcactcaggacaccaggggacattcagagccaccaggggtggctcaggaaacctaggggggtgctcaggacaccagggggactcaggaaactagggggtactcagaaccaccaggtggtgctcaggacaccagggagctctcagaaccatctgggggcactgaggaaaccaggggactcaaacactagggtgtgctctgaagcaccagcggaccctcaggactgcagggggcgctcaggacactagggaacactcagaaccaccaggaagcgctcagaaccaccagggggccctcaggacatcagagcgtgctgaggacctccgggggcgctcaggaccttcagagagtgatcagaacaccagagggcgctcagaacaccaggaggtgctcaggacagcaaggggctctcaggacactagggtgtgctcagtaaaccaggggtccctcacaaccaccagggggcactcaggacaccaggggatgctcaggacaccaggggccactgaggacaccaccgctcccttagcaggcagctccacatcaggcccctgggttggggcaggaagggtgttttccttttggatcttgccactaaactcttgggagtttttctccttcctttgtggtttcaagaaacattggtagattcttctcaggtataaagctctgctttcttgtattatgtaatgtttttggtttcggatgttaccagaattacactgcactgtgagaggattcattcctcgtgtgtgcaatagtgaatgaaagctgcaatgttaggggtggctttgaaagctacgttaggggtggctaagggcagttagcaggaaatgatcatcactatagaaggctactcatttctttgcacatttccataaataattgtagtttatgccctaaaaactgcatgctttcttggccctttttcttaaatgcctccaatccaagaccagtcatctaattaagctgtatgtcaaagaccaccaatcaagttaagtctgtttaatgaaacactttgtaaacaaaaaagtacatctgtgtttgtatagtcagctttaaattttacattgctttacaaatattaattttgtaaatttagtctcataattatcgtcagtatttaaaatcttaaagtcatgctatgttaaattaagtaatcttagctttctcactatgaattagagttactaagaattagaatagtaagagcatgtaataagcttttggtgaagtttataaagaaagatgaagatacgttttttgctttaaaatattttgttttccagtttacaggacctttctactggttttaagataacaatcactgtttacatctaaccctttttttaaacacctgctgtttaagattataaaattataaaattaaaaacctagttaaaaccagattgatctttgtaatttaacaagatgttcagtattgttgttttaataaaaaaaaataggtaaatacttagctactagaaaaataatcatctacttaatcataaggttttacttaggtaaacacctaaatttcatgggttataaacatggttaataggtgaaaaactttaatggacaagtattacagttttcataaatattctaggtaagctatttaaaaaataaattaggtaaatgaaataaaataaaccatttaaataaacttgttctacaatttaaaaatctaaagtttaattaaataatatatattatataaatgtttatgcattactaattgtttaaaatatatatactataaggaaaactttttaaaaatacatattataagaaaatattttttgaaaacatttgtttttagaaaaataatttatttaattcaaaggttaattataaaatgtcgtaaacatacccagttagtaagagaggtttaaagaaagttctagacatagagaagtacttttggtaagaaaggttaaaataaaaaaaaattatatgagaaggaattttgtaggataactttttatatataaaagtgactatttatgaaagaataatgtttagaataaaacaagatgttcaagtatgccataaatggttcgtgtaagtcaaaataaggtttatagaaagctaacttattaaaaaaacttcatgttatcgagttgactataattgaaagggaagaatttattatagtctttatagggatctggctttcatatgaaaatatactaacacactgaagattggttagaatgacaaaattgtcttaaagtattgatttattcaataaaattataaggtattataattttttaacccaaaattttaacttttgttgcatcttgccatttttatttttttccatttgagaaggcttgagaggatctcaactttttcatcagctcctttaacattgtttcttacttacagcagttagcctctgagttaacttctaactgttgttagtttctgactgctattatttcctgatgttaaaatcctctatcttaaagttctaaataaaatgttttctttcaatataatattcagtgtccttggcttttctttaactgtctaaatttttctatgaaaccaaaatcttcacttgtaaagacacattcttcctaggtctgattaattcaaatacttttttcattagagttgacttgcaggttatgtacatggagttccccatagggaaaaacagtcacagtgcagaaggctttatttttgctatttggtaactgggcatgagacaaattttaaatttcattgaaataattcctatgtaagtgttattaagtttttcaactacttagtaatactgagagtttaagacaatagaaattaatgttatgacattcatgtaactatctgtataacttttaaagtccttgtgctgctactttactgagctttgaatcctaggtctaaaaaggacacacaacactttgggaggctaaggtgggcaaatcacctgaggtcagaagttagagaccagcctggccaccatgacaaaaccccgtctttactaaaaaatacaaaaattagctgggcatggtggcaggtgcctgtaatcccagctacttgggagcctgaggcagagagaattgcttgaactcagggaggtggacgttgcagtgagcagatattgcactactgcactccagcctgggtgacagagtgagactccatctcagaaaaaataaataaataaaataaaaaataaaaaggacaccaagtccagctaaatcttaaacaccgacagcaattaaagccccatctacagacctggaagaaaatgacaagaaaaattgatcacactctcaagacacaagcccagaaattgaaactacttaaccaccccagccccagggactattacagaagaagtggctttgtaagattgtaaaagctaattttgagagatgaaatcagttcagagtttctttataaattaaacattaatgcaaggctagcatctgggcccctgtgccagattgaccagggtttcttgaagaattaatccacatttaaatttaaaaaacagataaaactgtataaaagatctatgcaaattatttttatggtaaaagtaattataatttaatagatttatttttcagaattgatagttttaacttttctcatgctgttcttctaaggggttatattttagaaaatcaattctactctttcaaaaatattttttttcttttttttagaaatcactgagttttcatgtggctaaataaataacttattttacaataatctgtaatcctattttgtaatatcaagtgttgtaaacttttgatatttgacaaagttcacaaaataaaattctaaattcagtcatttgaacaccctgaaaagaaacacatttagcttatttggtacagttaaattatacaggaagtaatgtcaaatttgcaatggttattaactttggactatatttatataaatgtggactatataatttgaatatacttatgtaaagagtatatgttccaaaattctattagattcaagtgatttttatatgtcttagtatcagtagtacttatgattataatttaaaatttttgtttatcacagaaataaccaaattttctcctcaattctgtctttaaccaggggtattctaaaaggtcggtcattcacaattgttgttttactttgattctttatcaggtggcttataataatctatagaactttgagtagtactcttaaatatacaatatacaattttgacaattttataaattgtgccattggtatagagagaaaaacttccatgagtctcatgagacctgaagcatttatgatgattgttaatctaatatcaagcaggacaggatgtaattgcatgaactgaatgaaaaggagactgaaataatttttataacttattctttaaagcatttgctatttacttatgttttattgttcagaatcaagaaaactttgtcttttaagctattcacagtttttaacaattttaactatactctattgagaaaaattgaaaatataatttcttcttctctacataatttctccaaaatttggaaactgtaggtattcttatatcaaaatagttatttgcataggttcgataaaaatctgctttcttccataacagagcacaattagagacaatggtcactttaccaaggctttaacttgaatgacatattttctgatttactttataaaatgaagagctgtacagctgatataagcccctttggaaaactggcattttacctttttttttttttttaacagggccctgagctgtagtaagtaaataattttgctttctgacaggcccaggaaacccaagttttcttggatacttgaaaaaataaaaagtaaaccaatccatatagctatctgatggcacagataaaatattggctgggcttgaggcttttaaagatcttacccttagattccttataaaaaatagcaaaagcaatgtatgaataaaacagcctatgtacaacaaacaacaacaaaaacaaaaacaataaaaagagagctaatatgttaagtgattatttttgctgcatcttatacaaaaaaatcaggccaagtataataagcctaaaatttattttacaaataaattagtcctattatgattttgtctccaataaaattggggaattatagggagaaatattctttcaaaataaactatagtgcatctgttattaggttctaaccttgtccacttgtttttcaatttacaatattttccacaatttggactcaattttaaaatatttctttccacaagtctccaaaataacattttcagtgattttctttttaaatatttttttcctatttgaaatctccagaaggtaaactgtgctttcttacagctagtcaacttaaactctaaaataaaataaaatcaatgatatggtttgtctctgtgttcccaccaaaatctcagtttgtatagtaataatttccacatgtcaagggtggaaggaggtgaagataattgaatcacgggacgtgttttctccatgcttttatcctattagtgagtgagttctcacaagacctgatggttatataaagggcctccctcttcacatgacacttctctctcctgcagccatgtgaagaggtacgtgtttgctgccctttccatcatgactgtaagtttcttggggcctccccagccatgtagatctgtgagacaattaaacctttttttaaataaattatccagcatcaggtatgtccttatagcagcatgaaaattgtctaataccagcaacttaattatatacaaaaattccttttataccctcctactgtgaagggaaaataaatcttgagaccccaaaattactaagctaaagagaagagtcaatgtggtgttacaggagatagaaagaaattatttaggtagatagttgggatgagagagtctctggcaaaataacttttcttctaacaaaaatcagctcagaaataacttcttctctaattacacacagttcaaagaaatcacttctaacaaaaagcagactaaataatcaggctgtgaaatatagataagcaactctgccacagagagggtgtttctgggtgtaatcaccaaacctcacatatataggatgggtcccagtaaaaacagtgagccttaataagcacattccttttcttttctgggagtacactaagatagaaaagctggaagcttgcacggggtttgcgacgccggcacctgtgaggaagtacctgggaccaggcaagaaaacccttctggcctttcttagcacatgcacggtggaagaagataagcagtgtggaggagatcaagcaaagtgcccgcctgcccaatgaaagcatgaggtggggttgccagagactttgctctatgcagatggcacacattgtcctaactgtttttgcaccctatgctgataagacaccgtctccccacgagcacatttataaaaatccttacattttactgcagcacgataacccatttgggacccctctctgtgacagacagctttttttttattttacctattaaacttgtgctctaacctcacccttagcatgtctgcgaccttgatattcacggccgtgagacaaagaagttcgggtggtattccagacaacgaggctgccatactggaaagtgctttgggcaaatctgcctccccttctgtttaaagtgattcctctgaggctaacctgagaccaatacacagctgattgcttcctcttcactatcatttatgtaaaaacgaagatccactgagtcagactaaattgtgcattcagtggtaggctaataaagtactcaaaagaacgcaacctattgtctcttatctacttctaaactgcagtccgtgcttttgattcgtcctgccttacaggaaaaatccaaagtacattttacatatattgattgatgtctcatgtctctctaaaatgtataaaagcaagctgtacttcaatcgccttgggcacatgtctcaggacttcctgaggatggtcatgggtgagttcctaactttggcaagataaacgtattagtctgttctcctgctgctaataaaacataacaaagaccgggtaattgataaaggaaagaggtttaattgactcacagtttcacatggctggggacacttcacaatcttgtcagaaaagcaagcgacatcttacacggtggcagactagagagagcttgctcagggcaactcctctttacagaaccatcagatctaatgagaagtatttactatcatgagaacagcatgggaaagacctgcccctgtgattcaattatctctcattgggtccttcccatgacacatgggaactgcaggactagaattcaaggttagatttggatggcgacacagacaaaccacattagtaaacttcctaaattgactgagacctgtctcagatatttgtcgtttacctaattcatgttcagccttcagagttccaaggcctatatcagttttccaggattgtttcccctttttgttgtttgttatttcctcctttatttatatgttttacttctcttttttctcccactattttcttattaatggatgtgaaacttcacaacatttgaaatataggtaacaatgaactataataacaacttgggacctatttatctagaaataatccgtcctacccatgaaagaaaaaaacaaaaacaaaaacagaagcccagaaacttattttgtggtaaaatgcttcctctgaaatattttggaaaggaaaaagttgggaagatatgaaatgaaaataaaaacttctgatgtcaattcattatgtcatgagggggaaaaaaactaaacgatgatccacgcaagaaactgattttcctttcattcctgagaaaatagccacagacagataaaatgttagatatcttcacagatagctacaatttgttcatctttgaaatacttagtgcaggagaaccacttgatattctatttccctatgtgcttctttttcattactacatgtaagttttcatgcaattcctccttcccctctagccagcttttcccctttatatattgaaagccctaaaaaatgtcttttgggaatggcactaaccacgcattgtttctgtgattacttttcttccaagcatgccataactttgaaaaattaattttaatttgattgagagctctctcagaaacctttggttacactaggcaaaatccaaaatcaggagccaattattgtaaaaatcagccatagtacactgtgcgtctgtgtgtgtgtgtgtgtgtgtgtgtgtgtgtgtgtgtgtacatgtgtgttttaatttttgtgagctttgagccatgtagttctctctgtggagatactatttggcgtgactttgaatagagaattctaaaagaaataagaagctcctatgagttctctgaaagtttctggactcaccatggatcttgactgtgtcattgcatcagacagtcccagggaacagactctctggtggtttcatagaatctatgcttgggctctccctgcagtttactgggtatagtaatgacaaatcactgtttcaagagacaatttcaaaagcattagatgctgctgagagaggattgtgaaccaggggactgcccctttcttcttggagagcgacattgggagaatatgctctgtgagcccaaacagcatcctcccctgcagggtgagggcagagttgcagggcaggcccagaacccactccacacagatgtcagccctggagctgctgcagaggagtctgaggagaaaatttttccagcacctgaattacacttatttcaaaacaaaaatgcaattaaaaagttaaaacaagtaattaatgtccaggcacagtggcttacacctataatcccagaaatttgagaagctgaggtgggaagatttattgaacccaggagtttgagatcagtctgtgaaaaatagtgaggcttcatctttatttttgaaaataaaaataaaataaaacataaaaaatttagcaaaaactacgatgcgtctttacataccccatcatacttgaagcatttacctaacccaatgaggtgatgaggacccaatttgaaaggagaaaattttagacttttcatatatcttaatagttggaagatgtagaagaaatatatttatatcaattaaatgtgtgcaaatattgacagacacaccataccaggagttcaacttgcaaagggtaaaaccaaaaaagtttgagattgttaatgtgccatttgaaggtgagatcgttttgaggaccatgtcctgtgagagtttgtttctctattagaggagttctgtactcataaagttctggacatgccaggagacaagtatcagtaaacaaatatcagaacttgaacttcagcttcccactcttgcattctccatgtgtcatctctctactatttctcattctagatcaggtctttagctatgaaatattccacctaattaacatgtaaatagattgaagtccacagagttaaatatgtatattttctcctgtttttcccaattgttccctcccacagctccaatattctccactgttaccatcaccttctagatctgctgccatgccctgcagattaaggatttgattccatgacagagaggaggtgcatttcaatggaactttggtgagaacctcggtttttatcccatttcctctggggctccaccagtgcatctggaataatgggttcagtggctggcccctgcagggtgattccttagttctgtagtgaagatgagggaggtgggtctgaatgcatttcagaagtatgggctctcctctctcagacagacactttgggaaaataagatttttctgactgcacccattctagaacaaaggaattcaattggataagaatgctgataaaaaaaacctcaaaccaaattaaatttaaaggagtttaattgagcaatggatgattcatgaattgggcagcccccggaatcacagcagattgaaagagacttcagtgcagccatgtggttgaagaagatttatacatttttttaaattatgtacagaaatcagaagtgaggtacagaaacagctggattggttacaggctgatgtttgtcttatttaaacacagtttgcacactcaagagtgtatgagtggttgaggtatggctgctgaaattggccaacgctcagctgttggtgaggtgctcaggtacatactcctgagttaggttttcaatctcgtccacctattcaggtaggttaccgtttgtccacaaggactcaaacatagaagtacggagtcctcctcaggccatatttaattcactttatcagtgcccttcagcatatggttcctgagaatttcacacggcaacatgtttaccaccctagaatttaagcaatccaatacatgtaataggctgtatttcacatggcaacttctgcctcagtttagctaacactatggctttgtttctctctacaagaactcatttctcccaagatttccattttcctgaaaggaaaataaatctttgggacccccatatcactaagccaaagggaaaagccaagctgaaaactgtttggggcaaacccaccttccattctttccctaaaatgatagctgttaaggtgtttacaagctacatatctccttcaaaatttgaccgcacagaaaatccttgtagaccaaggacattgtagaccaagcagagagtcacttctctgctcacgtaagtcaaatgcatatctgattgctccctttgctctattgtttcactaagccagactaaggcctatgtgactattcctgtaaactgtgcattcagttaaaggctaatcggaaactcaaataatgcaaccatttctctcatacctacctatgatctggtagctctccccccaacttcaatttgtcctgcctttttgaactaaataaatataccttacatatattaattaatgtctcatgtctccctaaattgtataaaaccaagctgtgtcccaccacactgggcacgtatcatcaggactccctgaggctgtgtcacaggcatgtccttagtcctggaaaaatgaacttcctaaatctattgagattagtctcagatactctttggtttataagtatgttttctatctcataacttcaattatctgaaatactaaaggaaatctgccaaataacacattatcttgtttatctgttattgttgttgcaaaaataaatatatttatataatttatgtataattgatcatctttgtacattaccaaactgagtagcagatttgttagtaagacccaatgtaataaaaaattcaaatatcaattaacaacttaatagaaaaacaaattacgctacatttgtttgccgaaatgctaccaatttttataaaaaaataaacacatataacataaatggtttaattctcagtatttctattgagaaaaataagccaaatacataagcgaatatactatattatttcattcttataaattctaccaaataaatactagtctaaagaaatatgaaaacatcagtagtttataaagaaatggtagaaaaagggaaggggaaaaaacaaataatataaaagatcaagaggaatgctgaggggagttgacttgttacctcattgaaaatagagattattttttcaaagtttactattgcacatgttaaatatgtgaattttatcatctgtcagttaaaactcataaaatttattacaagtaaacagccgacattttatacaaaaaagggatgataggaagaaacaaataaatacattaaatgtcagatacgccaaaaacttatctgcctgacccctagttgtctccgtaatttttggatgaaaaccagcccacccctgaccctgctgctctgggagaggagccccagccttgggattcccaagtgtttgcattcagtgatcaggactgaacacacaggactcaccagggagtttgtgctaagctgggttttccttgttgctatattaaaatgtgattcatggagaactagagagattgagtgtgagttacatgagtgagagaaacagtggatatgtttggcaatttctgacttttgtgtctctgtgtttgcaggtgtccagtgtgaggatcagctggtggagtctgggggaggcttggtacagcctggggggtccctgagaccctcctgtgcagcctctggattcgccttcagtagctatgttctgcactgggttcgccgggctccagggaagggtccggagtgggtatcagctattggtactggtggtgatacatactatgcagactccgtgatgggccgattcaccatctccagagacaacgccaagaagtccttgtatcttcaaatgaacagcctgatagctgaggacatggctgtgtattattgtgcaagagacacagtgaggggaagtcaatgtgagcccagatacaaacttccctgcaggaacgctggaggaaatcagctgcagggggcgctcaggagccactgatcagagtcagcccaagaggcaggtgcacacagaggctgatttcctgtcagggtgtgggacttcgtctttttaccatttctctagggaacctctctaagttcagaattctgtgcttaccaatgtcatctctacatgttttttaatgattattttgagaacctattcttacatgcacaaaatgcagatggatgcttacagagatgaaaagtcctcaaccatggtcaccaggatcagccttgaggaaactcaggggtgcctggtgaatcttctccagtcagactcaggacagaaacctctgtgagattccctgactagatcagtcttcaggaattttgataccagccaatagagaggctgggccagggtcagtgtcatgtagaacctcacaggtttcacgtctgacccttctccttctcctgacactaaagtatgcaaatcagtatcagcactgatctgggtccccttttgctcttaaaccattctatttctttttatttgttgttgttcttgcttttcctcgtacttctcttgctccctgtaaaatggggaggtgtttcttgctgcaaaagccccaagcctcaagcccattccctgcagctcaggcggggctcaggctgtggctcctgcagccacatgggagtggctgttggggctttctcttctcccattgctcagcaccctccagtgtgttgtgtggagactatctgggaacgaatgtggacaacaggagtgaaggggatgagcttgcgtggacagaatgggatgtggatgtgaaatttatcctgtgctgtacaaacaaccacagattcaacttcctcaccagtagtattagaaagagggtgtgaaagttgtcagaataaaaatggaaacacttgtgttaacaccctgacaaatggaactaggaatgaccatgaagaagtttctcatgcatatactccagaaaacaagaactaccgtaaatggattctgcttaaccacagccttggatagaagaaaccacaaccttacaaaaatcacttctacaaggatatcttcccagcaactccctgtttaaccctacagtgatgccacccttagtcctacaaaaatcacttctacaagaatatcttcccagcaactccctgtttaaccctacagtgatgccacccttagtcctgattctaggagcacaggataatcctctcaaaacgacttatgtaacccacctcattttcactgtgtaaacctatggattcacatcctggagtcactgctgcatttgttcttaatggtcattagcccctttcacaatatttgaggctgtttttctctgatgtctcttctaaaataaagaatttccaagtggacagcagtaaagaagctatttaggaagatgtaatgggaaggcatctttaacattctgttgaatgtttccacatggcacttcaatcccctaaaatactttgctgtatcagcatgtgatgaatcggagtataatattgaaggtaaaatgggaaatacatgggcttttgatgaatcaagtcataggatgagaatgtctgtgtccttgaggaaggagaccatgggttgtaagttctagtggaggtacctttggcaaagggagttcatgagtttctgaaccttatgctacttttaatttaaggacgcaatttatgatgtatgtttacttaaatctttccagagacatttgtcagtaaggacagggtagcatttgtgtaatagtgatgacttagagagttattttgtaattgctcctgtaaggtatgcacattgctcacttgatacagaagttcaaatgtcacaggtggaaaaacaggaataaaggtgggcagatcacaaggtaaggagatggagaccatcctggctaacacggtgaaaccccatcgctactaaaaaatacaaaaaattagccaggcatggtggcgggcacctgtagtcccagctactcaggaggctgaggcgggagaatagcgtgaacccgggaggcagagcttgcagtgagccgagatcgcaccactgaacttcagcctgggcaacagagggagactccatctcaaaaaaaaaaaaaaaaagaaaacaggaataaagcaaattttatgaactgtcatgactgtagtttttggcaaggacattatcatgtcaacctgtaaataaacagacaacaataaaacatatcaaatccatggggagtctgacctatgtccctctgtcttataagcacaaggctttgccacatccaaaatattattcaggctccagggtataaaatgcttttggactgtggaaggtaacagctctcccctcaggcaggggtaaggtatctggggaatgcagagttgtgttcataaggaagatgtcattatcgtgtcttctcctgtgcctggtagcaggtcctgaaggtgaacgtctcagatgtcagacatgggtctatcgggttaggataggtacatgtgactgacagggactgattctccatgtaatcacatgccctgtcccaggagcagctgcaggagtcagccctggacctgaatagcacacacttaccctctgcctcacctacactgttactggccactccgtcacaaccagtccttactagtggacctggatctgccggctctcagggaggggctgcaatggataaaatccattgctagtggtggtgggagtccatttgtcttgtggaaaatggcagcatttccttattttataaggcataataatgctatgttgtgtacacataccacattgtctttatccatttgcccattgacagacacttagtttccatatcttggctgttgtgaatacagctgcaataatcacaggagcgcaggtatcttcacaaggcggtaatttcatctctttgggtatatttccataagctgcatcactggtcatatggtatttctgttttaattcatttaggagccaccacactgttttgcctaatggtaatgatgagaatacagaatgtcatagccgctacgaagaacagttttagatttgaggtataatccaaaagcaaataatgtttgatcagggttctcatatgaggctctaataaataagtccagaaagttttcccatcttgggcaaggatgagtttgcccctaattgtctttgaggaagaagattggcagaacgtgagatggagtctgttggcaggattcaggattcagtaataactagtaatggcacagaaaaatagagagatagagacatacagagaaagagagagagaatatgaatctcataagaggaaaatttgctaaatatcagcattgggttttcagtcatagacacatttgtatgagccaggaaccatggagtcaagtgaggagtggagaatatgttcagtccaaaaatcagcatattctcagaggcacccattgccccatcacacaggtggagaattttggaaaccagtgaagtgcgagttcacattaggtgattaagctaccatgtttcgataaactttcattaacatgcaaagtacttccatagataactgatgcacaaatatacgagatgcctttttgcgtttatggatgtctagagaaaaataagtgagaaaatttttccaggttgcagagatctgtttaagttgcagattccataggagagtgtctttgaatgaatactgttctattaattaaataggtcaaaattccctctgttggagcagccttccaattatatagatttctttatagcttcttgagttgtgaaacataaacccaaggattgacttactggaatatgactgctgtgttgattaaatttctgataaggtttcttccaatgatttgagaatagctttcctgtttttttactcaaggaaatgaattttcacaaggtctcaggacatcacgtttcaggtgctttagttaaagagactcttcttgggggcagtcagctttcttccaaccatgagctcatttcttcagcaaaccattcgctttgtgcctctattaagaattatgaagcttttgtacttcaatgcactgaaaatcatgccccttgaattaaatgttgattggcactgacatgaattggccactcttgtatatgtgtcctatgttatgggctcaacataacagtggactgagaatcgtccattagctgcctctgattgtggcactgaccagattgagaatcctcagagtcatccatgaaaaagagagtccttaggttcatgaggttcttggagacattcaggtaagtggaggagagaaacaggattgggggctgccagccatttcaacaagactgggaacaattatcatctatgtttaaaggtctacatcattccaaacaccctccaggtttctctgagttcattgtgatgattacattcagctgcttctccagtgagtttaaatgagcatgtggcaattcagatgagcctggctgtggggtttattatatgtaaatctgaactacataaacaaagagggcatgtctgaccgtatgagggtgcaaaatcctggagaccccacaccccacactcttgtgctttcttttctccagcaacctccaggtttttttgtatgagaattgtaatagattatctcatggctaagtcatcaagagacgtaaactctgagaaatacaagcagaaaattctccagatagaagatccaggggaagaacatttctagcaccttatctatgtaggggaaggcagtccatctccattacagacccctcacagcagccttcctttataaggaaaatgggtcaaattagccaatagggtaagaatcctataatgttccagccagaaaagggaaagcatcaatttgacttctggagactctgtatataggtcacattccatagaaagaagagcactaaattattaagattcaattgtaactacatatgatacttccgggatgcacaaattaaagatgaaagtgtgacaatgcacaggctctgtcagagaaggagaacgtagggaaactgaaagagaatggcagagagtaagacaaggacagaagagcaatatgaagcctctgacatcaactctgtaaggacaaggtcttggcaactcccgcattgaccacagattctgttaccatgggccatttgcagggttcctagctaaggaaaaagaaaaaaaaaactgcatgcacttcccaagtctccacttgtatcctgtttttcttagatctctaggacaaaaaaaatggcataaacctagacctagtgtcagtgtaggaggtactttctttataggcaagacactaggaagaagggaaaatgtgtgttattggactaggagatacagagatggctttaatctgaatagatctacacccgcaggtattctcgaatgcaacattcaactacaagagcctaatgaagaaacacgaccctccccaaacccctgcaagctcttgtattcactgtgtctccactgatttagtgcacctggagcttcagagcactggctccctcctgtgtcctagaatcttttctttgggtctttctgcagaattcaataggattagttaggctaatcaattgtttcaagagatggtgttggcagcatatattgtcgctggaagagtattctaagccaggacacaggcactttatgccggactaaagactctggagaaaatgttttgtgagccctgacagaaacctccttgaaaggtaagggctgggcaggagggggcactgaggagccacgcagcacacggtccagccctagaacaggaggctggggaggaggtttcctctcagggcctcggttttccttcgtcagaaaaaaaaaaatctaaaataaccgttcaacaagttgctgatatgccttcaaatatcctgctacaatggaacaattcatataacttcaggcaatgagaactattttttaaattgggcttctaggattataagtatcttaatagtgaaaatgtgaagaataggtatgattttactatttcaatggatacagaattgtgggagtcactatattcctatgaacaaaaaattcagatttcagtgttaagtaatgttgcctacattgtgtgagtgacggggcagtggtggatccgagagtgtggtgggtgcacggacataatgattcagaaagcaatatggaaagatgagtatctatggatacgaactgaaagtatgtaaatacttcacaaaatactaataaacggagttgaatataaaacccataattatccaaaacacaaatttcttggaagttattttgggaacatgatttcttaaagaactccaaactcttgtttcaacttctgactcctcgtttctgtgatataagaaaaccatttccaattatgcatctcagggcaattctgtaaacccagagcgtttctgctgaagatcctggggaatcaagacaccgggcaggtgatggagacactgtctcaggtgcgcccaacgaatctcagaggaacctgctggagagtcacgtggaacatctacagtcagtttctcagagtcaacagtgagctgtgttggtgcctgaggggaccatgatggggccaaggcacgtgcccagtgtcgtggacagtgatggtccagaaatgatctagatggtcttgacgctaatgaaatatgggttcagagtgaggagcataatctgtggggacttgttcttcagtgaaaggatcctgtccgcaaacagaaatggagcaggacatgcatttcttcaagcaggattagggcttggaccatcagcatcccactcctgtgtggcagatgggacatctatcttctttctcaacctcgatcaggctttgaggtatgaaataatctgtctcatgaatatgcaaataaccttagatctactgaggtaaatatggatacatctgggccctgaaagcatcatccaacaaccacatcccttctctacagaagcctctgagaggaaagttcttcaccatggactggacctggagggtcttctgcttgctggctgtagctccaggtaaagggccaactggttccagggctgaggaagggattttttccagtttagaggactgtcattctctactgtgtcctctccgcaggtgctcactcccaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagacacagtgtgagaaaccacatcctcagagtgtcagaaaccctgagggaggagtcagctgtgctgagctgagaaaatgacaggggttattcagtttaagactgtttagaaaacgggttatatatttgagaacaaagaacaatagaaacacaatctaattgtaagagaaatattccattcaagagccaccacataagccaaactgacagagtgggaaaggccacactcagtaaagttgatacaaacataccataaaggtgctactatgaacaagtttttgaattagatgaataaatcatttggagcaaggttatttggtcatatgttaagagtaagcatgattcttacaaagtgggaaaattgtctttcaaatgtttctgtcacttcttaccataaagttcattttagaggttttaggattacagtgaaattgcacagaaggtgtgagaattcccatgaatccctgccccgcacggacaccgcctcctccactacagccatcctgccccacagtcacaaataagtcacaatggatgaatctacaagaactcttggttctttctttttctggtgatcccctaatataacaagcctaaattatcttggaacacccaggtattttcaatggctttctagaagtgatattagtcagagggaaagtgagtgaggctattactatttgagcactttcttccaaaatccacaaaatatatgttaatttggagtttttctaacttctggtttacaatgtcccttcccagagagtaagatttttaagcttttagtgaggctggaaaaaaaaatttttaaaaaagagaaataagctttcctgtattaggctgacttatcccagcggcagcaacaagcacagcccagacccaggaaaagtcttaataatattatctaatgtgctctggagactctttcagcactccctcaacatagggagaagaaaaacaaattttcctttgtcttatgatatgagtttatagagtcttgttctctgtaactagtaacttcaagtattctgttttatctaagaagcacaacgaaggtcatgagaagcctagcaggccagaactacagctgtctaggtaccggagtgagtgttatgagatcaaccagtgcaaggctctttagaacaaaacctagataacagacatctgggttgcatagcaatggtcatgtgtaatcctgagttatgaacctgttacaatttgattaactgtctctgtcctgcctccgtatccctgcttttgtgcactctaagcttgcttcaagctagcccaccccattttgggaagtgtgtataaaagtcaagcgctctctttgttctgtgcccagtctttggtcattgagtctgctgggtctgggtgtactcagtaataaaaatatcctcctgtatacaccccaagatctctctctggtcctccggattctgcaacatttcaggcagattcacatctctaaaaggccagcaagttctggtcaatcccataatgaaaatcctttaatgagacttggcacacgtgacaataagagactccttgtataatgccctagagttggattagacacactgtgagctcttgggtggtggttctgaataaggcagtttgtgcagcaaatgcaaacacatgcatgggatccaggcaggaacaaaagcttccctttacaaagtgggtgggcatctggagggagccctcagaggtgggcagtggtcgtccttgctgactgcacattagccagaggcgtgaccataattggtcttgcagggaaagagcaccactgaggtcataggttatgaaaatgtttgtcatcctccagtgagcaagtccatcctgcttgcttgtgggtgtcaactccatggtggatacactctgggagatgacaagatgcacacaaacctcctctcactaattatccactaccacacactcaagaccaacctttgctccagaaaggaatacgtgtctgtggaaatagacagagcttaagtattttgtaacctggtgaacatactgtgcaaaaccaaacgtttcaggaagattagctcagaaatgtttatcaagtgactgaagggcagtggcgggtgaggtgatgggacagcctcagggctgcacatgaggagggctccctcccccatgcaggcttttcctccaggagctgcaccaggaactcaaggaagatcagggagaattctgagaacaccctgctgtggagctgcctagagaagaagaataaatgatgaaaaatacaactctgagtaatgcatgggtttttgttcatgaaaactctctctctgaaagcttgtgaaggtcttgaaatacccctgattagctgaagacaaacatttaaaccctccttccacagggagttcaagcaggctggatgtgtccttctatggatgatcttcctcagccccttcctcttcccagctcatccctggctctctgtgtaaaaagttctcatcagcggaatgtggttgatgaagtgacgtcttcaatttcctcatcttctatgtggtcatgttattttcctcatctgaagtttaaaaactcacctgcatgcagcacatgacaggctaaaatctcttgtggacaaaacagtaacaaaggcacccaccatggttgagcacccgtgttgctgacaacgaccaccaggggtcaacgtcctcttcacaatcctgtgtcagagcagcacttgagtgatttcaataacaacttcccaggagaatcagctgaaaactacttgtcccattttccatacagatataacccctctattttcctgaagaaatagaaagagctgaatgctgaatacactgaatgtctgctggttttgcaagtttgtgactatatcactttctaatttctgacctgtgcagaccactgtacagacttttctcactggtgggaccaggcttccagatgtcaaatataaatgagcttcttcatataaaagtcaacacaagctcctcatggtttcagtgctcactgaatggagttggaaataaaacccacaattatccataacacaaattccttggaagttattttgggataatgagttcataacctgtagaccaagagtccaagagtgtttctattgaagagcctgggggatcaagacaccaggcaggtgatgcagacactgtctaaagagtgcccagcggctctcagagggacctactggatactcacgtgggacatcagcaatcactttctcagagtcaccagtgagctgtgctggttcctgaagggtccaggatagggccaaggcacctgctctgtgtcggggagagtgattgttccagaaatcatagaggtggtctctatgcttataaaatctatgttcacagtgagaagtctgttctgagagggcttattcttcagtgaaaggacctctgcccacaaatgttcataaatggagcagggcattcatttcctcaagcaggatcagggcttgagtcatcagcatctcactcttgcaaggctgatgtgtcgtttgtcttccctttcttatcatcgaccaggctttgagctatgaaatgccctgtctcatcaatatgcaaataacctgagatcgactgaggtaaatatggatatgtctgtgccctgagagcatcacccaacaaccacatccctcctctagagaatcccctgaaagcacagctcctcaccatggactggacctggagaatcctcttcttggtggcagcagccacaggtaaggggctcccaagtcccagtgatgaggaggggattgagtccagtcaaggtggcttttatccactcctgtgtcccctccacagatgcctactcccagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatacacagtgtgaaaacccacatcctgagaccgtcagaaaccccaaggaggaggcagcttcactgaatgaggaggttacagggcttacgatgtttaaagttgttcagaaaataggctaagcaattgaggaatatgagtaatagaaatatgtacgcactctatacaggaaatatttctaataactgtcaccctatatgcaaaattcgcagagaggtaaaagcagaaatcagtcaagctgatgcaaagttccccacgtaggctttgtgcagatgtaagttctaaaatcagatagataaataatttggagcaagattgcttgataacatggctaatgctgaatatgattcctaaaaactggccaaaatatattccaatttgtctctgccacctctcttacataaaatgtattaaaaagtagttttaagaccacagcaaaattgaacagaaggtgcagagatttcctatgtgcccctgcttcacacatgcacagccttccccactgtcaccatcctgccccagagtcatcaataagttacaatggatgaacttacatggatggattggttctttcctcttccggcggtcccttggcataccaagtctaaactatcttgaagcacaacaggttcttcgagtgggttcctgggaatgaagccagttagaggaaaagtgggtggggctattcctattaggagtcttttttagaagactcataaaatgtatatgttcctatagattctgtgactcctgacttagtatcccttcccagacggtaagcttcctaaatgtttagaggcagatccatatctatggaaagaaagcaagttctagtgaatcccataaggaatgtcctttaatgagaagtggagaccttggtcatgaggcacatcatgtatgattttctataattcctttagattcactgtaagcttttgagggtgtttctggatgaggccctttgtacagaaaatgaaaactcaggcatgagttccaggcacaaccaaccaacttccttccaaagtgggagggaatagaagaaaccctctcctgtgtgggcgctggtccccctccattgctggctgcacattagccagaggcatgagcccaattagtcttggagggtgacagccccactggggttgctggctatagaaatgcctgtcctcttccagctgagtgagtcaacctgctcgcttgttggagtcaactgcatggcaggtgcactctggaagatgacaagatgcacacaaaccttctgtaaagtatcaattactacacactcaaaaccaaactgtattccagagacaggtgtctgcagggataaacagaatttaagcattttttgaatagggaagacactgccaaatgccatatgtttcaggaagtttaactcagaaatgttgatgacataactcagaaacgtgaggtgacatgacagcttcaggggctgcacatgaggagggctcacttccccatgcaggcttttcttccaggaactctaccaggaactcacagaagatgagggagattctgaaaacatcattctgtggtgctgcccagggaggaaaaataagatatgggaaaaaaaactatataaattattagatttgttaatacaaactatttctgaagccttgtggaggtcctgacataagccatcattagctgtgaacaaatatctacaccctcctttcctggggagttcagttaggttgcgtctcttcttttatggacagtatcccccaacccctttatttcctgcacacctgctgctctccatgggacgagttctcatcagtgaaatgtggttgatgtagtgaggtcttcacttttctcattgtattagtcaggattatctagagggagaactaacaggatagaggtctgtatttgacggggagtttttaaggaggactgactcacacgatcacaagatgaagtctcatgataggccgtctgcaagctgaggagcaaggaagccagtccaagtcccaaaacctcgaaagtcaggaagacgacggtgcagccttcggtctgtcgccaaaggacagagagcccctggcaacccgctggcttaagtccaagagtgaaaaagctgaagaacttggcgtctgatgttcgagggcaggaagcatccagcatgggagaaagatggaggctggaagactcaacaagtctagtctctccaatttctcctacctgcttcattctagccatgctggcagctcattagatggtgcccagggaggttgaggttgggtctgcctcacccagtctactgactcaaatgttaatcttctttggcaataccctcacagacacactcaggaacaattctttgcatctttcagtgcaatcaagctgacactcagtattaaacatcacactcatcttctgtgttgtcatgttcctctcttcatctgaggttaaggaactcaccagcatgtagcacatcgtagcttaatgtctctcatggacaaaatagtggcaaggcacccactagggttaagcatcctgtgtcgccgacagcaaccaccacaggaccaagtctctctaccatcctgtgtcagggcatcgcctcagtgattgtattggcaacttccctcgagagtcatcttaaaaacggcttgtctcatttcccacgaaggtatagcccatccattttctcttcctagcaaaatggaaaaggatgaatacacggaatgtctcctggtcttgcaacttggtgactttattcctttctaatttctgatcaatgcagcccactctacaattttttttttcactgaaatgacccacattctggatgttaaatataattgaacttcctcatttataattcagaacaagtacctcagagtttctgtcctcatgcaccactctaaacttacacaagttgtttatttatttgtttcattttctggcatctctactgggggtcttcatcatacccattttatgttatttctacaaatgatttttaaaatttataggtacttaattaaatattcaggaaacaagagaataaaatgaatgtaaaataaaataaaagtaaataaattaatatttaaaataaagaagccagcagctgaaagcaaggaaaatctattatgctgggtcagagagtatggagaactcatagtacaatatcttctgcacgttaatcattacttctactcaagttacagggtcctctctctttatatcagagctttccctaacatgtgcaatgaagactgaacacagattcctccctcaagactgacctagcatctctcactgagcctgagctgacaagtcatagatatcacatttgtctaagaaaataatgacaccctgtaaagttacctaccagcgatatggagacaatttgaataatataaataaagcctaaacttgataggtagtcatttatccttagaaggattgactgctgtctctacatgtgttttttatcacagagaagctactagtgccacagtccaagttgctgaatattttatttcctagcatgagttactacagaatgtgttcaacatgaaagaatgcagctgttgttaagggagaggagatgtgattatggaacacgagcagggatccagcagacattcctctttcacgtttgccccccaacagagacaccagtaaaacgatgaaatgattgactttagtctccacagtctaatgtgagatttataccagatgttttctgccactgttttatagtagaaaatataatctctaaagaaattccatttttagagacaataccatcctccaggaagctgcaaatgcccataacagagagtattatagtgccttgtggccaggagctacaacacctgggtttggaaactaatggacagaaatatcaggttttcttgccaaatctatgatgaaaatttggagaatgtttctttccatctccataacaatatgttgtgatggagtggaggtcctggtacataagaaggtatgtgttcgcagtgggtacagaattagacccataaaatgattgttctactggggttcccttgttgttggaccagctgaccaagaaagtgttgtaagaggtgtagtatttagtgaatactgtcatatttttgaaggtaccatatttgaagctaccaggagaaacagagatacatcaatctagcctagggagactctatgaatttattttatttccttcaaaatgaggtaaaaaattgcatcagttgaaatgccgatgataatcaagtgatgaaagacaacatccactcagtgttttaggtgtggtttaacccaaaagttatacaatatgtgagaacctgaactctggagccctggccatctctcagaagaatctagaaggtagactgacctctcccacagtgtgatgtccatggagactggggatggctactgtctcaatcttgggatcccggaatagtcttaatatgattctgtgtgtatgtggatcattgtgtgtaagtgggaggattccaataactgtgtctgtgtgtttgtgagtgtctatgtttctgtgtgtgagcttgtgtgtctttgttttatattaaaatgagtaatttagtttctgatcattagactgtgtctttgagggagtgtgtgggagaatgtgcatgcctgtgtctgtgagttagtttgtaaaagggtatgttatattgaatgtgtgtgtctgggtccttcagtatttgagcctattaatttacatgaacatgaattttttgaaggtgtgtaagtataaaacttttgtaaatgtaattgtttgaatgctagtgtgtgcagagctatttgagtgtgaatgtgttacttgtattacttagtgagtgtgtgcccctatgtgagtttgtttgggtgagtcattacctatgactctacatatgaaggtgttgagggtgtgtgtgagtctgtgagcatgttttcattacctatgactctacatatgaaggtgttgagggtgtgtgtgagtctgtgagcatgtttatgtgcatgtgaaatgttgttatgtatgctttgaaagacttgtctcttgacctcaatatcatttgtctgaaaataccaggtatgtttaagcccttagaatctaaggaatagtttgttgtttaggataaatcctcaataagattaacaactgatttctcaccaaaaatcaggaaggccaaagctcactggagtggcatatcaaaagtgctaaaatacactatcaatcaaaaattccatactagcaagaacaccttcaaaagtgaaggagaaatcaagataatagaaataaacaaaagctatggagtccatcaaaaccacaaattcctaatgagaaatactaaatagagtcctgcaggctccaatgaaaacagagtggagaatatttaaaaatcttacacctaaaagaacaacaacaacaagtatcccagtaatcacatttgtgtaatgaaaaccaatattgttttatttttgccttgagtctcatgttctattccttttttaaaaaaaaaatagatataatagtaatgacaaatttgaataatgtgcctataatttatggttataaaattcattataaatttgaataatgtgcatataatttataatgtatgaatatgtaacaacacaataagtgaaaatggatacagctgtagagaagcagagttgtatgcactattgaactaaggcaatcataatttaaactactctgttataaatctgaattaccaattgtaatatccaggttagctataaaaacttaagtaaaagtaaaaaaaaaaaaaaattagcaggacagctgactaaacgtgcctgacactcttcaaccccacatgaaataaccacagaaatgaataaacagctgagactagagaaattcaacagagttagatatcatactaaataataaagcaaaaagcttacagctgaagaatttaatgaataaaataaaaatgcagtttacagattcaataacagaaaataacgagcaaaaataagaatttctgagcttgaagacaagtctttcaaaataattccagcagaccaaaaagaaaaaaaaagagaatgaaagagagaaggaaggaaggaaggaaggaaggaaggaaggaaggaaggaaggaaggaagataaaattttaaaaacatagaaaccctatagttttcaaaacacaatttgaaaacaagtttttgagttatggaaaatccaggggaaaattccagagggaaaaaaatgaaaatgatgtaggaaacatatttaataaaacaagagcagaaaacgtcccatatcatgggagatagatggttattcagatccaggaaactcaaatattccaaacagactgaaactaaacagatcctctctgaagaatgctttcctcaaattatcaaaagacaaagatagagcatgatagagtaggatagtatattcaaaatattgaaataaaaaagtatccagccaataatataatacctagaaacattattattcacaaactaacaaatatataatgtttatcggactaacatgaacaggaaatccatcacctccaggctggccttacaagaaatgctcaagattcttacatctggaagagaaaacataatagccacaattatgaaaaaattttaaaaaaccataaaacccactagtaaagccaatacacaaaaaagaaaataaatgaatcaaatcttatcactacaaaaattacaaaactacaaaaataaccaataggttaagaataagaaacaagagatacacaaaacaatgagaaaagaatcaatgaaagtgaaagaagtaagacctcttctatctattattagcttgaaagtaagtggattaaattttacatttaaaatacatagactgagttgaagagaaaagaaaagaaaaaaagaaacaaacaaacaaaagtgccaactataggctgctatgttaagcccattttgcattgttataaagaagtacctgagtctggacaatttactttaaaaacaaaaacagtctacaaattcaatgcaattcccatcaaaatatcaccatcattcttcacagaactagaattcatatggaaccaaaaaagacttggataggcaaagcaagactaagcaaaaagaacaaatccggaggcatcacattacctgaattcaaactatactatagggccacagtcaccaaaacagcatggtactggtataaaaataagcacatagatcagtggaaaagaatagagaacccagaaataatgccaaatattatatcaatgaatctttaacaatgcaaacaaaaacataaggtggggtatggagaccatattcaacaaatggtgctgggataattggcaagccatatgtagaagaactatatcctcatctctcaccttatacaaaaatcaactcgagatggattaaggacttaaatctgagagatgaaaacataaaaattctagaagataacatctgaaaaactcttctcaatattggcttaagcaaagtcttcataaccaagaaccaaaagcaaatgcaacaaaaacaatgataaataggtaggacttgattaaactaaaaagtttctgcacagcaaaataaacaatcagcagtgtaaaaagacaatctatagagtgggagaaaatcttcacaatctatacatccaacaaaggactaatatctagaatctacgaggaactcaaacaaattagccacaaccaccaaaaccaccaccaaaaacaattccataaaacaataagctaacgacataaacagaccatcctcaaaataagatatacaaatggcaaataaacatgaaaaaaatgctcaacatcactaatgattagggaaatgcaaatcaaaaccacaatggagatgcaagtcaataccacattactcctgcaagaatagtcataatcaaaaaataaaaaaatagatgttggtgatgatgcagtgaaaagggaacactggcgggaatgtaatctagtacaaacaccatggaaaacagtgtggagattccttaaagaaaaaaaggagaacaaatatttcatccaggagtcccattactgggatctacccagaggaagtcaccatacaaaaaagatacttgcacatgcacatgaatgttcacaggagcacaattcgcaggtgcaataatatggaacgggcccaaatgcccatcagtcaatgggtggataaagaaattgtgatacacacacacacacgcacaccattatatatatatataattttttttttttttttttttttttggggagacggagtctcgctctgtcgcccaggccggactgcggactgcagtggcgcaatctcggctcactgaaagctctgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcgtgatccacccgcctcggcctcccaaagtgctgggattacaggcgtgagccaccgcgcccggccatatatatataattttatattttctatatatacatattttttatatatgtacatatatacgtgtatatgtgtatatatgtatatatttaccatggaatattaagccataaaaaggaacaaaataatgacagtcacagcaacctggagggaattggagaccattattctaagtgaagtagctcagaagtgggaaactaaacattatatgttctcactcatacgtgggaaataagctatgaggatgcaaaggcataagaatgatacaatagactttggggacttggaatagatgaggggggctgagggataaaagactacaaattgggtacagtgtatactgttggggtgatgggtgcgccaaaatctcataaatcatcaccaaagaaattactcatgtaaccaaaccctacctcttcccccaaaacctatggaaataaaaataaaattatgtaaagtaaaataaaataaaggtatatttggctgacagttctgcaggctgtacaagaagcatagtactggcatctgcttctgtcgatggcctcaggaagttttcaattgtggcagaaggtgaaaaaggagcacgtatgtcaatggcgatagaagagaagaaaaggcagaaaattaaggttgttgggtgggtgccatgctccttaaacagccaggtatcatgtgaacgaatagaatgagaacacactcattaccacgtgaagggcatcaaggcttttatgagagatccgtgttcacgacccaaaaacctccctctaggtcctacctccaacaccggagataacattgcaacatgagatctgaagtgaacaagcatccaaactatatcagttacctacaaaaaactcactccaattgtaatgatgcacttacgttgaatatgaaggtatggaaaaagttatgtaatgcaaataaaaactaacttcacctggagtagctatacttgtagtggataaaccagactttaagttaaaagctgtaaagacagacaaagaaggacactatgtataaataaagagttcaacccaggaagaaggcataagaattttaaagatatatacccaacgatacagtacccaggtatgcagagcaaatgttatcagatctaaaaggatagacaccaatacaataattgctggcgacttcaatccctcactgaaagcattgcacagtttatccaaagagaaaatgaacagaaaatttcagattaaaattgcaccagaggccaggcacaataactcacatctgtaattcccgcactttgggaggctaaggcaggtggattggtagagagctcaggagtttgagactagcctgggtagcatggcaaaaccctgtctctacaaaaaaaataaataaataaaaaataaaaaacagccagtgtggtagcatgtgcctaaagatccagctacccaggaggctgaggtgggaaaatcaccagaacccagggagatagaggctccatagagccctgatggcacccatgcacgccctcctgggcaacagagcgagactgtatctcaaaaacaataattgcaccacagactgaacggactcaacagacacttacagaacacttcgccaaacagcagcagattgcacattctttttaacagcacaatgaacatcctccagaatttaatatatttggacacaaaaaagtctcgaaattataaaaatatcaaagccatatcaagtatcatttccaaacacaatgaaataaactagaaaccctagaggatggaatatttgaaacaatgcaaatatatgaaaattaaacaacatgcttctgtgtgaccattggataaaggaataacttaaaatgaaactttaaaaatttattgaaataaataaaaatagaaatacaatatagcaaaagctactggttacagctaaagcaatattaagagaaaagtttctagcaataaacacctaaatcaaaaaagtagaacgatttctcaaaaaccacccacctatgtgtcttaagaactagagaagcaagaacaaacagaattcataattgtagaaaaaatagacagtaaatatcagagcagaattttaaaatacagaaaaaaaattctataaaggatcagcaaggccgggcgcggtgactcatgactgtaatcccagctttttgggaggccgaggggggcggatcatgaggtcaggtgattgagaccatcttggccaacatggtgaaaccccgtctctaccaaaatacaaaaaattagccaggcgtggtggcacacgcctatattcccagctacttgggaggctgaggcaggggaatccctcgaatctgggaggccgaggttgcagtgagccgagatcgcgccactgtactccagcctggcaacagaacaagactccatctccaaaaataaataagtaataacaaaagggatcagcaaaacagttgttttcttgaaaatgtaaaaaagcaagaaggcattatctagattaactacaaatgaaaagagaaaatgcccatatacatacaatcagaaatgaaaaaagagacatcacaatgataccacaaaaatacaaaagatcattagagggtattatgaacaactatatgctagagaaaattcaagaacctagaggaaatggataaattcatgaacacatgcaaactaccaagactgaaccaagaagaagtagaaagcctaaacagaacaatgaataacaggagataataataatgaaaagtctcccatcacagaaatgttcaggacctgatggtttcacagttgtgttctacttaacttaaaaaaaaatcatgaaaacagattattgttaaactattcaaaaaattgaagaaaaattatttaattataattttaatattatttttaaaatttcaacttttatttcaggtacagggggtacatatgcaagtttttttacatgggcatattgtgtgatgctgaggtttggggtatggatcccctcacccagggagttagcataatacccaatagtcagtctttcaacccatgcacctctctctccctccccactccagcagttcacagtgcctattgtttccatggtcatgtccacatgtgctcaacctttagcactcactttcaagtgagaacatgtgatattttgtttcctttttctgtgttaacttgtttacgactatgacctccagctgcatccatgttgctgcaaaggacatgattttgtttcttttgtgacagagtctcactctctcaccaggcaggagtgcagtgacgcgatctcagcttactgcaacctctaagtccctggttcaagtgattctcctgcctcagcctcccgggtagctgggattacaggcatgtgccactatgcccagctaaattttgtatttttagcagagagggggtttcactatattggccaggatgatcttgatctcctgacctcatgatctgtctgcctcagcctcccaaagtgctgggattataggtgtgagccaccacacttttttttatgaatgtgtggtattttatgattttatattgcatacataccattttattcatctaatacatcattgattggcacctagattgattccatatctttgcggttgtgaatagtgtggcaagaggcatgagtgcatgtgcattttttggtagaatgatttattttactttggctatatacctaatgatgggattgctgggtcaaacagtagctctgtttcaagttctttgagaattctctaaactgctttgcacagtgctgaactaatttacatttccaccacccatgtatgtgttcccttttcttcacttcccacccagcagctgttttttgtttaacttttttcatattagctattatgactggtctgagatggtatttcattgttgtttttatttgcatttctctgataattaatgatgttggaaatttttttcatgtctgttggccactgagattgacaggcttacaagtgtcttagtccagcagttttcggtaacaggctatccactttcattttctcttcctcacatgccccatttctgggttgtccatcccaaccaacagttactgctggagctgaatccactagcccgcttccatgggctgtcaggaacacattgcaagggtgacacacacgatgatccatctctgcagagccaactctccttctccagagattcatccaagaaacaattttgactatacctgagctctgtgacatctgaggacatggtttgtattactgtgcaagacaaacagtgagaggaagtcaatgtgagtccagacataaaccttcctgctgagaacaatggaaagcttttcttctaagataaggaataagaaaagaatgcccagtcttaataattctaatcagcatattgatgatagttttaaccatagaaatttgagaaagaaaaaaatagtaaaaggcatacaaattgaggggaataagttaaattgtttctgtttacagacaatataactttataaattccaaaaaaataaaaaattctgaaaaaacagccactgaaaactaacaaacaaatttagtaacattgcagtatacaaaatttatatggaaaactcagtagtgttactaaaaactaaaaattaactatttaaaaatcataagacaatgtcagttgcatttacaataatattaaataacttacttagtggccatgcacagtagtttacacctgtaattcttgtactttgggaggtaggggagaatcacttgaggctaggagtttgagaccagcctgggcaacacagcaagaccaatatctatttctaaaaatcacttagaaaaaatgttggtcaaataagtgaaaatctgtgcattgaagactatatgacattgatgaaataaataaatctatatgcaaatatatgggaaactattccatattcacagattgaagataataatactgttaacatgtctatactacccaaagcaatctacagatccaaagcaatttctatacaaatgacattttcaacaaactactttttaaatgataaaattgaatcacaaaagaccccagatgtccaaagtaaccttgaatacaaacatcaaagcggggggaggtttcctagtacctgaactgcaaatatgctatgaaactacaataataaaactgcatgctgctgactttctaaataaactttaatattctgaattgaagttatttgacaatttcttctatcattttatctttactaaagtgttgcatgagtgtttatctagacagataatgtgcaaagagtcttcctgggtggtaaaatcccataagcgtctccaggagctccgagctctctctaggcttctcagtatgttcaggttcaagagacagaaagaattctctcagcccttcactgctttttgccctcttgacggtcagaagtccagaacatgctttgtggggacataatagaggggaccaaaatagacactttcagcaaacccactataacaagttctgctgcccatgggcatcttctccaggtacatgttggtcgccagaccctcaggctcacctacaccatgtggaggaggacctctacccacactcatttcagcacaactaccgtgtagctcagcatcagtaggtcacactacaatacattaaacatcactcagctaattacttattgaggttttcatttgtccatatgctatcaatattgggcagtttcaaatgacaacctagaggacttaatgatagttaaatttatgtcttctattacggaaaaacatcccttacctaatgacaggttcagctgtttttgccaagatggtgctcttccctggcctgctagtctcctacatgagaagcatcaatgaactgggcagcaccacacacttgtcaagtgatcactgggaatgatgtcagctacagaggatggggtagggttgctcatacctatgctccttacttctaggacacatcaggtgtctatggatttagagcatgtctgcaccctggtggactgcacactttacccagggagaaaggtctctgagtgtgggtggcaagccacctaggtgccaaggtaagagaccgagggcacaagctgttccagtataataaaatatataaaataagaatagttatactagatatagatcatagatatgattatatatgaatatcattaatcattagtttatagcaattactctttatcccaatgttattaataatcctcgctctataatcataacctaggaaaaaccaagccatacagagataggagtggaagggacatggtgagaagtgaccagaagacaagactgcgagccttctgttatgcccggacatggccaccagagggctccttggtctagcggtaacaccagcttctgggaagatgcccgttgccaagcagaccgtggtctagcggtagcgtcagtgtcaaggaaaaacacccgctacttagcagaccaggacagggagtctccctttccccaggggagtttagagaagactctcctcctccacctcttgtgtaggggatcagtcaggcccacccgagttatctggaggcctaatcatctccctctgatgctgtgcttcagtggtcactctcctagtctgctatcatgttccatcctgtatacctggctctgccttttagataacagtagcaaaattagtgacagtactaaaagtctctgatatgcagaaataatggcgtaagctgtctgtctctctccctctctctctctctctgcctcagctgtcaggcaggaaaggacccctgtccagtggacacgtgacccacttgaccttacctatctcattggagatgactcacactctttaccctgccccttttggtttgtgtccaataaatatcagtgcagccagacattcggggccactaccggtctccatgtcttggtggtagtggtcccctgggcccagctgtcttttatctctttgtcttgtgtctttatttctacaatctctcatctccacacacagggagaaaaacccaccgaccctgtggggctcgtccctacatctgagcttctcaatggaggtctacttctctatgagactagcaccttctgtggagtctcatgctgaatgtctccttcttgattatggtcatcggttatgcagtgctgtaattagaaacccttacagaataacctacaaaacaagaatgatactaccttctacagacatgacaattctacctaatgtgcacaactggacctattgacatcttagccaggagaggatgcaggcataaagcagatgattttccgattgttccaccctaccgggttatattgaacagtggacacaggattcaacaggtaccgattattaatccagtgaggaaattatagaatagtcccaagtctaggcagagaagagtagctgaagacagtactttccctgcagctctgagattcactaaaatgtccagctctgtccctcactcgtgaatatcacagactaaaggacacccttcccacagcattggctctccatgaagatttgaaattgatgcccaggcctcagggtctgctgacagagctgtgacagtgggagtggaactcacacagagcaaaacagagtgtgttgcataataaggctgtacaacattttcataatggagggaatctcttggtcccaggaagatgacaatttaatatgtctcaggcctgtggcgctctctttaggagctttgtgtgtggcttctttgtatactctggctccaggaactccagtgagggaagagattcgtcacctcctgtgcgaagggggctgaagcgaggaagacaagtggcctggcttccacagaacccataagctaaaacactccgagttcccttgactgcaagaaatgcagctgtcatcacggtttcaagtgccagagtctttaatgattatgtttcaactcatgagagtgccaggaaaattccaccagtatgaactactcaaatatgtcattttgtaacattacttcattgcttgctctcatatcctccatgtttctgaaaaagcaaagtttccatgctttatcatctgcaccaatgaggccatatttaagctatattttcatatgaacgtctcttgaagattttaaaatagcaacaaatgttgcaacaatatgcttaaccagaaaaaaaataaagcaaagcagtctatgttgactcatgtgacattgataatgtatattagattatattggttgcttattcagttggtcatgggagaagagccttctttccagccaaagaatactaagaactccctcttctaatgacgaatttcagctgatcttgctgagaatatttagcaagaagacagaaacagagactcctaaagggagctccagagtcctgagatacatttaagttttcattttcctggaacccagagattccccactgttctacaagacaagaccccattctatgaccctgtctgaggagagctcaggggcagtgagctccccctcacattaccccttcaccctatgcccttggggctctgtccatgcaaataagtcccgggttcaagaacgaatagaggcagggctgtgagtgttatgctgtgtgctggctctgagctggggtctctagtagcactctccacatccatagatacatggcccctccgctactccttctctgcctgctggctgccctctgtggtgagttactcatgatttcatacgtggggagacacgggatgaggcaaatgtgtctgtgactcacagatgttctctattctcaggggttcacagtgaggaccaccttgtgcaatgggaggaagaagtagtggtccccttggtcatgctcagcctcacctatgccgcctatgcacattcaatttctgaacattctgtttcctggatccaccatctcccatcaaaaggtcttcagtgtgttggtgtgatatgggttaagggaaacactaagccccaaccttcagggcagagctagcatctccagaaacacatagtaaaaaacaagaaaacttacagctgagaagtgtgatggctggggatgcaggcgtgtattactgtgctcaaggcactgtgactcgaatccagagtgaactcagacacaaacctgccctgcaggggttcttgggaccacaaggggaaggatcaggtcaccagggtgtacttaggaaccactgaactgggtcaggcacaggaggtgggggtcagggctcctccccagggaagggcttttaatctccatgccttgtaaacctctgacaagccaggcagacacagacatatttttaagctatggaaaaagatgtacctttcattttggaggaaaaagatcataagtgtgaaagcaaaacttaccaagggccaggtactggaataactgtaatctacataatcactctaagaattctaagaatttacaagtgcaatcatcctcatttcataaactcaccttaaataagagctttctaactgatcccatatattctgattttgtttatttcttcaacactttattatcttcaaggcatttcactgatgtcaattttagaagaatcatatgcaaacagcctctcgtggtggttgaaagcccacagcctcgccagtcctgtggatatttctggatgttctcagagtctccattgtctgtagagaagaattgtcccaatagttatttcacttttgtcttccacaaagttggaaagatggggatcactcaggggaatcgagatcaacaaacagaaagcctgaacccaccatatacaagataggatgtatttttttaggaatatattaattcccagaccctcaggctcacataccccatgtggaggggaacacacatccactccttcactcaagccaagctggccatgcagctcagcttctgcaggctcaggactgcaagctctccagtgtgggagtggagctaatgggaggtgaggccaagtctctgccctcacagagtctcatgatgaagatctgatgaaatatttccacagtaacatttctttggatatataaatgtagaatatattttgaaataatgaatgatgtatcttctgatggattcatgttggggaggcaatagaggaaaaataaaggtaattttaaatttctgctcccagctacagcacttgattttgatttagtgcatgactgtttgaaattttttgatgcagtcaacttcagcagcccagacctggaagcccagccaataaatgctccagattgggaaatttaaactgatgggagctgtttcatggaggaggaaaaatgctgagccagttgtgcgatcataactattgactggataatagaagcctgtgccctttctgccagtacctctggtccgaaacctgagctaatcaccctcaccaagttgagtaaacattgacacctatactaagtacaccttcatggtggtgcatgctcatggggccatctggaaagaaagaggccttgtctcatcaggaaataaggacattaaacacccaatagaaatggtgttaaactactagaggtgtgttctcatccttctcatcctccattatgcattgccctgagcacccaaaagatgactcattggcacctaaaggaaatcagactgcagaaaaggctgagaagtgagcagtgcaggatgcacacctgctatgagctttgattccacatctggagtttccatagttcaaactccattatactaaatagacaagaagcatgcctgcgactggggatttggtaaaacagatccagatttattctgaaaaactaatgcttatggattattcttactctccgaggccctggtctacaattttaaaacatttacatgagggcacacactccaaatgatattcccttgcagactttgtatgaccatgtgtcagaatggtcagaaaactgttcagaaagtcacatacgagtgtgttttgtgtgccaaaaatatctttgagactgaacaaaatctttgcaacgaagaggtacaacacagagaactgtgactcttggaagattggcaagtggattcactcacatgcctgtggccagtggcaactataaattcctcctgattgttctagatattgtttcaagatgggtagaagcatatctcaccaagtcccaaagagccacatgactggctaaggcataattcaaggaaatcgttgccaggtttggactcccatgcactatacacagtgacaatgatctttcttttatttcagagtttactcaaaaggtaagtcaagcactgcaaatcgaatggaaaccacagtcatcatggagaccacagtcagcagtaaagaaataaaagataacaccttgaagaagacaatagccaaactcaggcaggaaattgacctgcgttgggatagattttttcttattgccttgttctggggcagaacggtgccctgaagtgggcttgggaaaagtctctttgaaattatatataggaggcccttccagacctcttgccagtaacagcacctttagagctggtaaaagagcccagagttaaacaatatgtgcagattggtgcagaccttgctaactgcacatcagcttgctatttccaggcctgtttattccacagtgagcctcttcaccccttccatccaagagacaagatgccactacagtcttgtaaaagtcaaaaacaagatcagcagctgactgaaaggtggaacagaccccatgatgtgctactgattaacctttgttcagttaagttatccaatgtaaagccatgggtgcatcgctgttggagaaaacctgtcccacctcaatttgaccccagataacagactacctggtcacataagcctaaggaaaacctgaagttgctgataaagaggagacaagaagacagataggtaatacccttctgttaatataaaattcttaatgagttctatagttataagtacattatttctccttattaaaactaatcttttttgctgaatgggtggaagatggtggcttccctgcaaaagaaaacatagttggttctgtaaagagtttgcccatttcttccactataggcctgccctggcataatacaagctcccaacgtaagaatttatgattttccatccattggagaagccatcttttccatctattataaaaacagaagacacttcattaatatcactcccactataggctatgccatatccagtgaggtaggatggctgacagtggtgcgaatccaagtaattggtcaagcactgctatgtgtgaagaaacaccacagcatactctacactgtcactcatgatatggaattgttgcctccttagcaatgtaactgagcccttaatatgtggctgggatgacaaggcaatgccagcctgcagagtggaatctgttcttccctctggggttagctacagcctgtggcactcatggctggccctactttccttacaactggactaaaagaagcaactggatatgaccttatatcccaggatgtaactgtccaaagtgcattctctttatgtcaactggaaaagtgtgaaagacagacactactgacataaacagacatcctagttgttctgcccactagccagctcttccccccaggtggcagtcatagatttagaattgcaagtagaggccctggctaagcaaaccaccagtccctttaacaacacctaccatgccatcatcattcttactgaagaaacctcacagatttgacaagtgacactatgaagctatatgaccctaggtattgcaactacagccaaaggtaacacttgtgtattaatgaacactgaatgttgcatatatatacaagattagtcccacaatataactcaagctatgcaagcattagatacccatatttctgctagagatggatgccctctctcagaaccccatgacagcatggtttagttgacttcctaacacatggaagagtttcatatatagtagagctggtattctgttcattgctatcttcaattgctatggattttattgctatcttgcactttaagtgagaatgtaatactgaccttctcaaaaactcctaggtccttgcaccataatgctccaacaaacacctactgtaattccggagactccagaatatttccaactccagtttaatggattcccttccaatacatacaacctatgccctttctaaagaagtagccagaatgactatgacacatgttttccatagaaacgaaatggaatttgacagtggggaatgatatacaggcagcttaatttcaaaatgcattttaaacttagtatttgaggttttaatattattttttatactccctgaaacctgaaatttcacacttacattttaattcagacttaatagcaacaaataaccagaacacatgaattgcctgtaatctctataccttgcattgtaagccacatttcaagtgtaaccttacttgtcagcacagtatgtttaccacaggcataattgcttgtcctgactgtccagaaggcagggtggtattaagtatgcggcctctggagctgggaagtctggctttgtataccgtctctgccactgctaactggaggacaatgggccagttacttcctgtaccccagttttctcatatgtaaagtagggttgttgtaagaatgaaattagttaatatttagtacctaacaactaataggcattacatggtagctattggtattgctatcgtcagagaacacacaggagtccattgttatttttaccctccccctccaaacaaaatgtgtaagacactagacatggtagctctgtaacggggttcgtcatgtattaaactgtgtacccaaatgatatgtcaaagtcctgacaaccagcacttcagaacacgtccttatttggaaatatggtagctggagatgttattagtgaagatgaggtcttacttgagcagggcaggccctcaatgtgggaagatgggtgtctttctaagtacaaggaaatttggacacagagacagagacatacagtgtgccatatgacagcagaggcaaagatcagagtggtgcagcagtaaaccaatgcatgtccgggattaccagtcacctccacaagtgaggaaagggcaaggaagaattctcctgagtctcagagggagtgcagcccagctcacacttgattttggacttctagtctctagaactgtgagagaatacagtcctgtcatttttaagccacccagtttgtagtatttcattttggcagccctaggatattcatacagaattcttcacccaaaaggaagcactctttcacacaaacagtcaaagtcctggatgacagacaacctggagactgcaaacctccaaggaatcaaaggaagttctataaattctaggggccccatctttcaaaggctgctcctcaagtccacacccacactttggaaggagaatcctgctcttggacatgggatccttagtgagccaactgccaataatccaacatcgtcatgaattaaagatctctgacatttcctcttcaccaaggggaattctgtcaagtagtaagtaaaacccttcttcagtaatctccacaccaaacagttctgcatggcttgggacgcctcaggaaacttataatcatggcagaagaaaaacgggaagcaaggcagtcatacatggtggcagaagagaggttaaacttttctgtctctcttgggtgtaaagatataatcttgaggcaaacagcagaatcaattttcttacgccttgaaatagactccacctttctccctttcaccataaatattcccttcacattaatctaactttatgtttgcatcgaactatgtgcctttttggaagttccggaagctaatttgagacagatagacaaagtcgggagaccctgatgcagaattccagaggtgacttcaatgttgctagttaacaacccaggcattgcccagatgatgccagcccaagatctaggtggactgggatgccagagagccgccagaacaagacgcacagacctggttctcagcccaaatcttgcatgcctttcttaccaacttttccttttttaaacccctgcctttccttcaaaattcaagtggttgcttgggatgggaatgcggtcacttcccctttaccattatggttaatacaataatctttgtaccagatctctctcttgttaattggatcctgcaggtggcagattccggaccagagtgaggttagaaactgaatgcacatactgggtggttcacagacacggtgttctgtgaagtttatgggtggattcctggggaagcctgcaagcctgttagtgattagcagaaccgcatccagctactgggatctgcacgccaggtgccgtgagcccctcaccatgttccctggtcccagctgcccgcggatggttcagccttgacaacgggctcggtgttctgggtggtgggagagcaagggggccccttgggcagcgtgctacagggctgtgaatccaggggcccacccggtgttccctgtggagtcactgagggaatgaggggcttctcagggcacagagctgtaacgcctttgtgcagtggtggctgaatacagtgacactgggcgcgtggtgagaagcggggcaaggtcagttcactggaccctccgccctgagcctcagatgagtcgggggtccccagacaggcccggcctctgccctgcggcggacactggagcctttgctgtggccgccaccgaggagccttgacctcaaagcagcgggaacctctctacccacctcggaaacctgaaggcagcggcggcctctcccagccaggacctcgccggcatccgggtctccaggcccaaccctgtaccacataaaggaagtccccgctgagctaccggggggacacagcgccgttgggtgggcgggcgcggcggggcgggaagcaccggggcagctgccacagagatgcgcgggggctgtcgggaagtgggcggtccgggagacgcggggctgatgggacgtgggcggtccggggacgcgcgggggatggcgggacgtcggcgatcggagatgccagggggcagctgggacgtgggcggtctggagaggcgcgggggcagctgagatgcaggtggtccgggacgcgcgggggctggcgggttgtgggcggtccagggatgcgagggggcagctgggacgtgggagttccggggacgcgtggggtcgccaggaagcggggtctaggacttagatccgccttctcttcaggccatgcagccccgaagctccgaatcctgggatgactcctgtccatgttggaagggaccctgccagtcctggcaaggttcaaaggccttagggcaagaaatgttagtagagtcctggaagacgatgtgggaacgggtagcggacaccggatggtgatcgttctcctacaagaccttgacatggatggggagaaacagagaagaaccttccaagtttgtcccactggacatgcccaccacactttaccagcccttttctagaaggcctgtgcgtaacacatgaaaaagctccgctcgacctttccctgaccttttaaaagaaaacatttgctgcatctaatccgcctagatataaggaggttcccaaatgtatgacagagtcagaaaattacatgtcttgtaagttaccatgtgcttgtcttttgttttccgttttttttcgtttttttgttttttgtttttgagacggagtctcactctgtcgcccaggctggagtgcagtggcaggatcttggctcactgcaacctctgcttcctgagtttcaacaattgtgctgcctcagcctcccgagtagcttggattacaagtgtgcaccaccacgcctggctaatttttgtagtttttagtagagatggggttttgccacgttggccaggctggtcttgaactcctgacctcaggtgagccacccaccttgcctctcaaagtgctgggattacaggtgtgagccaccgtgcctggccgtaagttaccatgtgctttttaaaaaaatcatagcaaaggggtgtcttctggaaatgacattttgaaatggtgttattagaccacccctggaagggacacagtaaccacacgtccacgttcgttcagtgggtgagaggacatggaggggagacctgggcaggaagggaagagggttccatgccaggctgctcatatttagaagacattttcatatcattgtcattgttttcttgtgtgcgttttattcctcgctattgtatacatcattggaaattctaagtattcttttgaaatatctagtctttctagatgttctgaagtgcctgatgtatgttaaaattacaggtggtaaaataataaattttgtaaatatctttttgttaaaattcatatgcagtgttttattttattttgatgttggtggggggtggggaggatgaccaaatccctgcttgatcaacacacattgcgtttgtgctctggttcaggggaggagagaggaggagaaagtgcagacttccaggcctctgtgcgcaccgggaggagagattaatgatcatctcttctgtctgtgtgtttgttttatttatctatggatatcctgtgtataaaggatgaacaagtcctatttataacatctaatcttttcaggtgttaagttgccagtgtatgacggaagcagcgttattaaacgaacgcagcttgtacatattgtgttaaaattcataaaaagccagtcttctgaaaagaacccttgggccctccctccgcagcctccggcgccagctgcaggaagacctggccaggggaaggtgggtggaacaagctgctgctggctgtggggaaggcggtggagcccaggcctccacaggttccccacaggctccccacaggctcgcgcggatctggtcgctgggttccgcacgggccgcgtgggggcgcctgctgggagcgaggaggcgccatcctggctcgcctgctccaggaggacgctctgggcctgcgcagatgcagttctccaggatgggcgcgggcgctgggggccgcgctccttgggctgctgcgcctccactgagccgcctgggtgtgaggacctcacgccggcgcctccgggaaggacgcggagccgccgcggccgagcccagggctgcagctgctgcccgacgcccgcgagaaggcccttccgccaccgcccgcgggttcgaacttggagcagctgctgccagctgaggcgccagcggcgtcgggagctcctcagagtcagtgttttgtgctggattcggcatgtcctctgaaaactcgggaatttgtcactgaaatggtgacaggaggtgagaagtttttttagacgttgccttcgctgaccgggcgccgggctcaggcctggaatcccagcactttgggaggccgaggcgggcggatcgcttgagctccggaggtggagaagctgccttcgtggtaactgtggtcttaagttcagctgagaacgataaatggcttttccttgaattggctgcttttgtgatttctctcaggctcatctttcgtcagttaaaaatccagtggtaggtgtagcttagagacgggaaatttttggttttgttttggctacacgtaagtcttggaaattattttcttttacgttccaatgtgagcaaatccagaaggatgtcagattaaacaccgaatttaacaaattcagccgggcacggtggctcacgcctgtaatcccagcactttgagagaccgaggcgggtggatgatgagttcaggagtttgagaacagcctgaccaacatagtgaaactccgtctctactaaaaaaacaaaaattagccgggcgtggttgtgcgcgcctgtaatcccagctactcaggaggctgaggcaggagaatcgccgagattgcgccactgcactcagcctgggcgacagagcgagacttcgtctcaaaaaaacaaaaaaaaaaatcaatcattggaatactgttgttcattacaattaatgaacgtttgatacacgcataaacgcactaaattcacgagtacatataagtaaaataagccaaaaaaaaaaaaactacatcctgtatgatgacacttttatacattctacagaatagaaactgaagtgacatgaaggtcgggagttgaatggagaaaaggtgagagaaaagagggaggaaggcgttgcaagagaataagagaaaatgttgagggtaattgatttgttttctatcttaataatggtgatggttacatcaataatttccaaattgtacattttgtgtgttaattagaattttatattattcaagctattacaaataaatacctgtataaatttcttagggacggtgtaagggagatggataaatcacataaaaagtcagatatttctgaatgtacaatgaataacccttagctctatctctattttttggtaattctaaaatgcagcagttttttttaatgtttttattacaagaagggtttcttcaaaccacaccaggtatgcgtaactctgggataaagttggctaagggagctgtgggatccggtggagaggagcacaggtcccgatcctggagcccattcttgtcacatgtgagctccaggacacatctcatagctccctcatgcttctgggtttacattcacatctgtaaatggaggaccaatgggcatctgcctctaacaatgtattttcgtgtgttaagataatgtatgctaaatgtttaccacagcacaatcttttactaagaaattacattttttccaaatattatcattgtcttcaagccccaccacccactagaaaacttcatctgctctgtgccttgccctgtcctcagacatcctgcccaagagacttctatatagtaggagacatgcaaatagttccctccctctgctgatgaaaaccagcccagccttgaccctgcagctctgggagaggagctcaagtgccaggattcccaggtgttttcacttggtgatcagaacttaacacagaggactcaccatgttgtttgggctgagctgggctttccttgttactattttaagaggtgattcatgaagaactacagatattgtttgtgagtggatattagagaaacagtggatatgtgtggcagttgctgaccaggatttctctgtgtttgcaggtgtgcagtatgaggtgcagctggtagagtctttttttttttttttttttcactttttagcgaacatccatgggttacaaaataatgggttggcttttcttccaacactttacagacaccatcaattttcctcttgcttataaggttttaaccagaagaatgctgtcatcatctttcctgttcttttagaaagaatgccccctcaactcatctccacttgtctgcatgtatttctatttgtctttggttttcagcagttttaataagattcacctaaatgtgtgtgtgtgtgtcgaggggtgttatgctattgttctgtgttctctgagatgcatggattcaccgtttactctgtctccatttttgtgaaaacaattagaaaaaaagtcagtgtgagcctagaaacaagcctccctgaagtgggcactggaccacctgggggcgctcaggacccactgagcacaagagccagccccagggcaggtgcagaggggtgttaaggtctggtttcctgtcagccctgtggcttcctctccataaaacagtttcctttgtggcacatctctggattccttatcctttttttcctgtgaagtctgaagaagaaacatttgtcgtaacaagagaaaaactttctcatatgcaccaaaggcagagtcacctacagtcatttactcctgtttctgaatgtcaataaggtgtcaatgcttctgaagttaatcagctaaatctataaaaggtgcggtgtttaactcagcatggcagcccagctcaacagaactccaagggccagtgagcaagcaggcaggataaagtgcatgctgggcattggggcagagggagttagcatccagtgcaagagaagaaagcccccgtggtggtcattgtcaggactccaagcccacagttccaattgtaggtgatactgggcaaaggaagagagaccccaccaatggttagtgtggatttcgagtctgatggttccacactcacactccaggtgaatatgaaaacatttattaactctatttttgaggtgtctgctgagagcagcacaggcctctcaagaaatttcaaactggaatttcctcagtagacaggaaaggaggctggctcagggctttataatgatttggtggtggggttgggggtgcgtttctactcaggagaaggagattgtgtgatttaaacctcacaggggcatcagataagggagcttctgtgatttcttactagatttaccacatgcaggggataaggaggaggaagaataaaccttaattcgtcagcaacgaggcaccaaaaataggacctgacgctttattctccctagcagcttaagaaaatgagtgaaaaagagagagaagagtccactatgtgtgaaaagcaaacaggtctaaagaaaataaaaattttattactgtaagcacataataaaaagaaagagaagaatgaatgagacaggcaggggtgctgaatcaatgtcctgagtggggccttttcattatccacagttatcagttaattctgaaggtctcaggtcagcttcctgcttcaaaatatcacaggcccttacagtatatgtgaaaatcctcggtttgtcgttcttcactaaagtagccttataattagatgtacttctgaatttaatcttcagttgtgttaaataaaaaaaaacacaatctacaatttaggaaagtgagagtttatttttatcaaggtttacagccatcccatatgctggaaagcatagcttttggtaaagacgagagaaaggcactcccaggaagaaggggttgggcagaagctttatgctgaagggtttggctaaacagacataatcaacaggttacaggaggggctactgatgttcatggaggtggtcctcacacatgcatactgaacaaacatgtctgtaacgtatgacccctgttcacttaccagtggagacttagcatttaaattcattacagtcaggccctatgtgccaatagcagaagcagaaacacaaaggcactcagggtgcagcctctgtaaacggccagagccaggccatggtgagtggtctctgatcaggagaaaggtcctgatatcactctagtgttcaatcaaagctggggttatggcttgtggaacaggggtcagttcatcaggggatgggctgcaattgtcttcatagtgcttgtctcagtgccggtgcttactgagccgctagagaaaacgaataacctattggcagttagaagacagtttaccttttaagtgtgggagtgagtggcagaacccttgcctgacatggctttaggtcttgtttataatttgacatcttattgccacagagattctgttctgtcattcttttggatctctattttaacattagtgttggtcattgttgtgtctaaaccgcaaaggggagtgagtgtaagaggcgcgtctgatcttgtcatggctgggatctcagtttttaggcttttctggagtcccttagatgaacagatggactatttagtcagttggggcacttaggattttatttttgttttacagttcataaatatgaaccctagtattgacattgtgcatattcactgctgtgttgtggttaaaattacctggtaagattcccttcaaagccgttcaagagcaatatcctaccctgatgtttcttccagtaaataccattccctgttttaatgtcattagaggctattgaaaagatgtaggaaaatgatagcttaatctgtcgatgactggagtgggtaagatacagtcatcactttcaatgctttgtcatgcgtgcatgtaataggaagaggtgagctctgggggaaaatctctaaatgtatgggccttccagccaccaaatcataaggtgatgactgatgtctcactgagggacttgactataatgctctagtgctagggagagaaactttggccaaggaagttcaagattttcttaaggtttggacaagtttagttcaagtatgacaattttcttcaacattttcagaagattgtggatgggaatgatgctgagttatataagtaattctaatgccttctgtgtttagataatattataaacaagactgtttgggtataatgacccactacaatatatatacttttagttgttacaccatttcattttcctttaggattttactttctaagttacatgaatcaggtccctaaaatataggcgtgcatctaaaatttattctttggtgagaatttttacgtgttccagaagatatgagaaacttctttgcgtgaagagcatcccaaagtcaggcactcctgtaaaacatgtacttaatccttgtctttggcttattgatgagctctgttgaccacaataaaacttctgtcatgcgggctgacttgacatcaggtagaggaacagattctgaatgtactactgaattgagtgcataacctccagtttcgttactgatgtatgattcatcagagatgatactagatcaaggatttcaatcggaatctaatctaaaagatgtgaataaactttcctaatttagatagtattacttgtgagcacactgctagtattccagccatgtctcctgtctgtcacactgaattcacgctaactttgatctaaaagttaacacttgttctaatgttcaaatatgttatttttattctaatgtctctagattattatctgtggctattttaggcaagagtgaaggaaagcaaggttaactgactaaaaatgagaaaaagcacaacctaatgtaatggaagtcaggacatcagcatctccaggcttgtctatttctagagttcatgcaaccaggggatttcttttctcatttttacacaaagaaacacccaaattgtccatttcatctcccattgactcttatcatctgtctctgtcagtttgcttagaattttggcctccagcttaatccaagttgctgcaaaaacatgatttcattcatttttacagctgcatggtattccactgtgtataagtaccacgttttcttttttcagtctgtaactgatcggcatttagtttcattatatgtctttggtactgtgaatagcacagtgatacacacgtgagttgatgtgtctttttgttccaatgattggttttctcttggacatatacccagcaatgagattgctgaggggaatggtagctctgttttaaattctttgagaaatctccagattgatttcatcagtctcttgggccaaattatatttccaccaaaagtgtgtaagtggtccgttatctctatagccttgcctgcatctgttaatttctgatctttcagtgatagcaattctgacatatgtgagaaagtatatcatttggttttgattcgcacttatctgatgactgaatatgctgagcatttttataggttagttggccacttctatgtgtgtatttgagaagtttctgtgcatgtcctttctccatttctaatggggttatttggtttatgctggtgattaagttccctatgaattaccaccttacacacactaagataatcagcattcaaaaaagaaaaatgaatagaaaaacataaccacttgtaggtatagacatactgaatttggaatggtcatggcttgcatgttggtattgaaatgggacagcaactttggaaaatggtcttcacagaaaacctcataaatgtagctagtgtcaccactcacagaagtagatggagaatacaactcaagtgtccatcgactgccagagggatgaagacgccgcggtgcgtctgtaacccacagggatgaagacgccgcggtgcgtctgtgcatctgtaacccacagggatgaagacgccgcggtgcgtctgtaacccacagggatgaagacgccgcggtgcgtctgtaacccacagggatgaagacgctgtggtgctttaaaaaggagtgaagcactgacataggctgcaactcggatgggccttgtaaacattgggtgagtgaactgagggagacacggaagtctacatcctgaattgtcctattgacatgaagtatgcagaggaggaaaatccctagagacagatcacagggggtgagtggaggggaaatggagagtgacgcttaatggagctgaggttttcttttctgtgatgaaaatgttcccaaaccaaatactggtgatatttgcacaacattgcaaatgtgtaaagtatcactgacccgtacacttaatcgtggctaaaattgtaaattttatgtcatgtgtatctcaacacaatagaaatgagcaccacattttgtttagtgactcaacaacaataacatttaggtttaaattctggattccccaacagaaccagtgcttcctgctggagctggatccatcagcccccagggaagggatggagtgggtcaggtgcacaggtcatgaagggagcacaaattctaacccactcctcaagagtccagtcaccacctccagatctatgtccaaaaacagctcttcgtatggctgagtgacattagcaacaagcacacagccatgtttgtttttttgttttgttttggtgtgtgtgtgtgtgtttttgatagagtcttgtgtcacccaggctggagtgcagtggggcaatcaatcttggctcactacgagctccacctcctgggttcaagtgattctccagcctcagcctccaagtagcttggactgcaggcactcaccaccacacctggctaatttttgtatttttagtagagacagggtttcactatgttggccaggctggtcttgaactcctgaccttctgatccacccgactcggcctccaaaagtgctgggattacaggtataagccactgtgcccagccacaaacaagtatttttaagcaaaagacacagtgaagagacttcagtatgagcccacacacaaaccttcctgtgggagtttacagaacagcagtgggtgctgaggacagaagccagcacccaggaaccagcagggaaacccagggggcatttggcaccgcctgaaggctcaggaccattgtggggctcagtggtcaggcaggctcaaggttcagcctcagagcaggtgtagcaggcggcgaaaggctctgaagacggagtttagtgtcaccttctcatttccactactaaacaccctccagcacatctattctaatgtgtatgggtgttcatgtgtttagagaatattatttatgttatgaatctatagccatcttgtgggtgcatcaagttaacctcttcaacctatgtggaccctgttcattaggaataagtccctgtatttgaggacctcacaaattaataattatgtagaatcactttctttttcagtctcctttccttcctctttctttctttctcactcacacactgacaaacacacggggtgccataacattaattacctgatgtattaaagaatattgattcatttgcaacttgaccagtttagctgttgttcatgttgttgtaagatcaggaacatgtttctcagctgtgtactcctctaagctgagcagcagctttatttgaaatacacagaaactgaaaacaatccaaatattaatcagcaccttcataagtaaacaaattgtggaaaagtcgtttattgggatagtacccactactacaatcagtaaatgttggatacgatcaacagcatggttcaattcacaagtacatatgatgagtatagtgagccaaagcacatacatatgattccgttttataaactgtacaaagtgaatactcattggaaattacataacaaagatcactaactgacttctccatagtaagagaagcgaaggtataggagggagaaattgtgagagacaaagagaaaattgagaggcgaattgatttgttttctctgtgaatggtcattaggtcaatgtttgtcaaatggtgaacatattgtgtgaagattatatgtctgtattacttcattaaagctattataaataaaagtctaatgtggtagaaaaagatgaagagagaaataaaaataatacaagaaaagtcatgaactcctgaatgaattaacccttagtttttctctattacttataaaaacaccaagatacagccaaataatatcacgatatcattataagaagagtgttttgtaaacctcactgggaatttatagctctttcctagagttaattttgggaacagttggatccaattgtgagaaatgcaggctggacactgagactggctcttatgagatgtgagctcttgtctatgtcacatggtccttccatacttgggggtttacattcacatctgtaaatgaaggaaacattgactctcaaagaacatatttcatgtgcatgtaaaagtatgaatgctagtgagaattaattacttatgaagtataatcacccacatccactcttggacacagcccactctgaggcatctgttacagaactcattatatagtaggagacatgcaaatagggtcctccctctgctgatgaaaaccagcccagccctgaccctgcagctctgggagaggagccccagccctgagattcccaggtgtttccattcggtgatcagcactgaacacagagaacgcaccatggagtttggactgagctgggttttccttgttgctattttaaaaggtgattcatggataaatagagatgttgagtgtgagtgaacatgagtgagagaaacagtggatatgtgtggcagtgtctgaccagggtgtctctgtgtttgcaggtgtccagtgtgaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagatacacagtgaggggaagtcagcgagagcccagacaaaaacctcgctgcaggaagacaggaggggcctgggctgcagaggccactcaagacacactgagcatagggttaactctgggacaagttgctcaggaaggttaagagctggtttcctttcagagtcttcacaatttctccatctaacagtttccccaggaaccctgtctagatctgtgatctggatctgctgaaactgcctgtgtcaccttcctcacctgtgactattgggggagctgattgtggacactccagtgtgtgggatttcttggtgacagcaattgtgtcttctgtctagccatgtctagggctgcccatcaggaaggtcaggctggaatttttggaaagaggcgcacctgccatccaccaggaaattttgttgtcttttgttctgctagaactaaatcagacacaccaaggttaactagcactatcttcctagcttgagaaacttgatggcaggcttgaataacacctgtatgaagccatcagagcaacaactagattaatgtctgctagaattaaatcaggcacaccaaggttaactagcactatcttcctagctcgagaaacttgatagcaggcttgaataacacttgtatgaaaccatcagagcaacacctagaatagtgtctgatttaataattgagactatggtctagccaaggagacacataaaacatgatttccatggttggttcatattttatatttattaatagaatctggctggtattataaacagctttgccaaaatatatgtgttagtgttggtcttcggagaagcaaactctgtgactggattagcttcgtgtacagtttccttcgtgtacagtttccctgtccactcttctgagaggaaatgcagaggtggtggaaggggtctggggtagctgaatgcatatgagggaagtcggtccctgagtgaaggagaaagggaggaggactgggtggaactttcctaaacttctttgttgttctatgaaggtccagcaaggtcactgaatcagagtcgtgtcacagttcccatcagggacccagtgactcccagcagtggctctgctcagatcagcgcagagcttgttcgtctcctgagagtggagcacaggacgtggctccaacaccagccatggcatggaagacagagagcagccctgggtgcctgggtcaggtgcattgtgctccctgcaggtggagggagggaagtgctgactcagggcccagagactgtgggttctatacagaacatacacttttacttcatttctgtggatgacatagaaacaaacatgcagtctgtaaacaatggtgattcctacatttgccccaattgctttattccttaattctgcagaatgtcctggcacagaattgcctttctcatgtggaattgtgtcgtgtgttgtggatgtgtgagccctactttcattgttttcccccatgtacagagctcctaaatagagaacagctgaccctccttctacactgttgctctcctccccacagagagagcacataattacctgaggctgaatctgaggtgggatctgtcctctgaacctcagagcctgcagagacccccagctgcagattcatggagtcaggtgtttgtacatgtgggaaccttgagctgttcttttgtcagtgaacactccttaaaactaattgtgggttcagaattaggacacccattgatctatcacacctcagctcattctgccactcagaatctccagaaattcaggaaatggttgaatgtacatttttgtgacaaatttttctcatttcacttagttgtgagtttggttagcagaaagtgctaccatttatgggtcccaaactgatgaagctcatttgcttcaacagaagttaggaggctcctaaaacttctcatcagcccttctctctgcacttcatgtgaaattcagttttacctggaattctggtgtgttggtttagccagagttccccatcctccatgtctgattttcctgggtatctgatcagtttccttgcccttcaccatacctcggtgacgtctaatcaccctggcccaacatcaagaattctggcaggttggtttaagcaagatttgctgtgcccctgatgtttcctctcagtaattttccatcttccggaccccaccctgctgcttggctttaaatcccccatgtttccattctgcatttggagttcagctgaatctctctcctcactgcaaaacaccattgccctgatcccgacacctaccatgaggaccctggataaagtcttccttactgtgctggaacaagtgtctttacttgatattttttctttaataaatctacctttagtgcttcctaaattgctcaaggaacctcgaaaaataagataagtgcgattatccattttactgtgtgtgtatgtgtgaatttcaatttccatgtgtggtgtccagaagtcctgagcacaaacagttttgcttctctgtccaattctttgcttctgaaagccaggagtcatcccaacattggtaaattggcgatttgtttttactatttagtgactgacatatttcacttaacctgaagcttcatgaacacattgatgaaaagtagatagaagacttgtttggaaatgccagatttagggtagactttaccacccacgtgtgtctggagatctccttaggattccaagaacagggtggtttttttccaccacaggacaaggatgagaacctccaagctgtgatgataaaggacaggcagggccatgtgtggacaaggatgggctgctgccacgtccagagtgttctctcctagcaacgccgccatctccttcctcacactgtggtatttgtcagatgggaaacatgcctagaatttatctttgacatatggatggaagcccaggctagaggcatttgacagcttatttctgaacctacttctttaaggaatgcccagatcccttgctctgcttcctggttcttaacccctttagctcccttccgctcctgcacccatgcactgcctctttacggccacttccccacacccttcactgtagcaccattttcttgggctccttggaaatatcacagctttggtttaactcacagatcaggcacactcatgggcccctccagaggttctcgatttccctccctcaggctcctccctggggtcctaacttggccatctctatcctctcttctgagcctggccatccacaatccatcccatctggacttgtgtatagcactgggttaactcagcaggtatgaattgttcaaaccctgcacattcctaaaaaataactaaaaaaaaaaaaacttttgttcatttattgctgttacctactgtgatgagatctccgagtccataaaatattgcacctgataacagtgtctgtggatgtctgtagccttgggacatgcggtacaagtttaatcagtgatttatagtgaatgtctacttttgttttgctggagagggctgtcgtctgagtattgtggtcagttccccaggtgttccatagtctatgattcattccccaaacacagccctggacaagagagctcagcggcactccccttgttgtcaacacttcacacaagccatcttacctcacagctgaacaattacacatgtgtagaaggctccactgtgagaggacacctgagagcttgtgcctggattctccagggcttcactccttgtgccttttgtctttacttattttaaattgtatcatttttctgtaataaactgttcctgtgaatagaacagttatgagtcctgtgtttttactgatttttcagcctacaggtggcagatgagaactctcaacacagttgtgttagaagaaggatttcctagagagaccctgactcaatgatgatacatggctgaagcattgcatggaaaacgtaagtgttcaggtatggaatggcaaaatttgatacctggggagtgacagaatactacagtctattacagcagctgagctgaaatcggtttctggaggtaaatgggatttagaaattataaatccaactcccaaggagctggctcaatcaatacataatgaaatgtgaaatgattagaaatagcctaaatatgcaatttccatctgtgagagctaagtgaaaatccaggagagagttggcagggagagggatactgcaccaacctcagattttgaccattttcatttagggctgatgggctcatgaccactagagttagcaattacactgtgataaaagataaaagcttcacaaactctacccacccagaagggggctcaggtggtgaaatagggagggtaaggcatgaaacgactgaaatatgggaggatagtgagatgggttctctctttttgagttttatcttttgcttctttactaatttttgttaatctggatttggagaatgactagtgtaaaagtggattctgttttgagtcccttagaatggaggagaatgtgtgggccaatgttgtgcccagagactactacagaacaatagtagatgaatgtacatgacccaaacacaaagctttgtggttgctgatgggagagctgcactgccctggcctactggataacagcttctccaaagtgtatttaccctgacaatggagattgcctttctcttttaagtgaaaaaaatggaacactacaataaagtagtggtaatgctgtgtgtgtatgtataagacattctggagtgggtttgtgataattgggatatgtatcacttatccttttatttgtataaatttatggggtgaaagtgccgttttgttacatggatatattgttgagggataaaatctgggctttgagtatagccatcatctggatggtgtatattgtacccattaagtaacttctcatcccacatgccactcccaccctcccaaccttccaagtctccaatatttcttattccacactctgtatccatgtgtacatattatttagctctcacttatatatgacatgtggtattcaactttattcttctgagttctttaacttaagatagtggcctacagtttcatccatgctactggaaaatacataatttcattccttgtctattattgagtagtaattaaatgtgtatatgtacatacacatgtatagtgtgtgtatgtgtggggatgtgtgtgtacatatatgtatatgtatgaacatatacgactgtttcctttatctaatcatttactaatagaaacttagtttggtaccatgtatttgctattgtgaatagagcagcaataaacatataaatgcaggcatctatctgatataataatttatcttcccttgggtagatacccagtagtgggactgctgaatgaaatattagttccaatattaattatttgcaaaatctccatactgttttccatagagcttatagtaatttacatttccactagcagtgtataagcactcctgcttctctgcatccttactagcatctgttttttgttttgttccatttttctttttgactgttttaatagtagcttttctgactggtataagatggtatctcactgtgtctttaaattgcatttttctgatgattaatgtcattgattattttttcatatgctggttgatgatttttttgtcttttgaaaaataaacattgtagtaatttgctcatttttaatgtggttatttgtgggtttttgtgttgcttttgtttcttgtagtttgtaaatattagctctttgtcagatacagagtttaaaaatagtttatcccattctgtacgctttcggttaagttttttgattatttgttttgctgttcagatgctttgcttcttatttgtattaagtccaaatggtctatttcggtttttattgtttacttttaaggttgtagtcatgaattctttgcctaggacaatctccagaacaatatttcctagaatagcatctgcaactttcagactctcaggtctcccagttaagtcttttatccatattggcttaattttggatatagtgagagatacgggtccagttttattctgctgcaaatggctgttcagtttttcctgcacaatttatataacaaggtgacctgttcccagtgtatgcttcttgtctagtttttcacagtcagtttggctgcaggcatttgactttatttatgaaatgtctattctgttccactcatctatggctttctgctagattgttacttgattgttacttgtgtataataatgctactggtttttgtatgcttttttcatttattctaaaactttactgaattaactcatcaattctaggagtattttgaaagaatattagtttttttaagtacaaaatcatattatcagcaaacacaaagagtttgacttcctcttttccaatttgagtgcctttatttctttctcttgcctaatttctctggctaggatttcaagttccatattgattaagagtggtgaaagtgggcatccttgacgtgttctgagtcttaggaggaatactttcaacatattcctattcagtataatgttgtttcggagtttgaaggtgatttatggagaatgagagatgttgagtgcgagtggacatgagtgagagaaacagtagatatgtgtggccgtttctgaccagggtgtctctgtgtttgcaggcgtccagcgtgaggcgcagctggtggagtctgggggaggcttggtacagcctgggtgggtccccgagactctcatttgcagcttctagattcaccttcagtgacttctgaatgcactggatccgccaggcttctgggaaagggctggagtgggttggccgtattagaaccaaacgtaacagttacacgacagaatgcgctgcatctgtgaaaggcaggttcaccatctcaagagatgattcaaagaacacactgtatctgcaagtgaataccctgaaaaccgagtacacggccatctattactgtactagagacagtgagggggaggttaacgtaggcccatacacaaatctccctgcaggggcgcgcagggccaactgggggcgctcgggacccactgaggatgggacaggtcccaggggcgggtgcagggggaggtttcctttctcagctgcaggaggcgggtttgtttttgcaggaatatggagtcttatgaggttttgatattttactatggttatttatcatgattttttaaaattgggatttgtgttttagtaatttttaaatttatatgtaggggtatttttaaaaattaagttttagggtacatgtgcacaacgtgcaggtttgttacatatgtatacatgtgccatgttggtgtgctgcacccattaactcgtcacttaacattaggtatatctcctaatgctatccctcccccctccccccacctcacaacaggccccggtgtgtgttccccttcctgtgtccatgtgttctcattgttcaattcccacctatgagtgagagcatgcggtgtttagttttttgtgattgcaatagtttgctgagaatgatggtttccagcttcatccatgtccctacaaaggacatgaacttatcattttttatggctgcatagtattccatggtgtatatgtgccacattttcttagtccagtctatcattgttggacatttgggttggttccaagtttttgctattgtgaatagtgccacaataaacatatgtgtgcatgtgtctttatagcagcatgatttataatcctttgggtatatacccagtaatgggattgctgggtcaaatggttatttctagttcaagatccctgtggaatcgccacactgacttccacaatggttgaactagtttatagtcccaccaacagtgtaaaagtgttccctatttctccacatcctctccagcacctgttgtttcctgaccttttaatgattgccattctaactggtgtgagatggtatctcattgtggttttgatttgcatttctctgtaccctaaaacttaaagaataaaaaaaatccttcaaaaataattcttcctaataatatgcacttattctcctaggttgtattaacatctgttgatatcttcaactacatagctatggcgacattaatttacatctgtagacatatgtgtaaatacacaaacttatgcatacatgtctagtcttttatatttaatataataaaatcattataaaatatgtcctaatgaatgaaacttaatgattaactaaatataaattatagtaatccattattcattgcaatgattctctatagtttacataaattggtatctatttgtaagcttaaatatagtgtattggtcattttaaaatggccaagaacaaatttcaaatgtccctgtcacacaaacacacacaataaggatttgaggatttgagttgatatatatgtcaattagctagattcagttattccatattgcattcataaatcataacatagctttgcactctataaatacatagtcaaaatttctcaattttcaatgaaattttaattatacattttttaatccgtcctaggtcatgatttttttctccctgtcaggatatgattagattgtcctgagaaactcattcagcctcctgcctcctgaaggcttcaaaggcttcaggaagtaagctcctggatgggcagaagcaggcaaatctttcatgtgcacaggacctggagcatctctctttggattaagccccctcctcaggattacagggctcttcatttttctcaacaggctgttgtaccagataagcacaaaaacttaatttcattatgctttgctttttttaaaaaaaaaaaatgaaggtaataattttaacaataaacatattacaacctgctacacatgagacccttcttgtgcttcgacctttcttctcaggagtttatatgtattacatatattcagtttttttctgagttggaatgcttattacagattattccccttattacagattactcttttaatttatctcttagaatgatttttcgagagcccctgcctgcccgcgcctggtggaatggagcagagcctgggctgagccaggcgcgcaggggcctccgcacgtgccgcgccggtagcagacgccaagcgggcggacagtgagcgtgagaggccggctcggagtggccgccggagcagtgccggggatggaagaacagcccatcttcaccaccggagcacaggtcttccagattgaccccaacaccaaaaagcactggatgcctgcgagcaacaggcggccaccgtttcttacttctatgatgtcacaaggaacatctatgggatcgtcagtgtggacggagccaaggtgaccataaacagcacaatcacaccgaatatgaccttcaccaatgtgtcacagacgtctgggcagtgggccgacagcagagccaacacggtgtttggtttggggttttcctctgagcagcagctgacaaagttttcagagaaattccaggaggtggaggaagcggccaagacagccaaagacaagacccaggagaacatggagccctcgagtaataatcccgagaatccgggcatggagccccatcttctactccggcatccagtgtcaacgggacggacgatgaaaggcctctcaggccgctgcagctgacacgcacctgcagtctgggaaccacaagctgaaggcggcctcgacgcaaagagctgcccacgggaagaggtgggagatggagctgcagacccggcgggagagcgacgcccggctgcccacggcgctgcaggagtcggtggccagcgtggagcagaggaagaggccgtgagatccacagagaggagaagaacacgcagctgaagaggaagatagaggagctggaggcggagctccgagaaaacgagaaagagtggaagtccccaaaagcaaagtaaaactactcctcagctcaggtgagtgcaactgtgtctctgagaagatggaggcggcagagagaggatcaaaccctggaagacaaagtgcgttccctgaagagagacactgaggagagcaaatccagacagcgccacctgggggtggaggtgaagagtttcccggaggtgctggaccggaagatccacaacctgcctgacttccgcccaggccttgcatactgtgcaccaataactagggctggccgaggcccaggcccctcctgtgagtcccaagcgtgtgtgcgagaccagatggcgctaggacgttccctgtgtgcgttgcttctgtaaatgcaggcgcagtttcttgtatttccaaaccaactgtgccgtctactcaccccttcccagaatagaaatctcttgtccaggcacagtgtctcacgcctgtaatcccagcactttgggaggtcgaagcgcgggaggatcacgaggtcaggagaccgagagcatcttggccaacatggtgaaaccctccctgtctgtactaaaaaaccaaaaattagccaggcttggtggcaagcacctgtagtcccacctacttgggaggctggtgcaggggaatcgcttgaaccaggagagagagtttgctgtgagccgagatcgcaccactgtcctccagcctgggcaacagagcgagactccatctccaaaaaaaaaaaaaaaaaaggaaaagaaaatttcctctcgcttctctggccttgtgaggttgtggacaactggaagattttgactcaggaatccagaactaggtctaccttcaacatttacacagtcaggccagggatgtttatatttttcataagggctgttgaaaccatatgaactgaaaaaaagcactttctaatccaaatattgatattctttacaccaggtcatcgggctccttttatcgaatagcattcagggtatttgaatgtccatcaggcgccaggcccagggggcacagggagaacaacattcctctccgtcaataacgagaggctttaaaacaactgtttagtggagacttatcgagatgccaaacaggtttctggtgggtacattttctggcctggggatcacctgcatccacgatattgccctctgccccccagtttgtatggttgcgacaatgttccttttcttggttttaatttctgagcggatgattgtggtgcgggaacagcacacagtgagggtgcctagcacaatgcctggtgcaaagtaggttttttataaacgtttgtgcggctcacacctgtaatcccagcaatttgggaggctgaagcaggcggatcacctggggtcgggagttcgagaccagcctgaccaacatggagaaacctcatctttactaaaaatatgaaaaaaaaaatagccgggagtggtgcatgcctttaatctcagctactcgggaggctgaggcaggagaatcacttgataccgggaggcagaggttgcagtgagtggagatcgtgccattgcactccagcctgggcaacaaaagtgaaattccgtctcaaaaaaatttttttctaaagccccactcaaaaccagggtattattagcagtgtaatagttgggccacagttgaaaatacattcaattcagttcatgtgctctcaaatatcctttttccttttaaagttgttctcagttgtaatattactcaaaatattagtaatttatactaatgacacaggttacaatattgtatacataatttagtgacatttgattggaaaaaatacatgttccccatgtcttgagtattttttccttctctataaaatgtatgcttataattatttaagtttcagatgctagcattatctttttgatatctgggatttaattttagtaggtatactggaatgccttttattaattcatataataatgttcatattttagataggattttaatattaattttactatttactgaatttcaaacttttctactttttttgtttttatgagataaaattcacacataagaaaaaatgcatagatctgaaatgtgtcactagagagtttctggcaaatgtgaatacctttgtccccagcacctaaggtagcctgaagagcaagtctctccccaaaacatgcgtctttttctatgcctgtggtcaaatcctgcatggggaaaggtttcgatttctgacactatagatgtattttattctgctttgaactttatataaatggaatcaaacattatagactttttttggtaaggggctacttttctatttttgaggttaattcatgctagctaatgtataaaattagatcaacatattgtcgtttattcaattcatagacagactgtgatatgaaccaccaaaattttcatgtacatggagagagagagagagaaagagaggaagcagagatattttatatctgagtcagtccattaagtaaataaatgacaatattttcatttatttttatgtcagtggactttaaatttgtgtccagtttatgaatattatatgcagagctgttacaaatatcttagtgtaagttttctgatgttctatttttattgagaaaatatgaagtatgtatttctttattctaagagtaagtttaatttttttcagtggtattgaggcataattgaaatatttttataatatatatgtttaaggtgcaccaattgatgttttgatattgtattagtccattctaacactgctataaagaaatgcctgaggctgaggtgggcggatcacgaggtcaggagatcgagaccatcctggctaacacggtgaaaccccgtctctactaaaaaaaccaaaagttaactgggcgtggtggcaggtgcctgtagtcccagtactccggaggctgaggcaggagaatggcgtgaacctgggaggtggagctttcagtgagctgagattgcaccactgcactccactccagcctgggcgacagagcgaaactctgtcaaaaaaaaaaaaaaaaaaaaaaaaaaaaaaaaaaaaaaaaaaaaagcttgacactgagtaatttggaaaaaaaaaaagatgtaagatgtttaattgacttgtgagaactcaactcatgcattgtcatgaaaacagcaccaggagtcagttctaaaccattcatgaaggacccacgccatgacccagtcacctccaaccaggtcacacttccacaattgaggattataatacgacgtgagatttggggtaggacacagatccaaagcatatcagatatacattgtaaaatgctcatcatagtcaaggtaatttgcatatccatcttctcacagagctaccgtttaattttttttaaatgtagagcttgtgtgtgtatgtgtgtctgataacaacacctaagacctactcttagcaaaaatcacttttacaatatagtattaaatacaggaacattgctgtgcattagatctccagaaatgattcagcttgcacaactgaaactctgtgccctttgaccgatatcacccaatttccctctcctcccaggtcgtgggacccagtactctactcgctgctatcaagaacttggatattttagatcctacatgcagatgacatcgtgaagcatttgtctttcggcatctggcttattccacttagcaccatgtcctctagctccatccgtgttgttgcaaatgtcagaatttcctttttttttttgaaagccaaatgaaattcagtttatatatatacattttctttatacagtcatcaatctatggtcattaaattctttcacaaatctacactattataaataatcttgcaattaacatgtatttgacatcataattttatttcctttgacgatataacaagaagtgggatcaccaggtcatatgatagctttatttttcaatttattgactaaccaatcttaccatacgatataaggataccctcttcaccacattcttgccaacatttgttatcttttgtcttgctgataataaccattttaagtggtgtgaggtgatatctcattgggctttttatttgaattcccctgataattaggaatgttgagtacctttttaggatctgtttttcatctgtgggtcttctgaaaaaaaatctaaccaggtttttgccctctgtattaggtcagttgatatttgctgttgagttgtatggttaatttatatatttgggtggaacttcttgttagatatataattgcacatagttttttttactgtgcttgcttttggtattaaattcaaataatttctgaatcaatgacgaatatttttccatgttgtctatgatttatggtttcaggttatgttcatttttagttgatttttgtatatggtgttagagaaggtctagtttcatttcattttttttttgcacatgcatgaccattttctacaccattgattgaggagactgtcctttcttcactgtgtgttcttggcatacaaaattaggaagacacataattaaaaaagaaaacatcagatgaatattcctggtgaacatagacctaaaagttctgagcaaaatactagcaaatagaatccagaagcactttaaaatgtgatacatcatgatcaagtaggctttacccctggaaggcaagtttcattcaacatccaaaaatcagtaactgattcactatgtaagcaaaataaaagcgaaaaacatagattatctcaatagatgctgagaaagcttttaatagcatccaacatccactcataataaaaaccctcaacagactaggcatcagaaaaatatacctcgaaattataagagctatctatgacaaaccacagtcaacatcatactgaataagcaaaagttcaaaccccttgagaattgaaaaaagacaaggatgccgtctcaccactcctattgaacatagtattagaaatcctagtccgaggaaccaggcaataacaaaaataaaaggcagctgatatggtttggatttgtgtccccacccaaatagcatgtcgaattgtaaccaccaatgttggaggtggcgtctggtgaaggatgattagatcatggggatgtgttttcctctctcatgctgttctcctgacagagctctcaggagatctggtttcaaagtgtgtggtacctctcccttatctcttcctcctgctgcagccatgtaagacatgatgtttcccattctgtcatgattgtcaggttccccaggcctccccagccatgcttcctgtacagcctgcagaaccatgaattaaattaaattaaagaattaaatatctttataaattactcactcctgtgtgtttctttgtagtgtgagaatggactaatgcagcatccaaatgggaaaagaatgcaatgtatctgtccaaactgatgataaaattctatacctataaaattctaaagactctgacaaaataattcaagagagataaacaactttggtaaagtctcaggatacaaaaatcaatgtacaaaagtctccagcatttctatatcccaaccacatccaagctgagagtgaaatcaagaacacaatcctgtcccacttacaatgctcacaaaaaatgaagtgcctgaaaatacaggtaaaaaacaaggtgaaagaactgtataaggagaactaccaaacacagcagaaagaaatcacaaatgacagaaataaatgtgaaaacatttcatactcatggattggaagaattgatattgtaaaaattgtcatactgcccaaagcaatttacagattcaatgctatttacataaaactctcaccagcattcttcagataaatagaaaaaaaattctaaaatttatatggaataaaaaaaagaccctgaatagccacagcaatcctaagcaaaaagaacaatgccagaggcatcatggtactgaatttaaactacaccataaagtcatggtaacaaaaacagcttggtactggtaaaagggcagacatgcagaaaaagtggaacaaaagagaaagcagaaataaagctgcatgcttgcaaccatctgatatttgataaggctgacaaaacaagcaatggggaaaaaactctattcaataaatggattctggcagatatgcagaatgcaagagtgaaggaggttgggcagcttctacctagatttcagaagatgtgcatggagaaccctatatgccaaggaagaagcctgctgcaggagtggagccaccacagacagtgtctattaggacaataccaaagatggggaaagatggggtcggaacccccattcagagtccccactagggcacttcatagtaaagctgtgggaatgtggccacaaccctcaagatcccagaatggtagagtcaaaggcagcttgtcctctcagcctggaaaaccttctggcacttgactctaacctgtgaaagcagcaccatgggctgtgcccagctacagggatgatattcctgaggtttttgggaccccctttgtcctagtgtgccctggtggaagtacataaagtcaagagagactattttgtagctttaagatttaatatctgccttactaggctttaggtgtgtctagagcatgttggcagttcctttggccaatttattccttttgtattgacaatatttacccaattcctgtggcactattgcaccttggaagtaaacaactgtttaaaactttttttttttttttttgagacggagtcttgctctgtcgcccaggctggagtgcagtggcgcgatctcggctcaccgcaacccctgtctcctggcttcactgcctcagcctcccgagtagctgggattacaggcgctcatcaccacgcccgactaatttttgtatttttagtagagacagggtttcactgtattagccaggatggtcttgatctcctgacttcgtgatccacccgcctcggcctcccaaagtgctgggattacaggcgtgagctgccacgcccagcctgtttaaaacattttgcaagctcatagctgcagagaaattgccttaagactcagaggagactttggtattttcagtcggaggttgaccaagtgaagagtttggtcactattaaaaaaactattaaaaaaaagatgactttgcaatctaagaaggacatgagatcaggacacaagagtaaaatggtatagtttagatgatggtccctgctaaatctcaaggtgaaatgtgattcacagcatttgcggtggggccgactgggaggttttgagacatggggaaagatccttcaggaatggcttggtatccaccccatggtaattagtgaattatttctgtattatctactgtgagatctgattttcaaaataatctagcaaccatcctcccctttcatgtcctccctctcaccatgtaacacagcctgtttcccctttgccttccaccatgactgtaagctttctgaggccatcacatgatgcagatgctgatgccatgcttctcacttagcctgcagaactatcagccaaataagccaaatagactagtacactgtccaaagcaatatacagattcaatgcaatttctattaagtaaccaatataattgattacatattttaaaaaaccataaaatttatatggaatcaaaaaagagcttgaacatcaaaagcaaccctaaggaaaagtaacaaagctggaagcaccacattgccggacttcaaattatactacacagatataataagaatgacatcatcgtagtgacaaaaaataaaaattgatgtaacacaacagacagcccagaaataaagccaaatatctacgaccacctgttatttgacaaaactgacaaaaaatatacactggagaaacaaccctttattcaataagtggtgcttggaaaattgggcagccacacaaagaagaataaaaccagacttctatctcacaatagacaaaaattaagtgaatatggattcaacacttaaaaatataaactgaatctacaaaaatacttgaagaaaatgcaaaaaaaaagttctctggacattggcctaggcaaataaaacatgactaagatttcaaaagcaaatgcaatgaaaacacagacaaacaggacttaagtaaaaatcttctgcacagaaaaagaaataatcaacatggtgagtaaacaacctgcaggatggtagaaggtatcatctcacctcagttaacatggctcatattaaacacacacacacacacacacacacacacacaaacaaaacactaaccaatgctcgtaaggatacagagaaaagaaaactcttatgcattgttgaggagaatgtaaactagtacagtcactatggagagcagtgtggaggtacctcaaaaaactacaaatagaactaccgtatgatccagcaattccactactgcaaatttatccaaaggaatgaaaatcattgtatcagagaattctgcaccccagtgtatgtggcaggacctttcacaatagccaagatatggaatcaacacaggtgttgaacacaagagaataatggttaaagatgatgtggtgcatatacatgacgaagtactcatcagccataagaaatgaaatcatgttatttgtggcaatgaggatggaactggaggacattatgttaaatgaactaagccagggacagaaagtaatacaccttgttttctcactcataggtggatacttaaaaaaaaatggtctcctagaagtaaagaatagaacagaggataccagacgctgggaagggtagggtaaaggacgagataggcagagatttgttaaataatacaaaattagagctagggaggaggaatagattataatgatctttaccactgtaggatgatacggttaacaataatatgtagttttaaatagttagaagaaggatactgagtgttcctaacaaaaagaaatggtttgagatgatggatgtgctaattaccctaatctgacccctatgcattatatgtatcaaaacatcactatgtacctcatgaatagttacaattattgtctattaaaattatattttaaaataacacaaaattcattggcagtgacataaatggaggctctgggataggtgtggggataaagggaggctctgggatacattacaggcctaacatgtcagtgggcagaggagcttccattagctttttctatttgtagcactgagtagatgtgacatttctcaaagtttgccctacaatagagacctgagttccagggaggtcttgcaggcagctgtgcagatggaagaagcaggagtagagggttgctggcccattcaacaatagtaggatgattattgtgcatgtagagaagtcaacattgttttaagtagttgcatcactggatgacatgaaaaacaaatccagtggaaatccttaaatattattggtagtgaaactgttttgggtgaggaaatgttcactgaagttaagtgagccagtaaagctgttaagaactataaaaacattggattggattcagctttgtctgaatttaatgtgattattactggctcaggcaggggtcacaaatcaagatggataggtggtaccaaccagaaaaagccatggaccagaaagattcacagctgaatttattcggatgtataaagaagagttgctaccaatcctagtgaaactattccccaaaaattaggataagggactcctccctaaattattctgtgagaccagcattattctgataacaaaacctggcagagactaaaaaaaaagataactttgggccaatattcatgatgcaaaaatgctcaatgaaatactagcaaactgaccacagcagcacatcaaaaagctaatccaccatgatcaagtagactttgttcctaggatgcaaggttggttcatatacgcaaatcagtaagtgtgattcgtctcataaacagaactaaaaacaaaaccatgctatcaatggacatagaaaaggtattcaatgaaatttaacattgtttcatatccaaaaccctcaactaggcatgaagaaacatacctcaaaataataaccatctatcatgaacccacagccaaaatcatactgaatgggcaaaagctggaagcagttttccctgaaaactggaacaagaaaagcattcccactctaaccactcctgttcatcatagtcatggaggtcccagccagagcgtgcaggcaagagaaagaaaagcatcagaaccggaagagaggatgtcaaaccatctctgtagatgaaatgatcataatcccgagtctgtagtttggtgattgacattaatttggaaaaattgtcagtcatcattgctttaaatatttcttcttaacctttctctgttccttctctttcccatgtaataccctaataattgtctcacaattcttggataagctgttctggtttcttatgggtgtgtatttgtgtacttgtatgtttgtgtgtgtatttgtgtgtttactttttaaaaaaaatatttctccattttcagtttgggacattgctactgagatatttttaatttcagatttttttcctcagccatgctgcgtctacatataagtccattgaaagcattgcttaattctgttacaatattcttgatatctacatttttttgctttttaagagtttgcatatttcgacttgcataacacaactgttcctggatgccctctgcttaactcatcacagcccttagcatatgagttatagcggggtcttaaattccttgtttggtaattccaacttacatgacgtagctgagtctcattctaatgcttgttctgtctcattacactgtgatatttttcttttagtatgtctcgtgatttttttagccagaaattatgtaccaggtaaaagaaactgctgtaaagaggcctttagcgatgtcattgtaagatgtggagagaaatgtgttccataatcctacggccatggcttactctagcaagcttaggcctttgaaaataaacccttacatgaaagtgaaaacataagtcttagatttggagaatttgcttgcaaatcaaatatttggaaaatgacttttatcacaaatgtacaaattaccttacaattgaacaacaacaaaaccacacaaattaattttaaaatgggcaaagatctgaatagaaatcgcatctaaaaataaatataaagagatcaacttcattttcattaggtatatgcatgtttaatattcaaaaaatactactatcttatgaggatgggtaaaatacacaatatagataataccaaatggtgatgaggaagttgaaaaacaggaacattcactctttgctggtggtaatgctgaaatggcacatagacatgtacagttaataatttagtgtatattacaaaacagctagaagagaagatttagaattgttaacacaaagaaataatcaatgatggagatgaaagatataccagttatccagatttaatcactgcatataataatcttttatcaaaatatataccccataaagattttgaactcatgtatctatataaattaggtattaaaaaacagcaatgcaggggaatccagctaattgcacattccctgaatgtaccctttcttgtcaaaaaggagttccagagactcttgaaaacgtagtgcagttcatgtgagaaatagaggttcagaaatgcctcattataccctcctccctttggaattcaagcacaactaaccagtatttttcattaaaacagatcttaagactcagaaaacagattctttgcagcagtaagataccaaattctaacctgactcaagaataggatcacatgacagagagcagaccttgaaaagaatcaaagacttttaccctaaaatatatttatttgacatattttaaaatcaccctgcacagttatcttttgagagagaaatttacgttctgtagcgaatctccttccctttccaggtctagttgttagattagctgagagtctagcatcttttaaatgtcatagtagaaaacatttgctatctactgcctctaacggtggccacataagagaattcatctacataataagaatcttgttctccaaaacccgttatcctaacctatgtagggaaaagagagatcagactgttactctatgtagaaaaggaagacgtaagaaactccattttgatctgtaccctgaagaattgttttgccttgagatgctgttaatctgtaacttttgccccaaccttgtgctcacagaaacatatgttgtatggaatcaaagtttaagggatctagggctgtgcaggatgtgccttgttaacaatatgtttacaggcagtatgcttggtaaaagtcatcaccattctccattcttgattaaccaagggtaacaatgcagtgcagaaagccacagggacctctgcccagggaagccgggtattgtccaacatttctccccactgagacagcctaagatatggcctcgtgggatggaaaagacctgaccgtcccccagcctgacaaccgtgaagggtctatgctgaggaggattagtaaaagaggaaggcctctgtctcctgcatgtccctgggaatggaatgtctcggtataaaacccaattgtacatttgttctattctgagataggagaaaaccaccctgtggctggaggtgagacatgttggcagcaatgctcctctgttactctttactacactgagatgttagggtggagagaagcataaatctggcctatgtgcacatccagcgatagtaccttcccttgaacttatttgtgacacagattcctttgctcacacgttttcttgctgcccttctccccactatcaccctgttctgccacattccccttgctgagatagtgaaaataataatcaataaatactgagggaactcagagaccggtgccggtgtgggtcctccgtatgctgagcaacggtcccctgtgcctactgttctttctctatacttggtctctgtgtcttatttcttttctcagtctctcatcccacctgacgagaaatacccacagttgtggagggggtgggccccttcaaacacagaaacgtttttctactgatttcagctctttaaataaaaagttaagtctttcaatcagaaaatctttgaattcacctgtaagctgtaatcccctccccacactgcctcacttgtagctcttttatctttatgaaacaaatcgacacatgtctcatatgtattgactgatgtctttctctctaagacattaaatttaagctgcaatcaagccactttgggcacacgttctcaagatcttctggggctgtgtcacagggcatggtcctcacatttggctcgaataaatctaaatattttgcaaagttgactttttcattaatagttcttacagaacctactctgtgctctttgttacaagcataaaatcaatatagtattagttataatagtattgggtataccacatattggcaatttcttatgaagttaggcatagactaacaatgggatcaagtgtaaatgttttaatgtatttatgcaagttattttgatatttatgttctgcagatacttctatcagatttattatatcagctaattatttgttttatgattgggtgcattttttatagatgataacaccatatcttttctaggcctttattggagaaaattgtgtgaaactactcaggactacatgtgaaagtccttattggagtggctgacagaattgaagtacatttcctctgtagccaccagacacccagattcctccagtaacaccttaattttgtttcctgcttggctttggtcttcagtcttgtgctatccagagagactctgtcttacaaatcccccaggtcattctaaagccacatggaccggacaattgtcaatgtggtgggaagggtcgcactgaacggtcactctctgtccttctgagggagccatactgcaggcagacatggcagtcctggctcaggttgtgtccttccaagtatccctgccctcctgcaggtgtgatgctgatccatgcatcttcctcccattcctgggtagagggtctccttgttttttcccagatcttcttccagcagccactatgtcttcccactgatgtcttcagcttcctcttttctgcccttcccagcaggatgaggcttttattcctgaagaaagagagaggaggtgggagatgaggctgttattcctgagagaatgaacagggctttggagcttttctttcttctatcccagtttctatgagttcctccagtaccagtaacacaaaggtgttactggctttgcccctgcatgttaattctctagcaatgtagtggtgacagtggaggtgggtctggatgcatttcagctgcagttgctgtttttctttccagcacagaaccaacttgggagctacagggcaagagctttttgtaatgtgtcctcaatcctgggagaaaagttttcaatagcaataggaatctctcagttgtatgttctctgagaatttaaacaataacttatttattatactcaattttaaacaatgtaataaatatgtctaatttaatcttgcattagcttatgtgacatttgctggccattgccccagataaggccattttctcttcctgtttatccctgcaagtgactgacttttgcaagatgtaaggtttcttgtttgccctataacatcaataatctgaaatattaaagaaaatgtgctaatttgcagatcagtaaggttagttgtttctgtaaaaatatatatgtttttttgagatggagtcttgctctgtcaccatgctggagtgcagtcgtgtgaacttggctcactgcaacctccgcccccttggttcaagcgattctcctgcatcagcctccatagtagctgggactacaggagtcttggcctccaaaagtgctgggatttctggcataagccatcacacccagccaaaaataatatattttaaggggtgcatacatctccaggctgagtaggagctttatttgtagtactcagtaactggaattaacacaactattaaggagcattataaataaatagtaagggtgcactcattaactggaatactgttcctcattagaatcaacacatcctttagttcatgtcctttgcagggacatggatgaagctggaaaccatcatagtcagaaaactatcacagggacaggaaaccaaacaccgcatgttctcactcataagtgggatcttaacagtgagaacacatggacacagggaggggaatgtcacacaccagggcctgtcggggtggggagcaaggggagggacagcattaggagaaatacctaatgtagatgacaggttgatgagtgcagcaaaccagcatggcacatgtatatctatgtaacaaacctgcatgttctccacatgcatctcagaacttaaagtataattttaaaaacacattatttatatagaaccaaattactggctcacaagtaattatactgtgcaaaaaaccacacaaatgaaattgagactataagatttcacttgaacaaaatcttgaaaaatagatctaaagtaacaaagatgactgactcaatatggtgagaggaaaatgactgggaggcaggaatgagaggaacacagggaaacttttaagtgtaattcattggtatcttgattgttatttgggatgcacaggtgagcacatgtgtaattacatttttttcctttggagacattttcttgctttgtcatccaggctggagctccgtggtgacatcatagctctctgcagcctcagaccctgggtctccagcaatcctcctccctctgccctatctagctgggactacagctgtgcaccaccatgctcggcttcagtgtgtattcaaccagacactttaattatgcagtatttattacgtggcaataatgcctcaataagggtattgcaaataagtggatggataatttgttcaattaagattgatggaaatatagacacttacatgacaaatgtatgacaatcaagaaaataaaactgtaggaaacatactttactttttgttaggtaatcgcaacagtgcatacacatcacaccatgttctcattacagagaaaaggttctgcaaacctcacttggtgtgacctcctgtatgctgggcttggctcagggagaagtcaggaccagtggtgagaagcacaggcccagataaccagactcactctgaccaaatgtgagtgctggggacattgtacaatccatctgtgttttgctgatattttttcatctgtaacgtggaaataacattgatactacataccatggtttctgtgcatatggaaaaataaaagatgattggtgcaaactttaaatacacacagtttatgtagatcaattgtacctcaataaaactgttttaaaataaaaattacaaaactataagttttataggttttaagggtttatcatagaacaaacttacaataagaaacaagaatttccaaatgctatcaatatcacaaatctcccccaggacgctctgacatgctctgagccccactctctcctcaggcgtcccatcccagagcttggcatgtagtaggagacatgcaaatagagccctccctctgcttatgaaaaccagcccagccctgaccctgcagctgtgggagaggagccccagccctgggattttcaggtgctttcattttgtgatcaggactgaacacagaggattcaccatggagtcatggctgagctgggtttttcttgccgctattttaaaaggtaattcattgagaactattgaaattgagtgtgagtggataagagtgagataaacagtggatacgtgtggcagtttctgaccagggtttctttgtgtttgcaggtgtccagtgtgaggtgcagctggtggagtctgggggaggcttggtccagcctggggggtccctgagactctcctgtgcagcctcaggattctcctttagtagctatggcatgagctgggtccgccaggctccagggaaggggctggagtgagtggcacatatctggaatgatggaagtcagaaatactatgcagactctgtgaagggccgattcacaatctccgagacaattctaagagcatgctctatctgcaaatggacagtctgaaagctaaggacacggccatgtattactgtaccagacacagtgagaggaagtccgtgtgagcccagacacaaacctccctgcaggggcacgcggggccaccagagggtgcccaggatcccctgaagacagggacagcccaaaggcaggtgcagatggatgtcaagagggtctgtggcttcgtctacatctaactgtttcctggtgagcctctgtatatttatttttctgtgcccactaatgaggttggtaagtttaaacacttttttttttgagatgaagtctcgtgcttgtgccccaggctggagtgcaatggcatgatctcagctcactgcaacatccgcctcatgaattcaagcgattttcctgcctcagcctcccaagtagctgggattccagacaactgccaccacgcccggctaatttttgtatttttagtagagacaggctttcaccatgttggccaggctagtctcgaactcctgacctcaggagaccctcccaccttgggctcccaaagtgctgggattacaggcatgagccactgtgcctagccaaaaaagacttcattattataggaggaaaaattctcatctgcaagtgtcactgatggaagcagaaaaaatgcccaggaagtcaggtgaggctgtagacactgtcaacccaggatgcaaatctcaccacaagtgcaggagaaagggcagggggttgatggatcatcctaactaacgtatggtttaagctgagcccagcaagaccctcagtgcctccctaaccacagttgcccttcagggataacccatgtgctcaacagcagccacaccttagtatctccactgtgcagtcattgtctaggacaagctcccaggatgtggggctttggcacaaaccaggtcatggatgtcagagaggggcagctgggtgtctggtccataggctccctgatgttggagggttgagaggtgcattctctgggccaacatatactctagggatatttacttcagaacacataattttatttgttggtttatggttaatggggtattcatcccttcaatcatttgtcctttgatttacaaaaacattccaatttcactttggaagtaattttattatgtgcaattaagtcattattgattatagtcacactattttgctactaaatagtaggtgttattcattctttctaactctgtattttgtacccattaaccatatccacctgttctctggcccccactagcctcccagactccagttaccatccttctaccatccgtgttcctgagtttaattctgttgatttttagagcacacacataagtaagaacctgcaatgctttttttttcagtgcctggtctttttcacttaacatagtgacctccagttccatccatgttgttgcaaatgactggatctcatggaatacctaattttattcggttctttcatatgacatagagaagcaagcatgcagtctacaaacaactgtaattttcacatttaccccaaatgaattattacttatttctgtgcagggtccaggcacatagtagcctttctcttgagggactgttaaatttagagtgagatcacttgtttctcatattatatgattcctgtccatgtgcagagatcttaagtaatctgcttctttctgcacactaactctgaccttctcgacaaaaagagtagagattttcatgtttcctgagtctggggtaggagttagtcctacacaactcagagcctgcagagacctcccagtgcagttttatagacacaggtgctttctcatggggggtgagacctccacttcctgtgattgctgctcagatctaactgtgatttcagatttaggacaccattaggctctcaaaccatttctattctaaaaatcagcctcatcatagaaaatggaaataattcaatatccatttccctgaccgtatttcatccttgtttttaatttggtgcaagtttattacatatttgcctgaatctaacttcagaatcaactgaattggtctagaaatctcaaaaattgaacagaagtgggttttattatttttaccaaaatgtgtgtaggtagggtttccaatgtatcatccagaacttgtgcatgctaacaactgtttttctcagtcaattatcagcctggtgaagcccttgcaaaccccctcactcacctgtgctgcctctggattctctgtcacaatcagtgcttcctgtaggcactggatggaaagcacaggagtgggtcaggtgcatacgtgatgagtggaggatgaattccagcccacttatcatgaattcagacaagcccacatgttcccacatgcactatatcttcagacaagcagatgtgtctgcacatgaattcttctttcagacaaacacgtctgtcccctcatggactcttgccacacacaagcacacgtggcttcttgtggactgtactttcagacaagcacacattgtttcatgtggacatcttcctcccacaaatgcattttcccctgagtagactcttctcccacaagcccatatgtcctcacatggacatttctcacaggcaaacacccatttccccatgtagtcccttccctcagacaagcacacgtattcccaggtagactcttcccttagacaagcacagctgttcccatatgaacccttccatatgacaagcacacatgttcccatgtgaactcccgtataacaagcacacatatttcctcacgggctcatcactcagataggtctgcatgtccacatgtggactctactctcagacaagcccacaggtcctcacatggactcttctctcaaacacccgttctccattgtagactcttcccttagacaagcacgcattttcccatgtgaactcttctgcatgggaagcacacatattcccacagggactcttctctgaaacacccattctccattgtagactcttcccttagacaagcacgcattttcccatgtgaactcttccgcatggaaagcacacatattcccacagggattcttcactaagacaagcatgattgtctccactgtgacccttccctcagagaagtacacttgtctacatatggactcttctctcagacaagcaaacatgtccccacgtggactctttcttctgacaagcacacgtgtccccatgttgttataatcattttctcacctctgtctcacaaagttgccctgtcctccaagaataattttgacctctcacttctcattcacactatggtgattggtgcgcagcattttcacccaagagaaatgcaggcagctctcagaatttattgtgatggaggcaggaagacaaacacaaagataaaacttgtcgctaccttgctgggctgtgttctgtgcagagtctctgaaggctgccctggggctgtgtcctaagctgtatctctctgattccactaggagaatgcacatagagaaattcaagctgaatggtgtcctgatccctgcctcattctgctattcttccctattcctcagaaattcacccaacattgccctctgtcttgtattgtctacattctcacagactctctcatagaacttcagcttcaatggtcagagccctggtcacttcttcccaactctccgcacatgccaagtgcacattagagactcaataatgaggctcaccaggggcagtagtagtttcatctatcacagtggagatgaaaatccatgatttaaaataggtttctaaaaaagaaaatatgtctcacatcaaacacaaatgagagaatgcaacggcataattcattttcaggtttttcatatgtaaatctcctaaagtacataatttagtttttagtgtggttcctgatccatgaatccttttgccttcttcattatctttcattcaaacaaacagagaccatacccactgttcacagtgtagcctcatggagaacatcttcaccagtcagcccagtcagtgagtgaggcctttaaatccttcatgctaattcaaatttctggctttattcttagtagaccccaggttttcggggatgttgggttgtgccagcactcctaaataagggagatagaaattatttcctcaggcatcctcttgcaacatttggacaattgcccatagtttgattattgaggtgtgatgcatcaaaataatgttagttcaatcttctctcaaccagtcattgaacattgaaattttgtaattatttatttggatatctctgaagtttacctcttgaatatttaggtcatattataaatagtttaagctgcctactaggtaaaatgatctgctgcagaattttgacttccttgctgtgcatttttgcatttaaattgaagtttctattactcgtgtgtctagaatgtaaaaatacgtcttacattttctcgaatttttcatttcactggagtttccagaagatgagaaaacctcccttgtgtataaaatacctggtaacacattgctcaatagtttcgttgctgagaccagctcagtcgggagaccctaacccagcggtgctagaggaattaaagacacacacagaaatatagaggtgtgaagtgggaaatcaggggtctcacagccttcagagctgagagccctgaagaaagatttacccacgtatttattaacagcaagccagccattaatattgtttctatagatattaaattaactaaaagtatcccttatgggaaatgaagggatggaccgaattaaagggggtgggtctggctagttatctgcagcaggaacatgccctaaggcacagatcactcatgctattgtttgtggtttaagaacgcctttaagcggttttctgccctgggggggccaggtgttccttgccctcattccggtaaacccacaaccttccagcgtgggcattatggccatcatgaacatgtcacagtgctgcagatattttgtttgtggccagttttggggccagtttatggccagattttggggggcctgttcccaacatttcctctttaatttttttctcctctcatattgtactgttataagcaatgagatatcaggacacatcatcaacactttgctaagaaatatcttcagctaaattcccagagtatcatatactaatcctaattttaactaaggtaacataattaagatacattctataacaagtcacacatattatccagtatccagtaacatgtttgtgacagaaacaaagcaggtgcttcctctgcaaagggtcatctgaggtctgagttgagggtcacacaggtatttttctggtttacaagggtgggaacgacaacagtaataacgactctgaacagcactggcccttccttgaaaggttgcaggtaaagctactgctgctatatcaaattaacaccttactagaataaagcccagagggagggtccacatgctaggtcacagagtgaggagaaatggagctgtgctctgctctccacactacctacaagatcccagacacacgcccaggttccactgatgcaaggcatctacagtgcagttctaaggcacctgcttcctggggcagggagcatcctcctgtcaattgcgcacctgctccttctgcaagctattaagtgagcacttctattgccatgaattatacatgttctctctcttaacatgtatattgaacatgcttacttacattgcattttatttttctctgaaatacactggatgagcagaagaaaataaatcacacccctgatgctttccacacatacaaagattcctgaaggcagagctgactgatatcctcaccagtagaccactgcctttcagagatgatcttggtattcaagttccagcaattcttgaagttaaagggcacctctatctcctctccactgctttgcacctcacctgatatcagctttctcattagaatgccttgtgtttaaggaatgagagttcctgtcacaggtgcaaaggcccaggttctcccactggctccagtccagggctagggacacctgtaagaccatgatatcatctgatacataacctttacatcataagctttacataacctttacatacataacatcacacatagcattcatgatacacacatcagatcacctttacatgctctaacatgtaaagattaggaaagtcatcaagctcattcttatgtcaaaaaacatctgcacaatttgaacatcaacaatttttgaaatctatcaaggaattgaaattgcaagggaaattacccattccaaatactgaagatacagacatgtccaggatcagagttgacactggctgaactggaaaagaacttgaagaaagcacgagttggtgagagcacacacatggtaaatgctatgaaagcctaaacggcagatgtggactagggtgagattcctggggacctacactccatagtcttctgaactttccttcaaaatcttccagattctcaggtatacaatccaaataatttttttatgggtctgaattggggaggattaattactgagaaatgtaccaagagccttctaaaaaaaaaaaatcctataggaaatgagattttccagaacctggaggaacctacagttccctaaagacagacactgaggagaataaatctcgacagcgccgcctggaggtggaggtgaagagcttcctggaggagctggaccggaagatccacgacctgaatgactcccgcccaggcctcccaagctgggcaccgacaactagggctggtggaggcccgggatccccaccgtgagtcccaagcatgtgtgcgagaccagatggcgctaggacgttccctgtgtgcgttgcttctgtaaatgcagacgcagtttgtcgtgtttccaaaccagttgtgctgtccactcgctcctttccagagtagaaatctcctctccgccgggcgcggtggctcacgcctgtaatcccagcattttgggaggtcgaggcgggcggatcacgagatcaggagatcgagaccatcctggctaacacggtgaaaccctgtctctactaaaaatacaaaaaattagccaggcgtggtggcaggtgcctacagtcccagctactccgaggctatggcagtagaatcgcttgaacccgggaggcggaggttgcagtgagccgagatcattccactgcactccagcctgggcgacagaacaagattctgtctcattaaaaaaaaaaaaaaataggcttcaggaagtagctcctagatgggcagaatcggtttaaccctctgtgtccacaggatctggagcctctctctccttagattaggccacctcctcaggattacagggctcttcagttttctcaacatgctgttgttgccccaaataaacacaaaagcactttattttcttatgcttacctttaatttttcaaaacaacataaaggtgataattttaacaataaacatattacaacctactatacatgatacccttcctgtagttcgaggtttattctcaggaatttatatgtattacttattttcaattgctttctgatatgggatgtcaatgccactttactacagtctttattcttttaagttatctctaaaatctctaaaaattaatctttccaaagcaccactcaaaaccagtgtattattagaacttgtgggtgtaatcgttggaccaatattaagaataaattcttaatggactaactcagatataaaatttctgtccttcctctctctctacatatatacataacgactttgaggtttcagttgaatcagtccattcattgaatgtatgacaataggttgatctaattgtatacgttaaatagcatgaagaaacctcaacaatagcaaaagtagccccttaccaaaaacagctctattatgttagattccacttatgagaagttcaaaagagaaaaacatggatctgtattgtcagaaatctaaacatttccccacacaggagctgaccacaggcacaggaagacctgtgttgggggatggactgctcttcagtctaccttaggtgccggggacaagagtattcacgtttggcagaaactctctagtgagaaattccagatctatgcatttcctcttatatgtaaattttctcataaaaacaaaaaataatgtataaaataatttaaaattcagaacataataaaaatgacattacatgcctatccaaaacattcagtaatgaacattattatatgaattaataaaatccattcaaatatacctactgaaattaacttctggaaaataaaaagacaagggtaacatccgtaacttaaaaattaataagcatatatttcatagagaagaaaaaggtagtcaagacatatgtggaatgtgtattcttttttccaatcaaatgtcattaaactatttaaacaattttttaacctgtgtcataagtatagattactaatatttgtctgatattacaactgtgaacaagttttaaagaaaaaaggatatttgacagcatgtgaactaaattgaatttattcttaatattgagtccaacgattacacccacaagttctaataataccctggttttgagtggtgctttggaaaaattaatttttagagattttagagataacttaaaagaataaagaatgtaataaagtgacattgacatcccatacataacaacatattgatctattttttgttgatggactttaaatttgtttctagtttatgaatattataagcaaagctgttacaaataccttagtgtaagttttcctatgttgtctcatttttattgcgaaaacatgacgtatgcatttctttcttgtaagagtaattttaacttttttcagtttcattgaggtatatttgaaaaaattttttaaaagtatatggttgaggaacaatgcaccacttgatgctttgtcttaggccattctcacattgctataaagaaatgcctgagactaatttgaaaaaaagaaaaagatgtttaattggctcatgattctgcaggctctataggaaatgtagttgtttattcttctggggagactcaggaaagttagaatcatggcagaagacaaagaggagcagggcaatcacatggccagagcaggagccacaggaggcgtgcggtgggggggtgcggggcgggtctacacaccgttagacaccagatcttgtgagaactcacgcactgtcatgagaacagcagcaggagttgttgctaaaccattcatgaaagacgtaccccatgacccagtcatgtcccaacaggtcctactttcaggaatgaggattataatataacatgagatttgggtcaagatacggatccaaaccatatcagatacacattgtaaaatgatcatcgtagtcaaggtaatttgtgtgtatatcatctcacagagctacaattttatttttttaagtttactgcatgtgtgtgtgtgtctgatgagaacaactaaaatctaccctgttagcaaaaatcgtttttacagtaaagtattaactataggaacattgctgtacattagatttccagaactcattcaccctgcacaactgaaactctgtaccctttgacaaacatcacccaaattccctctcctcccaggtcctgacaccctctagtctactctctgcttttaagaccttggatattttagatcccacacgtaaatgagatcatgaagcatttgtctttctgcatctggcttattccactcagcatcatgtcctccaggtccatccacgttattgcaaatgtcagaatttccttcttttcaaagcgtcataaatttagttttatgtatacacattttatttatacatttatcaatgtatggcccttaaattagtttacaaatctacactattattaataatcttgcaatgaacatgtcttttgcataataattttatttccttttaatatataacaagaagtggaatcactagatcataagatagttttattttcaatttgttgagtaaccaatcctaccacatcatataaggattcctttttctccacattgttgccaacatttttaaagttttgtcttgctgataatagccattttaactgctttgaagtggtatatcattgtgctttttatttgaattcccctgataattaggaatattgagaaacttttcattttccgtttgccatgtgtgtgtcttctgaaaaaaaatctatccagaattttgccttttttaatcaggtcacttgttatttgttattgagttgtatggcttatttatatattttgtttgaacttcttgtcagatatataattacgcatagtttttcctgtgttttggtattaaattcaaataaatcagttctgagtcaatgacaggaagttttttctttttccatgttgtctatgagtttatggtttcaggtattatgttcatttttagttgatttttatatcatgttaaaggaggcctaattttatttctttttatatggatgcccagtttttacatcattattgaaaagactgtcctttctctactgtgtgttcttggcacactccatcaggaagagacataatgaaaaaagtatataagatgaatattcctgatgaacatagatctaaaagtcctcaacaaaatactagcaaatagaatccagaagcactttaaaatgtaatacatcatgatcaaatgggatttaccctgggatgcaaggttcattcaacatccacaaatcagtaactgtgattcgccatgtgagcagaataaaagcaaaaaacataggattatctcaatagatcctgcgaaagcatttgataggatccaacatccactcgtcataaaaaccttcaacagactaggcatcaaaacatacctcaaaataataagagccatctgtgacaaactcagtaaacatcatgctaaatgagcaaaagctcaaacaccttgagaactggaacaagagaaggatactgtctctcactactcctattcaatataacactataaatcctagttagaacaatcaggcaggagcaaaaatgaaaggcagctgatgtggttttgatttgtgtccccacccaaatctcatgtctaactgtaatccccagtgttggaggtggggcctggtgaaaggtgattcgatcatggggttgtgttttcctctctcacgctgttctggtgacagagctctcaggagatctggtttcaaagtgtgtggcacctcccccttgtctcttcctcctgctcctgccatgtaagacatgatgcttccctttctgtcatgattgtcaggatcctgatgcctccccagccatgcttcctgtacaactcgcagaaccatgagcaattaaaactcttttctttataaattacctagtctcaggtgtttatagtctgagatggactaacacagcatccaaacaggaaaataattcaatccatctgtcttcactgatgatacaattctatgcctagaaaatcccccaaagtaattctagaatagataaataactttagtaaagtgtaaggatgcaaaatcaatgtacaaaaatcaccagcatttctatatcccaaccacatccatgctgagaataaaatcaagaacacagtcctatcccatgtacaatatcttcaaagaaaatgacatgcttaggaatgcaggtaacaaacaagatgaaagatctcttcaaggagaacaacaaaacactgcagaaataaatcataaatgacacaaataaatggaaaaaaacatttcatgctcctggattggaggaatcaatattgccaaaatggtcatactgcccaaagtaatttgcagattcgatgttatttccatcaaattattaccatcattcttcacagaattaaaaaacccatacatattctaaaatatatatggaaccaagaaagaccctgaatagccaaagcaatcctaaacaaaaagatcaatgccagaggcatcatgctaccagatttaacattacaaagtaagaaaaacagcttggtactggtgcaagagcagacacacagaaaaaaaaaagaacaaaacagaaaacagaaatagagctacacacctaaaccatttgacatttgataaggttgacaagaatcaagccatagattaaaaaaaaaaaactccgtattcagtaaatagtgctgggagacctggattcgggcagatatgcagaatgcaacagtgaaggaggctgggcagtttctaccttgatttcagatgtgcagagagccctatgtgcccaggaaaaagcttgctgcaggagtggagccaccacagagagcctctactagggcagtgccaaagatgtggaaagatggggttggagcccccattcaaagtccacactggggcactacatagtggaactgtgggaatgtggccacagatctcaagactgcagaatggtagatccatgggcaacttgcaccctcagcctagaaaagcttacagcacttgactctgactcatgaatggagccccaaggactgcgcccagcaaaactacagtgatgggctgcctgaggttttggggagccaacccttgtcccactgtgccctggttgaattacataaatttgagagaggttattctgtaactttaagatttaatatctgctctactgggttatatgtgtgtgtgggggggggggagcgctgttggccattcctttggccaatttatttattttggattggaataatttacccaatgcctgtaccataattgtaccttggaatacacaacatttgcaatgtttttttttttaattttgcaagctcacagatggagggaaattgccttaagactcagatgagactttagacatttgagttggaggctgaccaagttaagactttttgttattttagtattattatactttaagttttagggtacgtgtgcacaatgtgcaggtttgttacatatttatacatgtgccatgttggtgtgctgcacccattaactcatcatttagcattaggtatatctcttaatgctatccctcccccatccccccaccccacaacagtccctggtgtgtgatgttcccattcctgtgtccatgtgttctcattgttcaattcccacctatgagtgagaacacgcggtgtttggtttgttgtccttgcgatagtttgctgagaatgatggtttccagcttcatccatgtccctacaaatgacatgaactcatcattttttatggctgcatagtattccatggtgtatatgtgccacattttctcaatccagtctatcattgtttgacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagatccctgaggaatcgccacactcccttccacaatggttgaactagtttacagtcccaccaacagtgtaaaagtgttcctatttctccacatcctctccagcacctgttgcttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatgtcctttgcccactttttgatggggttatttgtttttttcttgtaaatttgtttgagttcattgtagattctggatattagccatttgtcagatgagtaggttgcaaaaattttgtcccattctgtaggttgcctgttcactctgatggtaatttctttcactctgcagaagctctttagtttaattagatcccatttgtcaattttcgcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcacctttctacatatggctagccagttttcccagcaccatttattaaatagggaatcctttccccattgcttgtttttgtcaggtttgtcaaagatcagatagttatagatatgcggcattatttctgagggttctgttctgttccattggtctacatctctgttttggtaccagtaccattctgttttggttactgtagccttgtagtatagtttgaagtcaggtagcatgatgcctccagctttgttcttttggtttaggattgacttggcaatgcaggctcttttttggttccatacgaactttaaagtagttttttccaattctgtgaagaaagtcattggtagcttgatggggatggcattgaatctgtaaattaccttgggcagtatggccattttcacgatattgattcttcctacccacgagcatgcaatgttcttccatttgtttgtatcctctttaatttcattgagcagtcgtttgtagttctccttgaagagatccttcacatcccttgtaaattggattcctaggtattttattctctttgaagcaattgtgaatgggagttcactcatgatttggctctctgtttgtctgttattggtgtataagaacgcttgtgatttttgcatattgattttgtatcccgagactttgctgaagttgcttatcagcttaaggagattttgggctgagataatggggttttctagatatacaatcatgtcatctccaaacaggaacaatttgacttcctcttttcctaattaaatatcctttatttccttctcctgcctgactgccctggccagaacttccaacactatgttgaataggagtggtgagagagggcatccctgtcttgtgccagttttcaaagggaatacttccagtttttgtccattcagtatgatattggctgtggctttgtcatagacagctcttattatgttgagatacatcccatcaatacctaatttattgagagtttttagcatgaagtgttgttgaattttgtcaaaggcgttttctgcatgtattgagataatcatgtggtttttgtctttggttctgtttatatgctggattacatttattgattttcgtatgttgaaccagccttgcatcccagggatgaagcccacttgatcgtggtggataagctttttgatgtgctgctggattcggtttgccagtattttattgaggatttttgcatcgatgttcatcaaggatattggtctaaaattctctttttttgttttgtctctgccaggctttggtatcaggatgatgctggcctcataaaatgagttagggaggattccctctttttctattgattggaatagtttcagaaggaatggtaccaactcctccttgtacctctggtagaattcagctgtgaatccgtctggtcctggactttttttgtttggtaagctattaattattgccccaatttcagagcctgttattggtctattcagagattcagcttcttcctggtttagtcttgggagagtatatgtgtccaggaatttatccatatcttctagattttctagtttatttgcgtagaggtgtttatagtattctctgatggtagtttgtatttctctgggatcggtggtgataccccctttatcattttttattgcatctatttgattcttctctcttttcttctttattagtcttgctagtggtctatcaattttggtggtcttttcaaaaaaccagctcctggattcactgattttttgaagggttttttgggtctctatttccttcagttctgctctgatcttagttatttcttgccttctgctagcttttgaatgtttgctcttgcttctctactgaaaaaagatgatcatattttgcaatgcaaggacatgagaattttgggctcgagagtgcaatgatatagtttagatgttttcccttccaaatgtcatggtgaaatgtgattctcaatgttggaggtgggaccgactgggaggttttgggtcatggggaaagatccttcaggaatggcttgggaaccaccccatggcacttagtgaattcttgctgtgttagctactatgagatctgattgttaaaaagagtctggcaacccttcttgccactcatgtcccagctctcaccatgtgacatagcctgttccccctttggcttccatcatgattgtaaagtagatcctggtgccatgcttctcacacagccttcagaactgtaagccaaatgtgcctcttttctttgtaaatcacttggcctcaggtattaatttataggaatgcaaaagagactaacacaccgtccaaagcattacacagattcaactctatttttatcaaatgaccaatataattgattacatatttagaaaaaaaatactaaaattcctatagaatcaaaaaagagtctgaatagcaaaagcaatcctaagcaaaaagaccgaagctggaagcaccacattctctgacctcaaattatactacatgaatataataagaaagacagcatgctactagtagaaaaaaatagcccagaaagaaagccaaatatctaaaaccaactgttgtttgacaaaactgacaaaaatatacactggagaaacaaccctctattcaataagtggtgccgggaaaattaggtggcttatgtggaagaatagaactagacttccatatcaccgtagacacaaattaactgaatatggattcagtgtttaaatttataaactaaaactataaaaatacttgaataaaatctaaaaagagtcctctggacattggtctaagcaaacaatatatgactaagacttcaaaagcaaatgcaataaaaacagaagtagacaaacaggatttagttgaactaaaggtcttctgcacagcaaaagaaataaccaacatggtgaccagacaatctgcaaatggaaaaaatatctggaatctattcatcttgcaaagggctaatatatagaatctacaagtaactcaaataagtcaactaaaaattacaaataacttcattaaagaatagacataaacagacatttatcaaaagaatacacagaagtggccaacacaaataagaaaatatactcagcatcaccaatcatctgataaatgtaaattagaaacaacatgatacggcatcttccaccagtcagaatggctgttattacaaataaaaacagcaggtgtttgcagacaaacataggaaaaataatgatttatatatgcttggtgagaatgtaaattagtacaacctccatgaaaaacaacatagaaatttctcaaagaactaaaattagaattaccatttcttccagtaagctgtcccagtaggcatgttcctcccaaacttttatatcagagaatgttgcctgcactcatatgtttatttcaacaccattttcaatagaaaagtcaaataatctaagtgtcaatcagtggatgattagataaaatatgatatatgtaaatcatggaatactatgcagccagtatggtatgaattcagtgtgaccagcccctggacaagggcttgagtggatgggatggatcatcacctacactgggaacccaacatataccaacggcttcacaggacggtttctattctccatggacacctctgtcagcatggcgtatctgaagatcagcagcctaaaggctgaggacacggccgtgtatgactgtatgagagacacagtgtggaaacccacatcccgagggagtcagaaaccccgagggaggaggcagctgtgctgagctgaggcagtggtgcagcagtttctttaacttccatatgatctcattttgcatcatcttctacttttatattagctaagaacttggggtagacaggtgctcctaagagatccttaacttgcccattttgatggttttccagaagacgtgagaagccactttgttagcaaagcatcccaaatccatgccctgttctagatacatgtgagcccatttcctggtctttgcttaactgacaagctctcatcagtgcacctgggctaatttcacatcaggtagaggaacgcgttataaaggaaagctaatgttgtaatagcaattcctgcttaaaaaccttcagcttcattgtttttgtgtaatccatcagcaaattatgttagttcaaggttctcaatgggagtttctaataaatagaaaggatgtataaagcttcccctaattaaaatgaaacaattgtgaacacaacctcggtattcagccatgtctccacccttcacacccttcgccacaaaggaattttcacctctcctggaagctgggttcattttcaaattagttatttttttcaatgtaatatctcaagattatcgtatatgactattttagcagaaagtgaattatgggaacttgaactaaacaactgaaaacaaattcacaactaattaaacaagatgccagaatgtgattggctccagggtttgtaattcagcagttcatgtacccagactggaaatttacatgtcttcttgttaccttcacagcacagtcaactcccattatgtaagaaatggtgactgcattcccaagggttatgcatagatatgaaaatagactgggtaaggtgaggagttgattgtttaaattcccctctgaagaagcagcatcaactcaacaaaccacctctcttcactctgtgactagagctatgtcacaggccacatggacctaaatccttgatggatataacatgactacataaattgggctgatcatttttatgctataaaattaatagatgacactgcactccagcctgcacaaccaagcaagtcttcatctgtaaaatctaaaaaagaaaaattaataggtactgacttcgaaatttttgataataatattttcaccacccaaatttaatcacacccacatgttacctgcatcttcactgaaaagttcccagtcacgatgagttccttcaatgctccatgtgttcaaatctggacatcaagagagtccagagaataaaacacaatgacggcagtgaaactgatatatattcagcacctcttaactcaggaggactccatacaccctggcacacaggtgcttttctaaatggctcacaatgactccagctcactcacagagctcagacagaaacctcccttcagggtgggagctgggtggcagggggcactcagtacccgcagaggtgaaaatgagcttcagatggaacttccctgtcacctcaacatggaatttattgtttcatttcattacctctctttccataatggttcatttcttttggcctgttcattactgatatttttcagagcaatctcacttgaatctttactcttttggattttgtctccttgacaatgttgggaagttttacctccagcatcataacatgatctagtgatctgacacattgtgcaaacaatacctacaaattcagaacctctttgtttttctttccacaaaatataattctttctgttctgtgtatgagcatgtcttagcaaccctgtacacacccacatagatgtctacaagcctatgaattgttctctgtaaataaaaatttatctcaaattccttcaatgttcataattctgagagtgaggaaggtccttctcaatctgttcaaacaaaatgcccagagaccatccagtaggtaaggagttcacctggctctggtgtggggtctgtctctttccctctgttgtcccacaggtcagcccagttgttcacgtcctaacaagaaagcccaggtttgtcctgattttaaaacacatcaaacttctgatgactctcctgttacccacatccatggagatagattatttattatataattcagcaaactaatgtcaaatgcccaagttgcaataccgcacatcctagggtatgttcatgcaattcaatggaggagaaaatctttcagagacagatggatctgaaatgataaatatgtgggtaaggactctgggcttgagtatcattgtccagccatgtttcacaagtgtgtcctgtcagggaaggatcagagttccttgtgctctcagagggaaggggtcacagagttcctctctggttcccaggaaaggtaatcgcactaatcttcatgatcttcatgagactatcctccagtgctgacctgttacggagtttttgtctgaagttctcactgtaatccccaatctacatattttcaatcagaagtgtttagagggcaggacacatcttcaaggtcacacattgagaagtatggagatatgtcccactaccttctcctacgatctcagacagaatcccaaatttcaaaaggacacagaaggacagctctcaggtgcttttaaaaaatgacccacttccagggacagtgagcttccctgtaaccatggtggatgttctgaactacaataaacattggatggatccagtattgtttgaagtcactgtcattattacattcagctgttgtttcaatgtgtctgaaagggtaaatgactatttagatggcctgggtgtgtggtgggttttatatgaatctttaagggttgaacagtactgaccctattccaaaatctgtccttgatccaggatcacactcatctctcagaccagctccttcagcacatctctttacctggaagaagaggactctgggcttggagaggggaggcccaagaagagaactgagttctcaaagggcacagccagcattctcctcccagggtgagctcaaaagactggcgcctctctcatcccttttcactgctccgtacaaacgcaccacccccatgcaaatcctcacttaggcgcccacaggaagccaccacacatttccttaaattcaggtccaactcataagggaaatgctttctgagagtcatggatctcatgtgcaagaaaatgaagcacctgtggttcttcctcctgctggtggcggctcccagatgtgagtgtttctaggatgcagacatggagatatgggaggctgcctctgatcccagggctcactgtgggtttttctgttcacaggggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacacacagtgaggggaggtgagtgtgagcccagacaaaaacctccctgcagggaggctgagggggcggtcgcaggtgcagctcagggccagcagggggcgtgcggagctcacggaatacaaggccgggtcaggagcaggtgcagggtgagcggggcttgctcatcttctcagtcgtctccctcctcgccagcacctcagctttccgtagaggtcctctttctttattgtgtgtggttctacttcctcacatccttgtgccaggaaagaaaggagtaaggcaaattttcctgttacaattgaagtttcaccaattactaagaactttcctgcaagtacctgcacagcccattatacctcatttatatatgtatatattctaatgcttctcaccatctcttgatttgtgtcatcaatttaattgtgccctttttgaaattcatatgctgaaactttaaatccaatggatctatatcggaattttaatggtataattaatgttaaatgtggtcataaatgagaccctaatgcaatagagctgttgtctttattagaagaggaagagacaccagatacctctcacttctcacatgcactcagagaagagggcacgtggagacatagtgcactagaaggtgggcctctgcaagccaggaagaagccgcaccaagaaccaaccctgccagcaccttgatcttctacattcagactgcagaattgttagaaaatcaatatttgttgtttaagccacccactccttttgtcttcttacgaagacccagacaggctaataccacacaactctgttagctccgtctcctggagggagaagcagccccctgaagctgggcacatcgctcagattttcacatgaattaggcaaaaacagtagctctcatataaaaactgtcacgtccctgttgggacaaggtcttttaaacaagccctggggctttgtcacaaatgttgcattttatcctttattaggacttaactaattgacaatgagtaccagctggatggaaactgaccactgaccatcttctgctgtctccttattatatcacagaaaaccacagcaacattactctatgtcttcaactttctaaatttgtactgaatctattgctaaatgaggagctacatggggtctgagttttgttaccttcttcccagtcttccccaattaccaagcatagaagatactttcagtgaaatttagctgtcaatgcccccaacaccacatcatgttttaaggtccaaggactttctttggggggctattgaaaaacacttttgaatggaaaatcctaaagcatacaacagctgaaagaatggcccctgtgcacatgaaggctgaagggatggatgatagggtacgttcctccaaggtgttcctgggcatgtgatggttggatacctcatgcatacgaaaacaaggactgaactgagatagaaacaagggccatatcctataggaaaacaagaaaaaaacgggcatccctgaagagagttaattagacttggtgggtttaagatgaatttttttccaaagttttttaatgttctaagctaaatatgaatattttcaataaactgcaaattaaaaggagaatgaatttagaagtttagacagaaaaaagccatgagggtgtagaaagcaaatccacacaaaactgtcacatggcagaggccagaatggagctgatgcagctatatcattattctgcagacctagttgagaccctttggtgtttaaggcaggtccagcagtgaagaactcctttattttttgtctgggaaagttctaatctaatcttcatttctgaaaaggatttacatgataaagattcgtcttggcaggttttatttatttttagtcccctccaacccacgtcaatttgagtaaagtcatgtgttacgtaacaatgctgcagtcaacagtagaccacatatatgtttgtggccacataatgttgtaataccatattttcactaaactttttccatgttttgatgtgtttagatagagagatacttaccatggtgtttccatttcctgcagtgttcagtgcagtaacacgctgtacaggttagttgtctgggaaccctgcgctaatccacataccctgtgtgtagtagggtattccttgtaggtttgtgaaaattcacccttgatgcttgcacaatgatgaaattgcccagggacacatttctcaaaaagaacctctgtcaataaaccacacaccattgaatacaatccctgtgccttctgaactgaaaaccttctgctgagaaatctgttccttttctttctgttttctaaagcctcttttatttccagcaatgtggttttaaactgtgtcacattttttgtcattgggtttatcttacgtaaaatttatagagcttcttcattgtggatgaatatttgcttcccttctccaaatttggaaatattttttgctattattttgaataatttatctcttctctctctctctctctctctctctctctctctctccctctctctctctctctctctctctctctctctctctctctctctctctccccctctctcccttcactaccccttttgtcttgtctttgtataactcctcaaatgcgtagttgagtgtttagtgtctttcctggcccataagtcttgaactcttttttatttctttcacttaaatttttcttctctgtctctactatttcaaatgatctttctttgagtttactgtttcttctattacttgatctagtttggtctaaaatcttgttaaaatttttggctgtattcttcaggatcaatatttttgtttagtcatcttttaaatgttttatctttattaaaattctcacattgttcttgcatgctgccactagctcattgaacatgtttctaacatttactttaaagtttctgtcaggtaatccatgttcttccttttcattgatgtcagtttatggaccttttggttgttcttctgtttggaccatgttcccctgcttcttcattttccttgactgtctttgttgttatctgttctttataacaaaagccatcatatacttcttcaaagactaggctcatagagatcaccctcaccaatcagcccagacagtaattgtgggtctctcaaaacttgataggattcaaacttctgtctgttcttagtggcccctaggttttagaggatgatagattgtgccaggactcacaggtaagggaggtagaaactatgtactcatgaccatggggtctgtgctgatctgagcttctcttgtcatcactctcaatattcaacttccccgtggatcaggctcagctgtggctgctccacgtggggctgttctcagtctgttgcctctgtgtgtgcagaagtcctctgtgaagttaactagtggagtcagacaggaaaatactacagaccaagaattctcagactgttctgcaaagcccctggattcactgaaaaaagaacaagtttggtccagcaggattcatggcaagtgttggtgagggagataacagtaattcaagtggaagttctcaatgggactcgccttcagtacaaagaagattaacagtcctcagagacactgttcagaagattctcttttaagataataaaactgagagcccaagacaagtctgtgtattactgtgagggacacagtgtggggacatctatgtgagcacagacacaaaagtccctgcagggagacaggaggggactgcatgttagttgctgctcagaaccaccagggggcattcaggacaccagtaggcactcagaaccaccaaggagagctcagaatcaccagggggcactcaggaaactggcaggtgctcagaaccaccaaggggcgctcaagatcccagcgggagctcataaccaccagggggcgctcaggacactagggggctcagaaccactagggggcgcccaggaccaccaggtctctcaagacaggagggcgcactcaggacactagggggcgctcagaaccatcagggggcaatcaggacaccagagggacttcagaaccaccagggggcgctgagaaccaccagggggtgctcaggacatgaccggccctcaggaccaccaggggattttcagaacaccaggaagcactcaggacaccagagagcgatcagaacaccagggggcactcagatcctccagggggcactcaggacaacagggagctctcaggacaccagggtgagctcagtaaaccagtgttcgctcagaaccaccagggagcactgaggacaccaccgctcccttaggaggcagctccacatcaggtccctggatccgggaagggagggcgggtccttttggatcttgccactaacctttggggagttttcctgcttcctttgtggtttcaagaatcatttgcagattcttctcatgtacaaagctctgctttcttggattatgtaatgtttttggctttggatgctaccagaattacgttgtactgtgagaggattcattcgtggtgtgtgcaatagtgaatgaaagctccaatgttaggggtggctttgaaagctacgttaggggtggctgagggcagttagcagaaaatgatcatcactatagaaggctactcatttctttgcacatttgcataaacaattgtagtttatgccctaaaaactgcatgttttcttggccctttttcttaaatggctccactctaagtccagtaatctaattaagctgtgtttcaaagaccaccaatcaagttaattctgtttaatgcaacactttgtaaaggaaaatgtacatctgttttttagagtcagctttaaattttacattactttacaaatattgatttgtcaaatttagtctcataactatcttcagtaatttaaaatcttagtcatgtcatgttaaattaagtaatcctaggtttctcacttgaattagggttactaagaattagaatagtaaaagagtataattagcttttggtgaggtttataaagaaagatgaggattttttttttttttggcttaaaaatattctgtttcccagtttacagggcttttcaactggttttaagataaccactgtttacatctaaactttttttggtaaatgactgctgagtttctatacatattccatagctagagtttcaaagtaaaagctctagtatctttgtattagtgtgtgtatgcgtagatgtgttaatatgtgcatgtatatatatgtgtgtgtgtgtgtgtgtgtgtgtgtgtgtgtgttgtggctactaggtacaaaattggctttgaaataaatattttcaaattaagtaaatgagcccaatgcatttgaagtacatgtgactcaaataaatatttaataaataagttggctttaaaattattggtaaaaacaaattagagatattttaacaattatcagcataccttatagtttatattaattcatcaagtgattttatatttaaaatcacagctagatattatatggtgtcaaaattttttatgatgattataaaattattaacctcgttggccatatgcggtggctcacacctgtaatcccagctctttggaaggctgaggtgggtggatcacgaggtgaggagattgagaccatcctggctaacatggtgaaaccccatctctactaaaaatacaaaaagaaaaaaaaaattagctgggcatgctggcaggcgcctgtaatcccagctactctggaggctgaggcaggagaatgcttgaaccccagaggtggagcttgcagtgagctgagatcgcaccactgtactgcagcctggatgacagagcgagactccgtctcaaaaaaaaaaattataaacctcattaaaaccagaatgatctttgtaattttttgacaaatatgatgtttaatattgttgttttaataaaaaacaggtaaatagttattagaaaaacaattatttgcttaattattaggtttttactcaggcaagcacctgaaattcatgggttattacatgggtaacagagaaaaaactttaaaggatgaattacaattttcatacagtaatcttgataagctacttaaataaaatagggaaatgtaatcaaataaaccccccaaataaacttgttcttcaatttaaaaatctaaagtttaattaaataatagatattgactaaatgtttaggtcattactaattgttttaaaaaatatataagaaaatatttttcttaaaaaattattcttagaaaaataatgtaattcaaagttatttatataacatcataaaaagtaagagagttttaaagaaatttattgacatagagaagtacttttggtaagaaaggttaaaataaaaaaattttatatgagaaataatcttgcatggtaattttttatcctaaaataaaatgactaagaaagaatgacgtttagaataaaacaagatgttcaactatgccataaatggtttgtgtaagtgaaaataagatttataaaaagttaatttattaaaaaaccttcatattatcaagttgactataattgaaagggaagtatttataatagtctttatagagatctggcttttatataaaatatagtaatacactgaagactggttagaatgacaaaattgtcttaaagtgttgatttactaaataaaattataagatattttaattttttaacccccaaatttaacttttattgcatcttgccattgtgattttttccctttgagaagacttgagaggctctccattttttcatcacgtcctttaacattttttttcttacaggcgattagcttcttactgacttaacttctaactgttgttagcttttaactgctattattgtctgatgctaaaaacattttatctttaagttctaaataaaatgttttctttcaatataacattctacactcttggcttatctttaaatgtctacatttttctatgaaaccaaagtcttcacgtgtaatctgagtcacattcttggtatgtctaattaattcaaatgcttttttcattagagttgacctgcaggttatctacatgcattttccaatagggaaaagcaatcacactgtaaaaggttttgctttgctatttggtaactggcataaaacaaattttatattttattgaaataattcctatgttactgttattaaggtttccaacttactgagattttaagaaaatataaattaatgttattacattcatgtagctatctacattacttttaaaggccttgtgctgccacattactgacctttgactcctaggtctaaaaaggacacacagcattttgggagactaaggcaggcagatcacctgaggtcaggagtttgagaccagcctggccaacatggcgaaaccctgtctttataagaaatacaaaaattacccaggcatggtggtggatgcctgtaatcccagctacttggaagcctgaggcagggagaattgcttgaacctgggagacagagattgcagtgagccaagattgtgccactgaactccagcctgggtgatagagcaatattccatctcagaaaaaatatataaataagagaaaaaggacactaagtcctgctaaatcttaaacactgacagtaattaaagccccatctacagacctggaagaaaatgacaataaaaattcatcatactcttaagacataaggccagaaattgaaactactcaacaactccaggcccagggactattacagaagtggatttgtaagattgtaaaagctaattttgagatataatattacttgagagtttctttataagttaagcattaatattaaatgcacactaatggaagtctagcatctgggcccctgtgacagattgacaagggtttcttgaagaagtaatccactctttagcttaaaaaattattaaaatttataaaagacctatgaaaattatattttatggtaaaagtagttataatttaatagacttatttctcagaattgagagatagttttaatttttctcatgatgttcttataaggggttattgtttagaaaattaattctttcaaaaataaaagtttttgcttttttaagaaatcactgagttttcacttggctaaataaataacttactttacaataatctgtaattccattttgtaatatcaagtgttctaaataaacctttgatatttgacctccttcacacaataaaagtctaaattcagtcatttgacctcattattcttttttgatatttgatctcctgaagccaaaaagaaacatatttagcttctttggtacaattaaattatactggaagcaatgtcaaatttgaaatggtgtttaactttggactatatttatataaatgtgggctatataattggagtatattcatataaattaaagagtacatgttctaaaatggtatgaggttcaattgactttgatatgtcagtatattttgtcagtagtacttatgattattatataaaatttttgttcatcacagaaataaccaaactttctcctcaattctgtctttaaccgtggctattctaaaacttcagccatccacaattgttttcctttgattctttatcaggtggcttataataatctatagaattttgaggggtactcttaaatacacaattgtgacaattttataaattgtgccatttatatacagagaaaaacttccaagactctcatggagacctgatgcatttatgatggttgttaatataatgtcaaacaggacaggacttaattgcatgaactgaactaacaggagcctgaaataaattttatggcttattctttaaagcatttgctaattacttacattttgtttttcagaatcaaaaaaaaaattctcttaagctattcattgtttttaacaattgagtatagtatattctagtgagaaaattcaaaaacacaatttcttcttctctacataatttctccaaaatttggaaactgtgagtattgttatatcaaaatattaattcacataggttcaatataaatctgctttcttccgtaacagggcacaattggagacaatgatcattttaccaagactttaacttgaatgacatattttcatatttactttataaaatgaatttaagctggatagctgataaaagccccttgggaaaactggcatgtaacctgttttgttcagggccctgagctgtagtaagtcaataattttactttctgacagacccaggaatcccaagttgtcttggaaaattgaaaaaagaagaagtaacccaattcatatagctgtctgaaggcacagatgaaacaatgtctgggcttgatgcttttaaagattctacccttagatttcttataaaaaatttccagcaaggtcaatttatgaattaaatagcctatgtacaaaaaatagaaaaaaagagagctaatatgttaaattactatttttgcctcatcttatacaaaaaaattaagcctaaaacttatattacaaataaatttgccctactatgattgtgtctctaataactttggggaattatagagagaaatactgtttcaaaataaacaccagtgcatctgttattagattctaaccttgtccacttgtttttcaatttatattattttctacaatttatattagtttctacaatttatattagtttctataaaaatttatatttgcagaagcctccaaaatatttttcctgatttaaaattaccagaagttaaactgtgctttcttatagctagacatcttatactctaaagaaaataaaatcaatgacatgatttggctctgtgtccccacccaatctcatcttggattgtaataattcccacatgtcaagtggaaaaaggtgggaataattgaatcatggaggctgttttctccatgctgttctcctgttattctcacaagatctgatggttgtataaggggcctccctcttcccgtggcacttctctcttgcagccatgtgaagaagcacgtgtttgctaccccttccatcatgattgtaaatttcttgtggctttctcagccacgcagaactgtaagacaattaaaccttttttctttataatttacccagcctcaggtatgtccttatagcagcatgaaaacggacaaatgtaagcaacttaattatataccaaaactcttttatacctgcctgctgtgtgaagggaaaataagtcttgaggccgccaaatcaccaagctaaatgggagagtcaaactggtgttacaggagataggaagaaattattttggtagatagttagggtgacagaatttctgccgaaaacatttcttctaacaaaaatcagcttggcaattacttattttctattcacacagagttcaaagaaatcacttctaacaaaaagcagcctgaaagatcaggctgtaaaacatataagcaactctgccacagagagggtgtttctgggtgtaatcaccaaacttcacatacatacactgggccctagtaaaaacagtgggccttaatgagcacattcctttccttttctgggggcactataacatcagaaagctggaaacttgcacaagtttaggatgcctgcacttgcaaggaggtacctgggacctagcatggaaaatcctcttcccctttttagcactctgggagtggagccccagccttgggattcccaggtgtttcccttcagtgatcaggactgaacacacacaactcatcatgcagtttgtgctgagctgggttttccttgttggtattttaaaaggtgattcatggagaactacagatgttgagtgtgagtggacatgagtgagcaaaacagtgggtttgtgtggcagtttctgaccttggtgtctctgtgtttgcaggtgtccagtgtgaggtgcagctggtggagtctgggggaggcttggtacagcctagggggtccctgagactctcctgtgcagcctctggattcaccgtcagtagcaatgagatgagctggatccgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatatacacagaggggaagtcattgtgcgcccagacacaaacctccctgcaggaacgctggggggaaatcagcggcagggggcgctcaggagccactgatcagagtcagtcccggaggcaggtgcagatggaggctgatttcctgtcaggatgtgggacttcatcttcttccaacagtttctctaatgaacctccctaattttagaattctgtggttcctaatgtcatctctacatattttcaaaaggtcattttaatatgaggacataacctctcatgtaccaaatgcacattgatgcttacaaagatgaaaagttctcaaccattgtcaccaggatcgcagtcctgaggaagctcacgggtgtctgatgagtctcctccattcaggcccaggacagaaacctcagggagactcctggactagaacggcagggattctgatcacagccaatagagagcctgggccagggtcagtgtcctgtagaagctcacagggttcacatctgacccttctcctgaccctaaagccaatccgcatcagcactgatctggtgctccttttgctcccaatacatgttctttctttggagtgtttgttctcccttttttatttgcttttctttcttcctgaaaaagaaacacatggtctctatgctctacactccagggctcaaggcattttcttagaactcaggcaaggctcaggcttggctactccagcccacgtgggagaggctgatgggatttccttctctccccatattctcagggccctcctctgtgttgtgtgtagactcatctgggaatgcaattggccgttaatagtgaaggggataaactcatttgatcaaaatgggatgtggatgtggaattaaccctgttctatgcacactgtcagagtcatcttcttcagaagtagtgttagaaagagcttgtgaactttatcagaatcaaaatggatccacttgtgttaaaaccctaatgaatgaagctggggaaggccatgaaggagggttctaacacacatatttcctgataagaagaactatcataaatagaccctgcacagccacaaccttttacacagaggccaccacagccttaaaagctttatttctccaagtaaatctgccccgcaactgcctattcaaccttacaccgctatctcaaaatagctgctgtcaccctcctcatttttccttaattctcttttttattattttttaaattatactttaagttctagggtacatgtgcacaaagtgcaggtttgttacatatgtatacatgtgccatgttggtttgctgcccccattaactcatcatttacattaggtatttctcctaatgctgtccatcccccttcccccaaccccactacaggccccggtgtgtgatgtttcccaccctgtgtccacatgttctccttaattctttatcttccttttcctacctgaatgtacccatacatattttaattgaaacgcacatcctagaaaaaatattattatactttagagtctctgtctgttattcaggttgacatgacaagctacagacggacatgccacttttctgtgagacatagaggatgacagtttttggagatgtctaggaatatccaatgtccataagatcagccatcaataagtgcagactggaggtcccagagagaggcgaagctgctgaatcatcgtggaatttcatcttctccagttctgctctgatggaatcaggcccacccattttatcaatgacaatctacctaacctagagtcagctgatgacagtattaatatcatctattaagtaaagtcataactatatatatagtgagagagggagagagagagagacggagtctcgctctgtcacccagggtggagtgcaatgtcgtgatcttggctcactgcaacctctgtctccggagttcgagcagttctcctgtctcagcctcctcccagtatctgggaatacaggcacacaccaccatgtccggccaatttttgtatttttagtagagatggtgtttcaccacattggtcaggctggtctcaaactactgacctcaggtgacccacctgccttagcctcccaaagtgctgggattacaggggcaggccaccaagtccagctaatttttgtatttttagtagagaccaggtttcacgatattggtcaggctggtctcaaactcctgatctcagcctcccaaagtgctgggattaaagatgtgagctactgtgcccggccaacaccacctatattaatgttggattgaataactacaaagtctaccctaaccaagtgtaccatcaaacttaccattacccagaggaaagaatctttaacatgagatctatattcttaaatgttttaaggtgtaaaactgaccacagtacaatcacccaattatgattttggtaatgagttgtagaaactgcatgtatattttggatattaacattttttcagatgcacaccttataattatattctctcattctgtaggttgcaattttttccacactttgcgggatctttttgttgggaggtggttctgcttgttcaattctgattttattatctgtgagtttaatttgaaatatagaaaatcatccttttttatatactttaaattttagagtacatgtgcacaacatgcaggtttgttacatatgtatacatgtgccatgttggtgtgctgcacccagtaacttgtcatttaacactaggtatatctcctaatgctatccatatcccttccccccaacccacaacaggccccggtgtgtgatgttccacttactgtgtccatgtgttctcattggtcaattcccacctatgagtgagaacatgcggtgtttggttttttgtccttgtgatagacttctgagaatgatgatttccagcttcatccatgtccctacaaagggcatgatctcatcattttttatggctgcatagtattccatggtgtatatgtgccacattttcctaatccagtctatcattgttggacatttgggttggttccaagtctttgctattgtgaatagtgccgcaataaacatacgtgtgcatgtgtctttacagcagcatgatttataatcctttgggtatatacccagtaatgggatgggctgggtcaaatggtatttctagttctagatccctgaggaatcgccacactgccttccacaatagttgaactagtttacagtcccaccaacagtgtaaaactgttcctatttgtccacatcctctccagcacctgttgtttcctgactttttaatgattgccattctaactggtgtgagatggtatctcattgttgttttgatttgcatttctctgatgaccagtgatgatgagcattttttcacgtgtcttttggctgcataaatgtcttcttttgagaagtgcctgttcatatccttcgcccactttttgatggggttgtttgcttttttcttgtaaatttgtttgagttcattgtagattctggacattagccctttgtcagatgagtagattccaaagattttgtcctattctgtaggttgcctgttcactctgatggtagtttcttttgctgtgcagaagctctttggttctacatactcaaatcaataaacaaaatccagcatataaacagaaccaatgacaaaaatcatatgattatctcaatagatgcagaaaaggcctttgacaaaattcaacaaccttcatgctaaaaactctcaaaaaattaggtattgatgggacgtatcttaaaataataagagctatctatgacaaacccacagccaatatcatactgaatggacaaaaactggaagcattccctttgaaaactggcacaagaaagggttgccctctctcaccactcctattcaacatagtgttggaagttctggccagggcaatgagacagtagaaggaaataaagggtattcaattaggaaaagaagaagtcatattgtccctgtttgcagatgacatgattttatatctagaaaaccccattgtctcagcccaaaatctccttaagctgataggcaacttcagcatagtctcaggatacaaaatcaatgtgcaaaaatcacaagcattcttacacaccaatcacagacaaacagccaaatcatgagtgaactcccattcacaagtgcttcaaagagaataaaatacctaggaatccaacttacaagggatgtgaaggacctcttcaaggagaactacaaaccactgctcaatgaaataaaagaggataaaaacaaatggaagaatattccatgctcatgggtaggaagaatcaatatcgtgaaaatggccatactgcccaaggtaatttatagattcaatgccatccccatcaagctaccaatgactttcttcacagaattggaaaaacctactttaaagttcatatggaatcaaaaagagcccgtattgccaagtcaatcctaagccaaaagaacaaagctggaggcatcacgctacctgatttcaaactataccacaacgctacagtaaccaaaacagcatggtaccggtaccaaaacagagatatagaccaatgaaacagaacagagccctcagaaataatgccgcctatctacaaccatatgatctttgacaaacctgacaaaaacaataaatggggaaaggattccctatttaataaatggtgctgggaaaactggctagccatatgtagaaagctgaaactggatcccttccttacaccttatacaaaaattaattcaagatggattaaagacttacgtgttagacctaaaaccataaaaaccctagaagaaaacctaggcaataccattcaggacataggcatgggcaaggacttcatgtctaaaacacgaaaatcaagggcaacaaaagcccaaattgacaaatgcgatctaatatgaaattcttaatgagttctatagttataagtacattatttctccttattaaaactaatcttttttgctgaatgggtggaagatggtggcttccctccaaaagaaaacatagttggttctgtaaagagttcacccatttcttccactataggcctgccctggcataatacaagctcccaacttaagaacttatgattttccatccatgggagaagccatcttttccatctattattaaaacagaagacacttcattaatatcactcccaaaataggctatgtcatatccagtgaggtaggatggctgacagtggtgagaatccaagtaattggtcaagcactgctatgtgtgaagaaacaccacagcatactctacactgtcactcatgatatggaattgttgcctcctcagcaatgtaactgagcccttaatatgtggctgggatgacaaagcaatgccagcctgcagagtggaacctgttcttccttctgggattagccaaaggccggtggcactcatggctgaccctactttccttacaactggacgaagcgaagcaactggatatgaacttctatcccaggatgtaactgtccaaagtgccttctctttatgtcaactggaaaagtgtgaaagacagacactattctcataaacggatatcctagttattccacccactagccagctcttccccccaggtggcagtcatagatttagaattgcaagtagaggccctggctaagcataccaccagtccctttaacaacacctaccataccatcatcattcttactgaagaaacctcacagatttgacaagtgacactatgaagctatatgaccctaggtattgcaactacagccaaaggtaacacttgtgtattaatgaaccctgaatgttgcatatatatacaagattagtcccacaatataactcaagctatgcaagcattagatacccatatttctgctagagatggatgccctctctcaggaccctgcgacagcatggtttagttgacttcctaacacatggaagactttcatatatagtagagctggtatactcttcattgctatcttcagttgctgtggattttattggtaccttgcactttaagtgagaatgtaatactgaccttctcaaaaactcctaggtccttgcaccataatgctccaacaaacacctactgtaattccggagactccagaatatttccaactccagtttaatggattcccttccaatatatacaagctatgccctttctaagaagtagccagattgactatgacacacgttttccatagaaacaaaatggaatttgacagtggggaatgatatacaggcagcttaatttcaaaatgcattttaaacttattttttgaggttttaatattattttcatactccttgaaacctgaaatttcacacttacattctaattgagacttaataacaaataaccagaacacatgaattgcctgtaatctctataccttgtattgtaagccacatttcaagtgtaaccttacttgtcagcacagtatgtttaccataggcataattgcttgtcctgactgtccagaaggcagggtggtattaagtatgcggcctctggagctgggaagtctggctttgtatactgtctctgccactgctaactgaaggacaatgggccagttacttcctgtaccccagttttgtcatatgtaaagtagggttgttgtaagaatgaaattagttaatatttagtacctaacaactagtaggcattacgtggtagctattcgtattgctatcgtcagagaacacacaggagtccattgttatttttaccctccccctccaaacaaaatgtgtaagacactagacatggtagctctgtaacggggttcgtcatgtattaaactgtgtacccaaatgatatgtcaaagtcctgacaaccagcacttcagaacacgtccttatttggaaatatggtagctggagatgttattagtgaagatgaggtcttacttgagcagggcaggccctcaatgtgggaagatggttgtctttctaagtacaaggaaatttggacacagagacagagacatacagtgtgccatatgacagcagagccaaagatcagagtggtgcagcagtaaaccaatgcatgtccaggattaccagtcacctccacaagtgaggaaagggcaaggaagaagtctcctgagtctcagagggagtgcagcccagctcacacttgattttggacttctagtctctagaactgtgagacaatacagtcctgtcatttttaagccacccagtttgtagtatttcattttggcagccctacgatattcatacagagttcttcacccaaaaggaagcactctttctcacaaacagtcaaagtcctggatgacggacaacctggagattgcaaacctccaaggaatcaaaggaggttctataaagtctaggagccccatctttcaaaggctgctcctcaagtccacacacacactttggaaggagaatcctgctcttggacatgggatccttagtgagccaactgccaataatccaacatcatcatgaattaaagatctctgacatttcctcgtcaccaacgggaattctgtcaagtagtaagtaaaacccttcttcaggaatctccacaccaaacagttctgcatggcttgggacgcctcaggaaacttataatcatggcagaagaaaaaggggaagcaaggcagtcatacatggtggcagaagagagaggttaaacttttcagtctctcttgggtgtaaagatacaatcttgaggcaaacagcagaatcaattttcttatgccttgaaattctccctttcaccataaatattcccttcacattaatctaactttatgtttgcatcgaactatgtgcctttttggaagttccggaagctaatttgagacagatagacaaagtcgggagaccctgatgcagaattccagaggtgacttcaatgttgctagttaacaacccaggcattgcccagatgatgccagcccaagatccaggtggactgggatgccagagagctgccagaacaagacgcacagacctggttctcagcccaaatcttgcatgcctttcttaccaactttcccttttttaaacccctgcctttccttcaaaattgaagtggttgcttgggatgggaatgcgttcacttcccctttaccattatggttaatacaataatttttgtaccagatctctctcttgttaattggatcctgcaggtggcagattccggaccagagtgacgttagaaactgaatgcacatactgggtggttcacagacacagtgttctgtgaagtttatgggtggattcctggggaagcctgcaagcctgttagtgattagcagaaccgcatccagctactgggatctgcacgccaggtgccgtgagcccctcaccatgttccctggtcccagctgcccgcggatggttcagccttgacaacgggctcggtgttctgggtggtgggagagcaagggggccccttggggagcgtgctacagggctgtgaatccaggggcccacccggtgttccctgtggagtcactgagggaatgaggggcttctcagggcacagagctgtaacgcctttgtgcagtggtggctgaatacagtgacactgggcgcgtggtgagaagcggggcaaggtcagttcactggaccctccgccctgagcctcagatgagtcgggggtccccagacaggcccggtctctgccctgcggcggacactggagcctttgctgtggccgccaccgaggagccttgacctcaaaggagggggaacctctctacccacctcggaaacctgaagggagcggcggtctctcccagacaggatctcgccggcctccgcgtctccaggcccaaccctgtaccacataaaggaagtccgcgctgagctaccgggacacagcgccgttgggtgggcgggcgcggcgcggcgggaagcaccggggcagctgccacagagatgcgcggggactgtcgggaagtgggcggtccgggaggcgcggggctgatgggacgtgggcggtccggggacgcgcgggggatggcgggacgtcggcgatcccgagatgccagggggcagctgggacgtgggcggtcttgagaggcgcgggggcagctgagatgcaggtggtcccgcacgcgcgggggctggcgggttgtgggaggtccagggatgcgagggggcagctggtacgtgggagttccggggacgcgtggggtcgccaggaagcggggtctaggacttagatccgccttctcttcaggccatgcagccccgaagctccgaatcctgggatgactcctgtccatgttggaagggaccctgccagtcctggcaaggttcaacggccttagggcaagaaatgttagtagagtcctggaagacgatgtggggaacgggtagcggccaccggatggtgatcgttcttctacaagaccttgacatggatggggagaaacagagaagaaccttccaagtttgtcccactggacatgcccaccacactttaccagccctttctagaaggcctgtgcgtaacacatgaaaaagctgctctcgacctttccctgaccttttaaaagaaaacatttgctgcatctaatccgcctagatgtaaggaggttcccaaatgtatgacagagtcagacaattacatgtcttgtaagttaccatgtgcttgtcttttgttttccgttttttttcgtttttttgttttttgtttttgagacggagtctcactctgtcgcccaggctggagtgcagtggcaggatcttggctcactgcaacctctgcttcctgagtttcaacaattgtgctgcctcagcctcccgagtagcttggattacaagtgtgcaccaccacgcctggctaatttttgtagtttttagtagagatggggttttgccacgttggccaggctggtcttgaactcctgacctcaggtgagccacccaccttggcctctcaaagtgctgggattacaggtgtgagccaccgtgcctggccgtaagttaccgtgtgctttttaaacaaatcatagcaaaggggtgtcttctggaaatgacattttgaaatggagttactagaccacccctggaagggacacagtaaccacacgtccacgttcgttcagtgggtgagaggacatggaggggagacctgggcaggaagggaagagggttccatgccaggctgctcatatttaaaagacattttcattgtagggacatggatgaaattggaaaccatcattctcagtaaactatcgcaagaacaaaaaaccaaacaccgcatattctcactcataggtgggaattgaacaatgagatgacatggacacaggaaggggaatatcacactctggggactgtggtggggtggggggaggggggaaggatagcattgggagatatacctaatgctagacgatgcgttagtgggtgcagcacaccagcatggcacatgtatacatatgtaactaacctgcacaatgtgcacatgtaccctaaaacttaaagtataattaaaaaaaaaaaaaaaaaataaaaaacattttcatatcgttgtcattgttttcttgtgtgcattttattcctcgctattgtatacatcattggaaattctaagtattcttttgaaatatctagtctttctagatgttctgaagtgcctgatgtatgttaaaattacaggtggtaaaataataaattttgtaaatgtctttttgttaaaattcatatgcagtgttttattttattttgatgttggtggggggtggggaggatggccaaatccctgcttgatcaacacacattgcgtttgtgctctgttcaggggaggagagaggaggagaaagtgcagatttccaggcttctgtgcgcaccgggaggagagattaatgatcatctcttctgtctgtgtgtttgttttatttatctatggatatcctgtgtataaaggatgaacaagtcctatttataacatctaatcttttcaggtgttaagttgccagcgtatgacggaagtagcattattaaacgaatgcagcttgtacatattgtgttaaaattcataaaaagccagtcttctgaaaagaacccttgggccctccctccgcagcctccggcgccagctgcaggaagacctggccaggggaaggcgggcggcagaagctgctgctggctgtggggaaggcggtggagcccaggcctccacaggctccccacaggctccccacaggctcgcgcggctctggttgctgggctccgcacgggccgcgtgggggcgcctgctgggagcgaggaggcgccatcctggctcgcctgctccaggaggacactctgggcctgcgcagatgcagttctccaggatgggcgcgggcgctgggggcggcgctccttgggctgctgcgcctccactgagccgcctgggtgtgaggacctcgcgccggcgcctccgggaaggacgcggagccgccgcggccgatcccagggctgcagctgctgcccgacgcccgcgggaaggcccttccgccaccgcccgggggttcgaacttggagcagctgctgccagctgaggcgccagcggcgtcgggagctcctcagagtcagtgttttgtgctggattcggcatgtcctctgaaaactcgggaatttgtcactgaaatggtgacaggaggtgagaagtttttttagacgttgccttcgctggcctgacgcggggctcagacctggaatcccaacactttgggaggctgaggcgggcggatcgcttgagctccggaggtggagaagctgccttcgtggtaactgtggtcttaagttcagctgagaacgataaatggcttttccttgaagtggctgcttttgtgatttctctcaggctcatcttttgtcagttagaaatccagtggtaggtgtagcttagagacgggaaatttttggttttgttttggctacacgtaagtgttggaaattattttctttaacgttccagtgtgagcaaatccagaaggatgtcagattaaacaccgaatttaacaaattcaaccgggcacggtggctcacgcctgtaatcccagcactttgagagaccgaggcgggtggatgatgaggtcaggagtttgagaacagcctgaccaacatagtgaaactccgtctcttctaaaaatacaaaaattagccgggcgtggttgtgcgcgcctgtaatcccagctactcaggaggctgaggcaggagaatcgccgagattgcgccactgcactcagcctgggcgacagagcgagacttcgtctcaaaaaaacaaaaaaaaatcaatcattggaatactgttgttcattacaattaatgaacgtttgatagacgcataaacgaactaaattcacaagtacatataagtaaaataagccaaaaaaaaaaaactacatcccgtatgatgacacttttatacattctacagaatagaaactaaagtgatatgaaggttgggagttgaatggagaaaaggtgagcgaaaagagggaggacggaggagttgcaagagaacaagagaaaatgttgagggtaattgatctgttttctatcttaataatggttatggttacatcaataatttctaaattgtacattttgtgtgttaattataattttatattattcaagctattacaaataaatacctgtataaatttcttagggacggtttaagggagatggataaatcacataaaaagtcagatatttctgaatgtacaatgaataacccttagctctatctttattttttggtaattcttaaatgcagcagatttttttaatgtttttattacaagaagggtttcttcaaaccacaccaggtgtgtgtaactctgggctaaagttggttaagggagcagtgggatccggtggagaggagcacaggcctcgatcctggagcccattcttgtcacatgtgagctcctggacacatctcatagctccctcatgcttctgcgtttacattctcatctgtaaatggaggaccaatgggcatctgcctctaacaatgtattttcatgtgttaagatgatgtatgttaagtgtttactatagcacaatcttttaataagaaattacatttttttccaaatactatcattgtcttcaagcgccaccaaccaccagaaaacttaatatgctctgtgccctgccctgtcctcagacatccagcccaagagacttttatatagtaggagatatgcaaatagttccctccctctgctgatgatgaaaaccagcccagccgtgaccgtgcagctctgggagacgagctcaagtgccaggattcccaagtgttttcacttggtgatcagaacttaacacagaggaatcaccatgttgtttgggctgagctgggctttcctttttactattttaagaggtgatacatgaagaactacagatattgttcgtgagtggatattagagaaacagtggatatgtgtggcagtttctgaccaggatgtctctgtgtttgcaggtgtgcagtatgaggtgcagctggtagagtctgggggagacttggtacagctgtggtggggttgggggtgtcctgagactctcatgtgcagcctgcggattcatcttgagaagcaatgacatgaactgggcccaccgggcttcaagaaaggggctggaatgggtctcatacattagtgctagtggtggtagcctatactatgcagacactgaagggtagattcaccatctctagagacaatggcaagaacatgctgtacttgcaaatgaacagtctgagagatgaggactcggctgtgtgagagacatggtgaggggaaatcagtatgagcccagccagaaacctccctgcaggaaccctggggtggggggaaatcagctgcagggggcactcaggacccactgatcagaatcaaccccagaaggaggtgcacatggagattaggggctggattccttccaggatgtgggacttcaacttcttctgacagtttccccagggaaccgctctaagtttagaattctgtgtcatctctatgtatttaaaaaagatcattttaatgtgaggaactaactattctcacatgcacaaaatgcagattcacactcacagagatgaaaagtcctcaactgtggtcactaggatcagagtcctgaggaatctcaggcgttcctggtgagtcttctccaatcagacccaggacagacacctcagtgagattccatgactagaacaggctttatggattttaaaaaatagagactgagccagggtcagtgtcatgtagaacctcacaggtttcacatctgacccttctcctgacgctaaagtgtgcaaatcagcatcaatactgatctggtgctgcttttgctcccaatctgtgttctttcttgagttgtccctttttcatttgcttttcctgctccctgaaaaaagaaagatgttgtctctgtggtctaaattccagggctcaagcccttttcttggagctcaggtgggtctcaggttgtggctcctgcagccacgctggggaggctgatgggactttcttctctcccattgctcagggccctccactatattgtgtggagactcatctcagaatagatgtggccagtgggagctgaaggggacaagcttgtttggtcaaaatgagatacaaatatggaattcaccctgtgctgtacaaactgtcacagagtcactttctgaaacaatagtgttagaaagaacttgagaaagttgtcagaatcaaaattgggtcacttgtgttaaaactctgctgaatgaagctgggaaaggccgtgacggaatgttctcatgctcatatccctgataccaagaactatcgtaaatagactcttaaaaccacaatcttgcacaaaggtgcccacaaccttaaaagaattacttctctgagtaatcttcccagcagctctctgtgtaagattggacttgatgccacccttgttattgattcttctatcccggagaagttgtctcaaaacagcttatgtaaccctcctcatttttctttaaacctttatctttctttacctgcctgagtgaacccatgcatgttcccattgcaatgtccatcttcaaataattatcattttactttagagtctctttttgtctgttattcagatttgacaagctgcagatggacacatcacgtttctgtaagacttaggggatgacagttttgaggcatggctggggaagtacaatgtccataagattgaccctcaataagtgcaggctgtaagtctcagagctgaagctgctgaatcaccatagaatttcatctttagttctgctctgatggaatcaggcccacctgtgtaatgaatgacactctacctaacctagagtcaactgatgacaggttaaatatctagacagcaaatttgcaacaccacttagattagtgtttgaataactacaaagtatagccgagccaagtatatcgtaaagcagactattatacatggagaatctttaacatgacatctacaattcttaattttttttacgtataaaactgatggttttacaatcaggctgtcatgattttgctaatgagttgtagaagttacatgtatgttttaaatattaacagttttttcagatgcctggtttgcaactatattctcccattctgtagatttggaattttttccatgctttgcaaaatctttatattttgatgtagttccagtccttcaattctgcttttgttgtctgtgcttttaatcttaaatttaggaaatcattgctaaccttttggtgggagagaattttacaattgcaggctatacatttaactgtttaacccatctagagttgattttttgtgtttattctaacctaatattcttaactatttgcaagtgaaaacccagtttgtttaacaccctctttaggggagagtatgatttagccgttgtgtagaaaatgttataaatcactttgccttcatattggttctcaacttgaaaatgagtttgccatcaatacgtgggtttatttctgagctctctatatgtatttatgccagtaccatcctgttttgattatgtttgtaattaattttgaagtctgagagtaaaatgcctccaagtttattcttgcccttttgcagatattagacaaaatattttaacatttcaccatgaagtatgataacagctatggcttttcataatgaattttattgtgtttaggttattttcttgtatttctattttgggtagagtttttatggtgaaaccttgaatttttttaatgttattttctgtctgagaagttaatgggaccttcttcgtatttaatttggcataccaaatgtattgatttgaggattttgaatcatctgtgcatctcaaaaataaatttgagttggtcatggtgtatgatccttctaaagtcctgtggaacttagttgactattatttggtgtgtggagggggctcatttatgtctactaggaatattggtctgtagtttacttttttgtgaccttgtctattactgaaaatacggtaatttgggccttatagaaagactggaaggttggcatctcaccaatttttgaaaaagttagagaatggttggcattacttctttaaatgttgagagtcctttttttacttaacatgtgacctatcatggagaatatttagtctttgcttcggaagcatacatattacactgctcttggttggaaggttctgtagatgtctattaggtcaatttgttcaatagtgttgttcaagtccactgtcttcttaagaattctcttaatgatgttctatccatcattgaaagtgaggtgctaaagtcttctcctaatttttattattttctatttatctctccatatctcttaaggtttgcttaatgcagttatatttatttttgtacaaatatgtaaaaaataaatgaaataataattgctaagtaattttaatggcaaaatcacataataagaaattatattttcccaaatgctgtcattgacactaagctcctccaggaatctcacatctgctctggacacggctctcctggtgtcctaccccagagcttgctatagaggaggagacatgcaaatagggccctcactgtcctgatgaaaaccagccttgcctgcgtctacgggagaagagccccagtccagaagtaccaggggtttccatttggtggtcaggtctctgaacacagaggactcactatggagtttgggctgagctgggttttccttgttgctaatgtaaaaggtgactcatggagaactagagatattgagtgtgagtggacacaagtgagagaaacagtggatatgtgtggcaggttctgaccagggtgtctgtgtgtgtttgcaggtgtccagtgtgaggtgcagctggtggagtctttgggaggcttgttatagcctgggggtccctgagactttcttttgcagcctctggattcacctttagtacctttattaggtactggatgagctgggtccatcaggctcctgggaaagggctggagtaggtctcatttatgagttgttgtgtaggtagcacaagctatgcagactctgtgaagggtcgattcaccctctccagagatgatgccaagaaatcactgtatctgcaaatgaacagcgtcagagccgaggataggtctgtgtattactgtggtggcattgtgtgcatcccttgtttaggtacatgcagagatgctgctttggtgtgttcaggggctcctgttttggggacaccaattttggagtttgcagtatccttgagtccagtacgttcatggtggcattgggtctggggtgtgcagtggcaatgagtccaggatacatgcagctgatgccgtatcttgtgaggacaagaacaactacaaaacgatcctattaataaataggcaaatgacttgaatacacatttttcaaaaaatacatacaaatgacatatagatatataaaatgttaaatatgagtaataatttttaaaattcaaatgtaatctacaataaattatcaccccatacctgttagaatagctatttttaaagaagatgaaagataaccagtattggggcagaagtggagtaaagggagcctatatatattgttactgaaaatgtcaattagtacagacattatggagaatactatggaggttcctcaaaaaataaaaatagaactaccatagtttccaacaagcccactactggctatgtatccacaggaagtgcaatcagtatgtcaaagagacatctgtgcccccacgttcattggaggaatatttatgatagtaatgatgtgggaacatcctaaattaccataaatggatgaattactaaagaaaatgtagtatgtacccaatggagtaatgttcatcctaaaataagaagggaatcctgcatttgcaacagcaggcatgactctagaggaccatatgtgaagttccacaggcaggcgcagaagacaagtaattcgcgatttcactgtagtttgtttaaatggtagactcacagaagtagagtggagtgttggttaccaggggctggaggggtggactggaaaaggcgagattttggtcaaagggtgaaatgttccagttagacagaaggagaaagttacagtgttctaatgcacaagatggaaaatatggctaataatgcattatatatttcaaaatggctaaaaatgcaaatgttaaaaattttctcactaagaaatgatacagcctgggcgcggtggctcacacctgtaatcccggcactttgggaggctgaggcgggcgaatcacaaggtttggagttcaagaccagcctggccagatggtaaaaccccgtctccactaaaaacacaaaaaatagccaggtgtggtggcacgcggttgtaatgccagctactcgggaggctgatgcaggagaattgcttgaacccgggagacagaggttgcagtgagctgagatcatgccactgcactccagcctgggtgacagtgagactccaactcaaaaaaaaaaaaaaagaatgaaatgatagctgtgtgaggtgatggatatgtcaaatagcttgattaacaattccataatatatacatgtatcatagcatgtgtgaggtgacctgtatgaaggtgaagtgacctgggggctgtgtaagattacctgggggtatgtgtgaggtgaacacggcacatatgaggtgaccagagacacatgtgaggggacatgggagatatgtcgggtaagccagggggatttgtgaggtgacacagagcaagtgtgaggtgacgtggatgcatgtaaggtgatttggggcacatgtgaggtgacgtgggggatatgtgtgagctgacctcgggtgagtgtgaggtgatccaggatggatgtgaggtgacctgggggtgtgtgtgaggtgacttgggcacatgtcaggtgacatcggggattggtggtgatgtgggtgtgtgtgaggtgacctaaggaggtatgaggtcacctggggcatctgtggggacctggaaatgtgtgaggtgggtacaggtgaagtcacctagggcacatgtgaggtgacctgtggaatgtgtatggtgacctgggaccgtttgaggtgacatggggaatgcgtgaggtgacctggggcatgtgtgaggtgacaaagggcatgtgtgcagtgacctgggtgcatgtgaggtgacctggtgcatgtgttaggttacctgggggatgtgtgaggtgaacaggggcaggtgtgaagtgcctgaggaatgtgtgaggtgaactggtgcatgtatgtggtgacctgggggatttacgaggtgacctgcgggatgtgtgaggtgaccttgggtgagcgtgaggtgacctgacgtatgtatgaggtgaccagggtgtgtctgaggtgatgtggggtatatgtgcggtgacctggtggatgtgtgaggtgacctgcaggatgtgtaaggtgacactggggatgtgtgaggtgactcagggcacatgtgaggtgaaattggggatgcgtgaggtgattcagggcatatgtgaggtgaccttggggatgtgtgaggtcaccttgggtgagtgtgtggtcatctgggatatttcccaacttcgtaaggaaagcctgcaacaacacatggcattagaagcttcacactctagcaccattaatgcgtacatcctcaaggaactctaaatgttttgaggttagcttaaatgccatggagcggcaccttccccaggcacactcatatatgcatcctgggtctccctgccaagctgtatctcctcaaatttacagtttatgtttgctctgtgacatcaactctgatatgttcaagtgtgtttttttttctttatttgtagttgttcaggcttgttgtttcactctcattactctgggctcagtcctctcctcaggtgtcccacttcagagctcgctgtgaaataggagacatgcaaatagggccccccctttcctgataaaaagcagcccagtcctgaccctgcagccctgggagagaagcaccagccctgggattctcaggtgtttccactttgtcatcagcaacaaacaaattaccatggaatttgggctgagctgggtttttcttgctgctattttaaaaggtgattcatgaagaactaaggatattgagtgagtggacatgagtgagagaaacagtggatttgtgtggcagtttctgaccagggtgtctctgtgtttgcaggtgtccagtgtgaggtgcagctggtggagtctgggggaggcttggtacagcctgggggatccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaacactgtgagaggtcggaagtgtgagcccagacacaaacctcctgcaggaacgttgggggaaatcagctgcagggggcgctcaggacccactcatcagagtcaaccccagaggaggtgcacatggagggtggggtttgtttcctgtcaggatttgggacttcctctgcttctgacaggttctctagggaaactctttaattttagatttctgtgcccaccaatgtcatctctacatttttttaatcattggttttgaggactcggtctcacatgcacaatatgttttttgccacctatgggaatgaaaggtcctcaaccctggtcaccagcatcagagtcgtgaggaagctcaggggtgcctggtgagtcttctccagtcagactcaggacagtaacctcaaggggattcccttgtgagaactcacacattttcatgagaacagcaccaggagtcagttcttaaccattcatgaaagacccactccatgacccagtcacctcccaccaggtcaccccttcacaactggggattataatacaacatgagatttggggcaggacacaaatccaaaccatatcagatacacattgtgaaatacgcatggtggtcaggtaatttgtatttctatcacctcacagcgctaccattttattattttttttaatttactgcatgagtgagtgtctgatgagaacacctaagatctaccctttcagcaacaatcatttttacaatacagtattaactataggaccattgctgtacgttagatctccagaactcatccaacctgcacaactgaaactctgtacaatttaacacacatcacccaatttccctcacctcccaggtcctgggacccactattctactctctgctttcaagagcttgaatattttagatcccacatgtaaatgagatcatgcagcatttgtctttctgcatctggcttattcaactcagcatcatgtcctccaggcccatccgtgttgttgcaaatgtcagaatttccctcttttcaaagccaaacaaaatacagatgtatgtatacacattttctttatacattcatccatttacagtcattaaattattttacaaatctacactattattaataatcttgcaatgaacatgtctttggcaaagtaattttatttcctttgcatatataacaagaagtgggatcaccagattatatgatagctttatttttaacttatcaagtaaccaatcctaccacaggatatttccctttcccccacattcttgccaacatttgtcatctgttacatttctgataatagccatattaactagtgtgagttgatattgcattgtgcttctcatttgaattcctctgataattaggaatgttgagaactttttcgttttctgtttgccatgcatgtatcttctgaaaaaaattatccaggtttttgcccttttttatcagttcatttgttatttgctgttgaggtgtatgggttatttatacatttggacagaacttcttgtcagatccataattgcacatagtttttcctgtgctttgttattaaattcaaagaaatcagttccgaattaatggcaggaattttttttgctccatgtcatttatgagtttatggcttcaggtattatgtccatttttagttgaatttttttttttttgggagacggagtcttgctctgtagcccaggctggagtgcagtggcgcgatctcggctcactgcaagctccgcctcccgagttcacgccattctcctgcctcagcctccgagtagctgggactacaggcgctggccaccgcgcctagctaatttttttttgtatttttagtagagacggggtttcactgtggtctccatctcctgacctcgtgatccgcccgcctcggcctcccaaagtgctgggattacaggcgtgagccaccgcgcgcggcctattagttgatttttttatatggagttagagaaggcctaattttatttcttttgcatatgaatgccagttttacaccattattgaaaagactgtcctttctctactgtgtgctcttggcacacaaaatcaggagagacataatgacaaaaaaaaatgagatcaatagtcctgatgaacatagacctgaaagtcctcaacaaaataccatcaaattgaatccagaagcactttaaaatgtgatacatcatggtcaggtgggctttacccctgggatgcaaggctcgttcaatatccacagtaactctgattcacaatgtaaacagaataaaagcaaaaagcatatgattatgtcaatagatgctgagaaagcttccgataggatctaacatctactcatgataaaaaccctcaacagactagacatcaaagaaacatacttcagaataagagccatctacaacaaacccacagttaacatcatactaaatgagccaattaaaacacttatctttataaatgacccagtctcgggtgtttctttacagtgcgagaatggactaagacagcatccaaataggaaaggaagtcaatccgtccatcttcactgatgatataattctatatctagaaaatcctaaaaactctgccaaaataattctagaataaacaactttagtaaagtgtcaggatacaaaatcaatggacaaaaattaccagcatttctataagccaaccacatccgagctgagagtataatcaagaacacaatcctattcgacttacagtatccacaaagaaaatgaaatgcccgggaatacagataacaaagtgaaagatccctacaaggagaactatgaaacacagcatacataaatcataaatgatacaaataaatgggaaaacatttcatgctcatggattggaagaatcaatattgtaaacattgtcataatgcccaaaggaattcagattcaatgctatttacataaaactatcatcatcattcttcacagaatcagaaaaaaatctattctaaaatttatatggaaccaaaaaagaccctgaatatccaaagcaatcctaaggaaaaagaataatgccagaggcatcatgatactgaccttaaactacaccataacgtcttgctaacaaaaacagcctgtactggtacgaaagcagacctgcaggaaaaaaaatagatcaaaatagaagacagaaataaagttgcacacctgcaaccctttgatctttgacaaagctgacaaaaacaagcaatggaaaaaaaaaactctgtgttcagtaaatggttctgggataactggattctggcaggtatgcaaaatgcaagagtgaaggagcctgtgcagcttctacctagatttcagatgtgtagagagccctgcatgcccaggaagaagcctgctgcaggagtggatccaccacagaaagcctctactagagcagtgccaaagatggggaaagatggagttggagcccccattcagagtccccactagggcacttcatagtaaagttgtgggaatgtggccacaaccctcaagaccccagaatggtagagctacgggcagcttgcaccctcagcctagaaaagcttccagcacttgactctcacttgtgaaggcagccccgtggtctgtgcctagcaaacctatagggattggctgcctgaggttttggggacccaatccttgttccagtgtgccctggttgaagtacataaagtcaagagagattattttgtagcgttaggatttaatatctgcagtgctgggttttatatgtgtgtggggcctgttggttgttcctttggccaatttatccctttgggattggaattatttacccaatgcctgcatcatcattgcaccttggaagtaaacaacttttattttttaaatttgcaagctcacagctggagggacattgccttaagactcagatgagactttgaaaatttgagttggacgttgatgaagttaagattttgggcactattgaaaaaaggtgattatattttgcaatgtaagaagaatatgagaactttgggtccgagagtgcaatgatataatttaggggttttcccctccaaatatcatggtgaaatgtgacccacaatgttggaggtggggccaactgggtggtttgggtcatggggaaagatttttcaggactggcttggcatccaccccatggtaattagtgaattcttgctgtattagctactgtgagatctgattgttcaaaagagtcttgcaatcctgctaccctctcatgtaacccctcctcacaatatgacacagccatctccccctttgccttccaccatgactgtaagcttcctgaggccctcacaagaagcagatgctggtgccatgcttctcacacaacctgcagatctgtaagccaaataagcctcttgtctttgtaaatcacttggcctcaggtattaatttatagcagtgtaaaatagactaatacactgcccaaagcaatatacagagtccatgcaatttctatcaagtaactaattaattatgtatttttaaaaatcctaaaatttatatagaaccgaaaaacactctgaatagcaaaagcagtcctaaccaaaacgaacaaagctggaagtaccacattccctgacttcaaattacacagcacaaagataataagaaaggcagcatggtagtggtagaaaaaaaatcaagagcccagatatatagccaaatatctacaaccaacagttctttgacaaaactgacaaaaatatacactggagaaacaaccctctattcaataagtagtgctgggagaattagatagccttatgtagaagaataaaatgagacttctgtatcatcatagacacaaattaactgtgaatatggattcaatgtttataaactcataaaaatacttgaaaaaatctaaaaataatcctctggacattggcctaagcaaataaaatatgactaagacttcaaaagcaaatgcaatgaaaacaaaattagacaaacaggattaattgaaccaaagatcatctacacatcaaaagaaagaaccaatatggtgaacagacaacctgtgaatggtaaaaaaaaaaaaatgtgcagtctattcatcaaatatatagatctacaagtaactcaaataagtcaactagaaataacaacttcataaaagagtgagcaaaaacgagatatttctcaaaagaagacatacaagtgttcaacagaaataaaacatgctcagcatcacaaatcatctgataaatgtaaattacagacaacatgatatagcatcttccaccagtcagaatggctattaaaaataaaacagatgtttgcagagaagcataggaaaaataatgctttttatatgcttgatgagaatacaaattggtacaacctctatgaaaaacaatacagaaatttctcaaagaactaaaattagaattaccatttgacccagtaacccctcctggtgggtatgtttctcccaaaaggaaacttctatataagaaaaagtcacctgcattcctatttttattgcaacactattttcaatagaaaagtcaagtaatctctctaagtgtcaatcagtggatgattaaataaaatatgatagatgtaaatcatggaatactatgcagccataaaaaatgaaattgtgtctttcacagcaacatgaatagagttgaaggacatttcctaaataaaataactcaaattctcttttataattggaaagcacacaatgggtacacatgtacatagagaaaaacaatagacactgggtactgcaaaagaaggcaaggtgagaggaaagtgagggttaaaaaatcagctattggctccaatgttcactatggggtaacagttacatcagaagcacaaacctcacctttatgaaatatattcatgttacaactctgcacatgtgcaccctgattctatgaaaataaaaacagaaaacatgaacagaattgttagactgctagctagattgaccaacaaacaagaaaaatgcaaaagtagcaattctttgttttgtaaccctttctcattttctggtaccataagaaattgtagactatcgtcctatattcttttctgaagtgctaccattagccatttctcaaagaaattctggttccttttttcttttattttctttcattttttttagacagagtctgcaacgtccacctcccaagttcaagcgattctcctgtctcagcctcccaagtagctgggattacagacgtgcaacaccacacctggctaatttttgtatttttagtagagatgaggttttgctatattggccaggctggtcttgaactcctgacctcaaatgatctgcccacctcagtctcctaaagtgttggaattatgggtgtgagccactgcacccagccgctggttccttttacagaagaatagtattaaaaactcatatcttgattcttgatgtactttttgttaatttcttgtagaacatctcaagtaatcaatacaggaagtatttgttgtgtattaacccatatatatatatacccacatctaaacggtttttatttatgttcctatattatgctaaacttgcaaatccactgagataccctaagttaataccacatgaatgattttcaccttccttctatgcctttccctaacctagcactccaaccgtggggaaccccctcccaccacacaccatccattccctttgtagtccatttccaggattcctgtagagtggaacccgattgtgtaagttgtgctcttttgtggaacatcatcaagtggagtccagtgctgacgtgcagtttcttttttctttaatcttatggactacactatttctgaacctacttagtacctcttttgatttcatacattagtataatggcataagatattttctatatagtctgcattccatcctggaattcctaatcacctatttttttaaaatttcttgtggattaagattgtattagtcagtgtcccctagagggacagaacaagtaagatacacatacacacacacacacacacggagtttattaaggagtattaactcacactatcacaaggtccacaataagccatttgcaagctgaggagcaaacaagccagtccaagtcccaaagctgaagaacttggaatccgatgtttgagatgaggaagcatccagcaggggagaaagatgtaggctggaaggcgaagccagtctaatcttttcatgttcttctgtttactttttattctggccacacttgcagctgattagattgtgccacccagattaagggtgtatctgcctttttcagcccactggctcaaaggttaatctccttcggcgacaccgacacagacacacccgggatcaatactctgcatccttcagtgagatcaagttggcactcagtatttagcattacaagtccaccctttgtcaacttgaacccatacacatctcctgagattatacataatcttcaaataaagacaagaataaagtcataattatgcctaataatacaattattcttcttacaactggaaacacaccaatccccaatccaaatggtactacatatgctccactccctcaaggacacagccaggatcatctgatgacttggtgtctagatggcttcagcacttttaattttacctccaatgttagactccactttatcaatgcagatgtagcagaatattttaagacattgatatgctgaaaaattcaacagttcataaaagttgccttcccaccacagccagtggttactactgaataaggacctgccatcctctagggagaagctataatggatggggtgcactgttggtggttatggaaatcgatccatcgtggcaaatggcagcatctttctttgataacattatattctattgtgcatatataccacattgtctttattcatttgtctatctactgacagattttttccatatgtttgctgttattaatagtgtttcaataaacataggatgcagatatcttcacaaggtggtaatttcatctcctttggatatactcccagaaacaggattcctggtcatacaatatttctggctttaattcatttaggagcctttatactgctttccataattgtgaaaatgtagaatggtatagccattatgaaaaacagtttcagttttgaggtatgatctgtaaacaaataatgtttgttatggctctcaatgagagtttctactaaatatgatggaaggtcaggaaggtctctcaccttaaagcagggatggattatgcctcttatttcctaaaagcaaaagattggaagcatgcatgatggaggtggttggcaggtttcaggatgatctcataagaggagaatctgttggataaaactgttgggttttcagtcatagacacacctacactcaatatgaaatgatgaaatcaagtgaggatctagaatgtgttcgcttgaagcaacagcatattctcaaaggcacctattgctccatcacaagggtgatgaacttttgaaaccagtaaagtgtgagagcacagtaagtgataaagttatcacatttacatgaagtttgtttaatgtgccaagggctcgcacagattaatcataaataaacacaatgtattttagcatacatagatgtctagagaagaatcttcttagagaaacttcttcaggttacagaaatctgtgtaagttgtagatctaatggagaagtgtctatgaatactggtctgtttttgaagtatggaaagatgatctcttttggagtaggcttgcgattgtgttgatttcttaattgtttcttgagttgtaacaaaagaaccaaaaaaatgactaaccggagtttcatggctgtgttgataaaaatttttcataagctttctgtcaattatttgagaccagatttcctgatttttttctccaatagatacatgttcacaagatctcaggaaaccacctctcaggtgctttagtttaaaagactagcttcctagaaaaagaagattctgtctaaccatgacaagttggtttcatctgcaaaccatcaagtttgagacctcattgtcaagaatcataaaaattttaactccaatgtactgaaaatcataaatctcgaatttaatgttgataggcattgacaaaatggttcattcttggatgcgtcctatgttgctggctcaacatatcagttaattgagaatcctcacttagctccctctgtttgtagcactgagttgattgtcaatcttcagagtcatccgttgaaggagagtcctgaggttcatgggattcttgtagacactcaggggaacaaaagaaagaaacagaattgagggctgccagccatttccacatcactaggaataattaccatctaagtataaaggtctgcatcattcagaacaccctgcatgacaggctgatgcaaaaaatccaaccctacagaggctccacagcaacctttacagttctttccgggaagaaataatctccaagttaagtgagtcagtaaagctgctctgagctacagtaaaaattggattgggcccgatttgtctgagttcagtgtaattattatactcagctgctgccccaatatagactgaggatggataatttaaatgagcctggctatgtggtttgttatatatctgaactaaataaacataaagggcctgtctggactagcgtgagggtgagagatcctgggagccccagccccccatactcttatctcccttcctccaggaacctctaggttctcagggtgagaatccacaagatccattcatggctctattaccaggagaccaaaatctctgaccttgttcatacagacaaacaggcgaaggacatttttagatccttatctatgtggcgaaaggcaatctatccccattacaagccttaccagcaaccttcctttgtcatgaaaatgggtaaaattagccaataagattacatttaagaaaattttcctgtgatgttccagccagaaaacagcaaaaatcagcttcacacctggagacttcttgcatcggtcacagcccagagaaagaagatcaccatagcattaaaatgcaactgtaagaacatgtaatgcttccatgttccacgcattacgtctcaccagtttagtcaatatggattaaatatgagagtgtggcaattcgcaaactctatctgaggaggaaaatcggataaaaaatgttatgaaaaataaagcaatttgaagcctctgacttcagcaacttcaccactaatgaaatgatgtaaccctcattggcctcaaatttagttttcacggggcatctgcagggttccaaagtgagaccaggtgaattcaatgtgcatgcacttcccaagtgtccacttgtattctgtttctttacttctgtttacagaaagtagacacatattcagtcttagtaccagtgtagggagcgctttccatgagatggataccagaaaaaaatggcaaacatgggatccgttaatataaaaattagccacgatgtatatatatatatgtgtgtgtgtgtgtgtgtgtgtgtgtacacacgcgcgcgcatgtgtgagttgaatagcagagttggagtgggtttctatccacatgtacctgcacctgcaggtattctcaggtgccataatcaactgtaggaccctaaaggaaataagagtctcccctcaacccctgaagagtgtttgggttcaccgtgtgtccaatgattctgtgcctcttgagctccaggaaagggctccctggtgatgcatgagatcttttcttggagtctctctgcagagttcactgggtttcctaaaggcaattcactatttcaaaagatggtgtgaggagcatgtggtgtccctaaaggagaattctgagccagggcacaaccactttatactgagctggatacactggtaggaatatactctgtcagctcagatagaaacctccctgcatggttggggctgggctgcagggggcgctccggatacacccagcacaggctcccgccccagagcaggtgcacaggaggctggggagaggttcctcccagggcctgggacttcctttaaaaatatctaaaataagtatttcacaaagactgctgaagtttgtataaatatctattcaattgtgagcatttatcaaactggatgttgtaatgagaaccacttttacaatggggatttcaaactctgctggaggtcaggaagagatcctttcttataaataaatgcaatttttggataaacacagtcattccctaaataacgcattcacatattatggtctagaaatgatgcaagttgaccctgagacagtcaaatgtggtttcaaagtgaggtgctgtccttgaggagcttgttctccagtgggggaagctctgtcaacacagagttcagggatgtgtaggggacacatggcctctaacaggattacggcttgaaccctcagcttctacagttgtgtcacccatgtgtctgtttctcatactgggtcaggaattgggctattaaatagcatccttcatgaatatgcaattaactgaggtgactatagtatctccgttccctgagagcctcacccaacaaccacacccctcctctggagaagcccctagatcacagctcctcaccatggactggacctgaaggatcctcttcttgatggcagcagcaacaggtaaggggctccccagtctcagggctgaggaagaaaccaggccagtcatgtgagacttcacccactcttgtgtccactccacaggtgcccactccctgcagctggtgcagtctgggcctgaggtgaagaagcctggggcctcagtgaaggtctcctataagtcttctggttacaccttcaccatctatggtatgaattgggtatgatagacccctggacagggctttgagtggatgtgatggatcatcacctacactgggaacccaacgtatacccacggcttcacaggatggtttgtcttctccatggacacgtctgtcagcacggcgtgtcttcagatcagcagcctaaaggctgaggacacggccgagtattactgtgcgaagtacacagtgtggaaacccacatcccgagagtttcagaaagcctgaggaaggaggcagctgtgctgagctgaggcagtggtacagcagttttctgaacttccatagtatctcattttgcattgagttccgctttaatattagccaagaatatgggatagacgggtgctcctaagagatccttaacttgcccattttgatgggttttcccaaagacgtgagaagccacttttttcgcaaagcatcccaaagccatgccctgctccagaaacacgtgtatccatttcctggtctttgattaactgacaaactctcatcagcgcacctgggctaatttcacatcaggtagaaatatgtgctttaaagcaaggctaacgttgtaatagcaattcctgcttaataaccttcagcattgttgttgtgtgctccatcaactaattacgttagttcaaggttctcaatgggagtttctaataaatataagggatgtatagaagttcccctaattaaaacaattgtgaagacaacctcagtgttcaaccatatttcaacccttcaccacaaaggaactttcatctctcctggaagttgggttcattttcaaattagtttttttattttaatatctcaagattattgtatgtgactattttagcagaaagtgaattatgggaacttgaactaaccaactgaaaatacattcagaactaattaaacaagatgccagaatgtgattggctccaggcattttaaattcaacaggttatgtaaccaggctttaaatttgcacatcttcgtgttaccttcatgacacagtcaactcccattatgtaagaaatggtgagtgcattcccaagggtcttgcacagttataaaaatagacttgatgaggtgaggagttgtttaaattcccctctgaagaagcagcatcaacccaacaaaccactctcttccctctgtgactagagctctgtcacaggccacatggacctaaatccttgatggagattacaggactacgtaaattggactgatcgtttttatgctgttaaattaataggtgagtctgcactccagcctgggcaacagaataatcttgtctgtaaaatacaaaagaaagataaattaatagatactgactttgacatttcggataataatattttcataaaccgaatttaattatacccacattgttacctacaccttcactgaaaagttcctagttatgttgagttccatcaacactccacatgttcaaatctggacatccaagagagtctagagaataaaacgcaatgagggcagtgaaacttgcgtatattcagcacctcttaactcaggaggactcaatacaccctggaacactctgcttttctgaatggctcacaatgactccagctcactctccaacctcctcaaacatctggcctctgtttgccctaagttcacgctctgctcttagtctatgttctgaagtctttgtagaggtgaaaatgagctgtcagatggatcttccttctcactgcaacatggaatttgctatttcacttaatgaccactctttccacaatggttgatttcttttggcctgttcattactggtgattttcaagggaatctcagttgaatctttactgttttgcattttgtctccatgacaatgttgggaagtttttcttctagcagcataacatgatctagtgacctgacacatttgcagcaaacaatacctacaaattcagaagctctttggttttctttccacgaaatataattcttgctcttctgtgtatgagcacatcctagcatccctgtacacacccaggtagatgtaaacacgccgatgaaatattccctgtaaataaaaaaagtatctcagtttctctcaatgttcataattctcctgagggtgaggaaggtacttctgggtctgctcaaacaaatggcccagagaccacctggtaggtaggtaaggagctcacctcgctctggatattgagtctgtctctttccctctgtcgtctcatagaaggccagcccacttgttcagctcctaagaagagagcccaggtttatccagattatacaacacaaccagcttctgatgactctcctgttacaacatccatggagatattttgtgtattatataattcaccaaactaatgtgaaatgcccaagttgcaatactgcacaccctagggtatgttcttgcaattcagcggaggagaaattctttcagagacagatggatctgaattggtaaatatgtgggtacgaattctgggtttgagtgtcattgtccagccatgtttcacaggtgtgacctgtcagggaagaaccagagttccttgttctctcagagggtagagctcacagaggtcctctctggttcccaggaaaggtaatttcactaatcttggtgatgagactatcctccagtgctgatgtactatagagttttcatctgaagctgtcactgctatccccaatgtacatcttttcacacagaaatgtttagaggtcaggccatattctcagggttacacattgagaaggatggagatatattctactaccttctcctgagatctcacacacaatctcaaatttcaaaaggtctcagaagggcagctctcaggtactatttaaaaataacccacttcctgggacaggtagcatccttctaaccatgatggatgttctgaactacagtacacattgcatggatccaggtttgtctcaattcactgtgattattacactcagcagctgtttcaatatgtctgaaggggtaaatgacaatttaggtgacctgggtgtatggttggtgttatatgaatctttaaatgtagaacagtattaactgtattccaaaatctgtctttgatccatgatcacacttgtctcccagaccagctccttcagcacatttcctacctggaagaagaggactctgggtttggtgaggggaggccacaggaagagaactgagttctcagagggcacagccagcatacacctcccagggtgagcccaaaagactggggcctccctcatccctttttacctatccatacaaaggcaccacccacatgcaaatcctcacttaggcacccacaggaaatgactacacatttccttaaattcagggtccagctcacatgggaagtgctttctgagagtcatggacctcctgcacaagaacatgaaacacctgtggttcttcctcctcctggtggcagctcccagatgtgagtgtctcaggaatgcggatatgaagatatgagatgctgcctctgatcccagggctcactgtgggtttctctgttcacaggggtcctgtcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggcacagtgaggggaggtgagtgtgagcccagacaaaaacctccctgcaggtaggcagagggggcgggcgcaggtactgctcaagaccagcaggtggcgcgcggcgcccacagatcccgaggccgggtccggagcaggtgcaaggagggcggggcttcctcaacagctcagtggtctgtctcctcgccagcacctcagatgtccccaggactctctttctttattatctgtggttctgcttcctcacatccttgtggcagggaagaaaggaggaagacaatttttctgtttactgttgaggtttcaccaattactagaaactttcctacaagttcctgcatgactcattttgccatatatggattctcaccatctcttgatttgtttcatcaatcgaattgtgccctatttgaaattaacttactgaaaccttaaatccaatggatctatactggaattttaatgatgtaattgaggttaaatgtggtcaaagtgtgagaccctaatgcaataaaccgttgtctttataagaagaggaagagacaccagagacctctcacttttcacgtgcacacagagaagaggccatgtggagacgtagtgcactagaaggtggccctgtgcaagccaggaagaagccatactaagaaccaattttgccagctccttgatcttcgacattcagactgtagaattgtaagaaaatcaatatttgttgtttaagccacccaatcctgttgtcttcttacgaagacccaaactgactaataccacctaactctgttagctctgtctcctggagggagaagcagccccctgaggctgggcactgcatctctcagatttccacgtgaagtaggcaaaaatagtagttctcatataaaaatgtgtcatggctctgttggccatttttgagcatggtctctgaaaccagccctggtgtgtgtgtgtaacaaatgtcccttatcttttatttggacataacaaatagacgataggtaccagctggatggagattggccactgatcatcttctgttctccttagtatgtcacagaaaaccacaccaacatcaccagcatcactgtttttcttctaccacctcaaacggactacagaaatgatccctgcagtatggtctatttcttcggctttcgaaatttgcactgaatctcttcctaaatggggagctacatggggtctgagttttgttcctttcttcccagtcttccccaagtaccaaggacagaatagacttaaaatttggccatcaatgcccccaaacaccacatcactttctaaaatccacatcctgcatccatccttctctggacacccctcatcaggctacccaggaatggccagaatctggtatcagcttatgggctgaggccacgagttatacacatgtgtgatttcagtcacacacactctacttcaggaccacacctgtgttctgaggagctcaggcacctgctgatctcagtaattctctaataaatcacacacctcttattaataaaggtccagatggccccatcagctgcagagcagtggagtaaagctcatgggtgggtccatcaggcagaagtcagacaatggaagggatggctggtcacttccattttcactgatgttcgcaatgaattttaatggaataaaacaatattaactacaaagagacagaaaagaagactggctcgtcaagatatttaaggacaaggaactttatttggggggaaagtgaaagacacttctaaatggaaatccctaaagcacatacagcagctgacagagtggccactgtgcacatgagggctgaggagatggatggtagagtccattcctgcaacatgtctctgggtgtgtgatggttagactcctcatgcatatgaatataagagctggactcatggagaaaaaaagggccatatcccataggaaaggaagaaaaaaaaacagatgggcacccctggagagagctcattagatttggtgtgtttaagatgaaaatttcttccaaaaattgtaatgttctaagctaaatatgaatctcttcaataaactgagaataggagaatggagctaggacttgagagaggaaacaaatcttgagagagcagaaagcaaatccacaaaaactgtcacatgacagaggtcagaatggagctgatgtagctacttcactattctgcagacttattgaccatgtggagaaggggcttgaacaaatggagacgttctccaaccttctgaatcagcctccttcttatgcatgagtagaaatcatagttctgggggtgaccttcccaattttcctgtccatacctcttcccccaggggtagagtgtcttcccaaccacaatggtttctcaccagtgttctcagcttctcctccattgtacttaccctgcagattaagaatttcttctagatggagttctttgggaattttctgttttctttagtttctgttgactccaccacacccccataggatacaggttttattggatttcccctggaaatagtgggggtggatccaggcgttcaacagtcctcgctgttcttcccttcctgtcagcaccacaggacagcagataagggagttgactgtggatttttcaaattcctgggaaaagcctgcaaggactagtagattcacactctaataccattagcacatgtatccaaaaagaaacctcactaaatatttccaggttagcctgttcctctctcagtgccatccagtggcacctgccctgggttcacgaacatgtgggccccagtcctctctgctggcatctctctcctcacatttcagtcttctcgttagctctgtgaaagcagctcagatatgttaaaaggttttcttcttcatttattcagtttttcaggtttactgttaaggaggtcagaataagatcatagtttcctcatttttcacatttgcacgctgagtagccactttctatataaaagccagaaactaagggaacaaatcaaatatccatatccactacaggtgaacgttaaaaaatttgacatatgattatggactaaagtacaatgcagaattagaatcaaggcatcctcattctcataaaagcatgtctacattctcaaataactctgctgagtgaaagtagctgaagaattaagagtgcacttcataaacttctaattgtataaactgcagaaggtacaactattctaaagtaacagagcagatttgaaatttgggagaaatgggtgttgaaagtaattgggtggtgagatgaaattacagagaagtgacagaaagatttaggggttaacttaattgtacacaacctgattaaagtttgcacacatacgttaccattttccaaatggtgcagtgtagatttgaattaattattaattgtacttaaagcagtaacaaagaaacaaatgaatatgttggttgaggaggagcaaaaaatagatgggtatgaacactcaaaacatctcagactcttgaaagtacacatgcttgaacactggttttctctgtatactttaggtaaagagcagaatacattaaaagaaaacagagatgtcctggcgggggtggaatcctgcaaacctcactaggcgtgtcccacactgccctggagttgtctcaggggagcagtctcctctagtggtcagagacacaggcatggataatggggctaatactgtccagctgtgtgaccttgaacacattgtataaacactgttccatatgtaatttatcttccttaaaatgtaacattgacacttgcattaaatgtattctacaaatatgtcaaaaagaagatgacgactgctaaatgattatcaaggcacaatcatataatataatgatattttcctgagtgataagatgactaccaatctcccccagggcactttgtttgctctgagccctgcgcctcctcaggattcccatcccagagcttgctatacagtaggagacatgcaaataggtttctccctctgctgatgaaaaccagcccagtcctgaccccacagctctgggagagaagcgccagccctgggattcccaggggtttctatttggtgatcaggactaaagacagaggacccaccatggagcttgggctgagctgggttttcactgttgctgttttaaaaggtgaactagagagattgagcgtgagtggatacccttgagagaaatggtggattatgtctgggagtttctgaccaggatgtctacgagtttgcaggtgtctagtgagaggtacagctcgtggagtccggagaggacccaagacaacctgggggatccttgagactctcctgtgcagactctggattaaccttcagtagctactgaatgagctcggtttcccaggctccagggaaggggctggagtgagtagtagatatacagtgtgatggaagtcagatatgttatgcccaatctgtgaagagcaaattcaccatctccaaagaaaatgccaagaactcactgtatttgcaaatgaacagtctgagagcagagggcacagctgtgtgttactgtatgtgaggcaccaggtaagaggacatcagtgtgaacacagacacagtttcctgcaatgacaagggaggaggctgggctaaaaggggcactcaggacccactgaaaacgggcagctctagggcaggtacagatggttatcatgggctgctttccttcagggtctgtggcctcctctgcatctaccagttcccctcggagcctctggacatttatgtttctgtggccacccctgacatctctggattagaaaagtttattataggaagaggaaacattctcatttgtcccaaagcagatgtaagtaatggaagcaaaaaatgcacaggaggccaggcggggctgtagatactgtcaccccagaatgtcaatctcaccactagtactggagagggaagggagtttgatggaccttccctaacaaccctgtggtccaagataagtccaggaagaccattggtgcctcccagagcacagttgtccatcagggatgtccaatgcgtcccagcagcagccatgcctcagtgtctccactgtgcacagccactgtctgggaggagctcccaggatgggtgtctttggcacacaccaggtggcgggtgttagagtgcagtgcagcagctggctgcctgttctattgggctccctgatgctggagagatgggaggtgcattcgcagggccagcaccctgtttgtgaatttttatataaaaaccctgattttacttcatttttgcagatgacatagataactaaaaacagaatctgcaaagaaattgtaattttcaactttaccccaaattcattgtttcttaattctgtgcaagatccagacatattattgccttcctcatgataatttattctatgtaaaaccgaaatcattttttctcctactctttgtttctgttcaagtacagagatcttgagcaaagtaagttgggttctttccacacactaaccctcaccttccccagagaatgagcagagattgtcctcagtctgagtctaagggaggagctgtttctgcacaactcagagcctgcagagacccccaggtgcagcttcagtgaagtcagacatttctccatgtgggcgacctccagtgcctgtgactgctgctcaggcctaattgttggttaagtattacgacaccctttaggtgatcacatctcaagcctattctgaaaatcaccatgaacagagatagttcaatggccattctcctgacataagtttctctttattacttggttccaagtatggagaaaaatgtgaccctatatttgtctgaatccaacatcagcatccacggcattacgctaggagactcactaattgagcacaagtgagctcgttattctcatagaaatgtaagtatttggaaatttcagcgtgttctccagaacctgtggctgccaacaactgtatttctcggtgcactcttggcctggtgaagccttcacagaacctctccctcacctgtgccatctctgcattctccatcacaaccagtgtttccttctggagctgcatccatcagcgcccccatgggaggtactggagtggatcgggtgcataggtcatggagggagcacagattactcccctcttctcaagagtccagtcaccatctccagatccatgtccaaaaagtacttcttcttacaggtgaactatgtgagcaacaaacacatagccatgtattttagagcaaaagacacagtgaggaaaccacagtgtgaactcatacccaagcctcccctgtgggggtgcataggacagccagggttactcaggacaccaggctccctcaggacaccaaggggcactcaagaccattgtagaggcatgcaggtagctgggggctctcaggaaccatgggggaaaatcaggacaccaaagggtgcttggtacagcagggggctcaggattattgtggggattcagaaagagcaggttcaaggctcaacctcagggcatgtgcagctggtgtgaaaaggggctggatgaggcgttttgtgtcaccatcatgtttcaccaccagacaccctccactacctctattctaatgcatgtgtttgtatgattagaaaatgatattgatataaatatataaccatagctaggtgtgtcaagttgtcctctccatcttatatcagccttgtctgtaaggactaattccccataattacttgagaacctcataaattgtggtcaattatgtaggattcctctctttttctgccttccttcctccctccttctctctctcacacagaaacttatatacagccaccccacaacacacataaatctataacttttattacctgatgtattgataagtaatctaaagttacataaaaatcagtagttcactgtcaatattgtaggagaagggaaggtctaggaaggaggaattacagaacaagaggatattttgagggtaattgacttgttatctatgtggataatgataatgtctatgaccatatttgtaaaattgaacacttcgtgtggagactattatttttttatttaaccccatgccattattttgccgtattctagcatttctctaaaaatacagaaatgttcagcactcattcatgtgtatattcaggagtttctgacttttcatgtattttatttatctctgtctaattgctttgataccaaattttacctagtataattagtactacctttagcactgattataagtctcactcctccatcatctccttttttgccacacaagctgaatctagtttggactcataggagctgcttcattcaatgccagtgggagtttcaaaccctatcaacccccctataaactgtcattaagaaagtttatcaaactccaccagtcatgtgatattagttcgttttcacagtggtataaagaactacctgagacgaggagtttacaaagaaaagaggtttagttgactcacagttctgcatggctggggaggccacaggaaacttataatcatggtggaaggtgaaggcgaagcacggcacatcacacagggcagcaggagagagagggggaagtgacacatagttttaaactatcagctcttgtgagaactcactcactatgatgagaacaacatgggaaaactgccctcatgatccaataacctctcacctggtccctcccttgacatgtggggattagaatttgagatgatatttaggtggggacacaaaacaaatctatagcacatgtccagctgtgtcctggagttgtttcagggatccagtgtgtactgttgatagaaacagtgatcatcattctagccggtgtgagatggtatctccttgtggtttagatttgcatttctctgatggccagtgatgatgagaattttttcatgtgtcttttggctgcataaatgtcttcttttgagaagcgtctgtgaaaaaaaaaaagaaacagtgacaccaagctcacaccatccgttgtagttgacaacatgcaaagccaagagatctcaactgagatttagtgtgtgtgtcatgtctgatgaagtcataagctcagagcaagtgaatatggaaaagtgtattatctgcacagtgtaggtgtctgctgagtgcagggcaggtctcgcaggaaaatctaaaatggcttgaaagaagaggaaaggagactggctcagggtttttataatggtttagtggtggtggcacagtgaggcttcccactcacagatcggggtttataaggtttgaaactcccactgccattgaatgaagaagctcctgtgagtccaaactagattcaccttgtgtggcaaaaaaggagatgatggaggagtgagccttaagtaatcaacaggcatgcaccaaaagatagagcgacaacttattctaggtagcaagaataaaaataatgaaaaagaaataagggttcagtatgggtggacaagacccagatctacagaaatgagatgactttagaaatataaggaaataataatgagaaaaagaaggaggggatggggaattagggtcctggcctaatgtcttgggtagaagcttctcacaatcaaggactatcagcttattctgcaggtcttgggtcacacgtctgcttaaaaacatcagaaatgccaggcaatcaatgaggatgctcagtttagcatctcctatttgagtagatttacagttgtgtggaattcttaattgattctttttggtttgtttttagaggcaggctctcacactgttccacagcttaaagtacagttgtgtgatcatagctcactgtaattttgagctccggactcacgtaatcttcctgtattagcctcctgaatatctagaattagaggggaacgccacccctcacctgcttattctttaaaatattttttcatagaaatagcatctctttatgttgcccaggttggcttcgatttcctggtctcatgtgatttccctcactttgcttctgaaagtggtgtgattatagggaagatccactgcatctgtcctgaattgattcttcagttgtaaaacatgaagccaataattaactgcctgactgttttgtgcagtgagttagttaaaagtttctgataagattccttccaatatgattcaagagcagtattttctgctgatgttcctttcagtttccttgttgaagatcagaagacactgcggaaaagatgtagtaaaaaggcagttttaactcttcatgattggagtggatatcacataggaatccctttccgtattttgtaacacatgcatgcaatagaacaaagatgatcccttggtgtaaaatctataaacgtatgggccttttagctaccaagtcatagggtaataactgatggaccctgaggagtgaaccatgattccatagtgctagtgggagaacccttggccaaggaagtttacattttattaaaattgataatttttatgtagcgatgccattttttaaacattcccagaaggttgtgagtgggattgactctgtcttctgtgaacaatgacagtgccctccatggttagataatattttaaactagattgagctagagtggtttctgtattgaatcactatatttttttagcttcatgttagctttttgtgtgttagcatttgctttaaaatgatattaatcagccctctagtaggtagaaattcatctgagggtttcttcccttgttgtccatctcaataggatttccagaagacgtaagaaccctctctgtttctaaaaatattccaggctgggcgctgtggctcatgcctgtaaacctagcactttgggaggccgaggtgggtggacccctcgaggttgggagtttgagaccagcctggtcagtatggtgaaacctcatctctactaaaaatacaaaaattcgccgggcatggtggtgtacactcgtaatcccagctacttgagaggctgaggtgagaggattgcttgaaccctggaggcggcggttgcagtgagccgagattgtgccactgcacttcagcctgggcgacacagcgagactccgtctcaaacaaaacgacacaaaaaattccaaagttgtgcaccctctaaaagcatatgtacttaattctcatttttaatttattaaacatctctaataagttcaatgtttcctgccttctgagttgatttcctaacacatagaagaatatatcctaaatgaaagtttgtgttcttaatacaaattactagttaataacctttacttttattattgaggtattatacatcaatgttaatcaatcctctcaatgggactcttacctaaagaatatataaaatattttcctgatcatgacatataatagatgtgaacacattcttagcattcagccatgtctcttgtctattaatattataaaccacatgctaactttgattttattggtaattgttctaatttcttttttttcccacttctctggttgttttttttttaactttaagttttagggtacatgtgcacaatgtgcaggttagttacatatgtatacatgtgccatgttggtgtgctgcacccattaactcgtcatttaacattaggtatatctcctaaagctatccctcccccctccccccaccccacaacaggccccagtgtgtgatgttccccttcctgtgtccatgtgttctcattgttcaattcccacctaggagtgagaacatgtgttgtttggttttttgtccttgcgatagtttgctgagaatgatggtttccagcttcatccatgtccctacaaaggacatgaactcatcattttttatggctgcataggattccatgatgcatatgtgccacattttcttaatccagtgtatcattgttggacatttgggttggttccaagtctttgctattgtgaatagggaattgttctaatttcaaactagttaatttttatcttcatgcagctagattattatgtgtggctatttattccgagagggataaagacaacattaacaattttcactgcaggcatgtctaggcaactccctgtgcactatgaccctgggacgttggagattctatggggactcttccctacctgcctaggagagttctctgccttctacctctagcattttcctctttgaagaagtacatctaactgtcattagaatagagacaaagacaagtcttaactgcttccagctgaggagggatgctgtttggggaagatctctcttggaggtctaagggaccccaggaaaagggagccattatcccaggcttcagttgcatgaccatttggagtttgatggtctgaaaatgagaagaggcaaatctggttattagaagacatgtatgaaaaccaaacaaggtggcaaggacagcttgaaagaaaattccaaggctgctgacattcctagataactgcagctgtagttatgcctgctaaggtttgggcgcatggggcttggcttttgtcagctccctgggatttattttcccaaacaaagaaacctccaggttaggggcaccctattcattcccatcacctggcatgatttaaaggataattgcttagaattaaaatattgatccagattttttatattccccatcgctttttgtttcttctgggctgtagccagagatcattgattggcgctcaggaataagcagagttagtctaaaatgcaggcaaatacttaaacaactgaagagattagaatttaaagacaagtgtatgatatgttttgaaatacaatgtttctctttccagttttggtttttgtcggcagcaaataatgataagactgagttgtttgcaaaataaactttagtcttaaacttggcctgattatttgcataaagtgcagcaagaatattaataataattctgtaggaaaagcctgcaagcaccaggagcttcacagtctaacactatgagcacgtgcatcctcacgcaactcactgaatatttccaagccagcctgttccgatcttaaatgccatccagtggcatctgccccaggtacactaatacatgggtcctgcttctctctgcagcctcctctctcctcagatttcaggttttgtttattgtttgttttctctctgacatcaacacagatatgttgaaggttttcttttttttatttgtagttgttcagctttgttgttaatgaggtcagaataagctcatagtttacacatttttacattcccatgccgagtagctgcttttctctatcaaatccattaactgagagaacaatcacatttcgttacaggtgaacagttaaatagtttggcatatatttctgtgctggaatctaatgcagcttgaaatcaagtcatgcctcactcattgaaaaaaacatggctaaattctcaaagaattgtgctgagtgaaagaaactaaggaattaagagtaaattttacatgatacatttgtagaaattttagaagatgccactattataaattaacatggagaagatttaaatgtttctgagaatatgctattgggagtaatggggatgtgagttaaatttcagaggaataagagaaagatttagggattaattttttcaaaccttgattgaagtgctgagtaaatggttgcaaacataggtctacatttttcaaatcattcaccataaatttgaattatttattaattacactcgaataaagcaataaagaaactgatgagataatatttgactgaattgcatcaataaatagatcgatattaacacaaggaatataactgatttccaaaaacatacacatgaaccatggttcactctgcgtatttagataaattacagaaagttgtcataacagatggggaatcctgcagacttcactaggcatgggccatgctgccctggagttgtctcaggggagctgcctcctccagaggttagagcacaggcccaggtaataggactaaatttttagatgtgttatcttagacacactgcacaactgctgtgttctctatgtaaattatctcctgtaaaatataacattgaagcctgcattaaatatattgtgtaaatatgtaagaataaaagaaagttatgagagctaagtgttaatcaaggcacaagcatataagatataactatattttcctgaatgatggaattactaccagtctcccccaggacacttcatctgccctgagcccagcctctcctcagatgtcccacccagagcttgctatatagtgggggacatgcaaatagggccctccctctactgatgaaaaccagcccagccctgaccctgcagctctgggagaggagcccagcactagaagtcggcggtgtttccattcggtgatcagcactgaacacagaggactcaccatggagtttgggctgagctgggttttcctcgttgctcttttaagaggtgattcatggagaaatagagagactgagtgtgagtgaacatgagtgagaaaaactggatttgtgtggcattttctgataacggtgtccttctgtttgcaggtgtccagtgtcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagacacagtgaggggaggtcattgtgcgcccagacacaaacctccctgcaggaacgctggcgggaaatcagctgcagggggcgctcaggagccactgatcagagtcagccctggaggcaggtgcagatggaggctgtttcctgtcaggatgtgggactttgtcttcttctgacagttccccagggaacctcttaaatttagaaaactgtgcctaacaatgtcttctctatgcatatgaggaccttttctccctggcacaaaatgcagattgacgctgacacggatgaaaattcctcaaccatggtcacaaggatcagagtcctgagtaacctcagggcttcctggtgattcttctccaatcagacccaggacagggacctccgtgagattccctgactggaacagtctttatggatcctggtcacagacaatagagaggctgaaccagggtcagcgtcatgtagaacgtcacagatttcacgtctgatccttctcctgacacgaaagtatgcaaatcagtatcagcaccgatctggtgcttcttttgttcctaatccatttactttcttttttcgtcgtttttctcctttttccatttgtttttcctgctttttgcaaaaggaagatgttttccctgtgagatgcaggggatgacaattttgggagatggctggaacatccaatatcctcagggccgaccatcagtaagtgcaggctagaagtctcagaaagagctgaagctgcttaatcaccgtggagttttaccttctccagttctgctctgatggaatcagggccaagcaggttatcaatgataatctacctaacatagagtcaactgattccagtttcaataacgtctgttaaaaattcacaccaccacctggattactgttttgtcaaatcaatacacagtattgtccagctaagtagacccaaagacggaccgttgcccatggagaaaaacattaacctgagttctaggttcttacagtgttaaaggtgtaaaactgattattaaaaatgaggctatttttctttttgctgttgagttgtagaagtttcttttccattttgacatgaaaactttttcagatatatggcatattatccaattctgtaagttgtagttattttgttgctttgcagaatctttttcataatctattcccacttgttcaattctgcttttttttgtaggtgatttgaatgtaaaatcctgaaaaagattgctaattttttgagtgttgagagttttacaattagaggtattacagttagatatttgaggcatttggagtgaatttttgtgtttattctaacctaaaattcttaattcttttcatgggaaaatccagttttcataccaccctctttggaagacactacaatttagccatgttatattgatggttctcatgctaaaaatcagcttgtcatcaatatgtgggtttatatctaagctctatataggtatttaagccaaaactttctatgtttttaataaatgttgaggcctggaagtgaaatgcctaaagctttcttcttgccttgttacagatattgtaccaaaatattctaaccttttactattgagtgtaataatagctgtggcctttcttaacggcttttattatgttcaagttgttttcttgtcttcctactttgttcatagttttaataatgaaactgatttttttcaaagtctttttctgtgtctgatgaaatgttactgagatattttttctttagttttttaatgtgtaccaaactgattgatttgagaatgttgaatcaagtatgcatctcaggaagaaatttgagttggtcatggtgtatgtcttctaaaacactttggagcttagtttactattgttggggattaattcatgtctactaatgatattggtctgtagtttcctttattgtggtgcctttgtctattactggtaatactatcatggtagtctcatagaaagagtttagaaggtgtatggcagactacctttaaaatagattttatcagtggagaaatggtgatagttttttcttcacttttctgttgggaagaattttatgttgtttaaaagatattcagaatgacttaacctggtttatgagctttcattctattcctttcttccattctttttgaagaactgcttacctttcctatttatttttaagtttgtttttagacatatgcaatacattttgaggtgaaacctggtggaattttttccaataaattagtaaaaataaatcatttaattgactattttattcaggttgatttgtttaatatttgctaaaggccagttctttaagctatgacacataataaatcccaaatggcagtacctcattgtttacttagcttttgtacttatatttttcagaggaagaaccactactgtaaattgtaaatagccaatacataattgtattgtatgcaaatctgtgactgtttacagtgtcatctctgagaaacataaagtttatttactatatatatataaagagtttggaaggtggactccaccaatttttgaaagagttacagaagggctgctattacttctttaaatgttaaggttccattttatgatgtaacagataacctatcatggagaatgttcaatgtgttccttgagaaggatgtgtattacgtgactcttggttggaaggttctgtaaatatcattcagataaatttgttcaatagtgttgttcaagttccagaggcacattgagaattttctttctggatttgctaaacattatggtcatgaggtattaaggtcttgtgttatttttgtattgttttctatttctttatatctcttacagtttgcttaatgcagttatatttgtatttgtacacatgtgtaaaaacaaaaatcataattgctaaatgagttttatggcacagtcacattataagtaatatttttccaaatgctaccattgccactaaagtcctcctggagtctgacgtctgctctgggcactgccttcttctcaggcgtcccacactggagcttgctatagaggaggaggcatgaaaacaggcccctccctctcctggtgaaatcaagcccagacctgaccctgcagctctgggagaacagccacagccctgggattcccaggggtttccatttggtaatcaggactgaacacagagaactcactatggggtgtgaattaagctgaatttttcttgttggtattttaaaaggtgactcctagggaactagagtgagtgagagtgagtggatatgagtgagagaaacagtggatatgtttgccagtttctgaccaggatgtgtgtgtattttcaggtgttcagtgtgaggtggagctgatagagtccatagaggacctgagacaacctgggaagttcctgagactctcctgtgtagcctctagattcgccttcagtagcttctgaatgagccgagttcaccagtctccaggcaaggggctggagtgagtaatagatataaaagatgatggaagtcagatacaccatgcagactctgtgaagggcagattctccatctccaaagacaatgctaagaactctctgtatctgcaaatgaacactcagagagctgaggacgtggccgtgtatggctatacataaggtcccaagtgaggaaatatcggtgtgagtccagacacaacatttcctgcaaaaagaagaaaggagtctgggccgaaggggacactcagcactcacaaaacaggtgcagccccaaggcaggtgcagatggagggagggtaagggctgctttccttcagggtctgtggtttcctctgcttctaatatttcccctctgaacctctgtatatttatgttttgtgcccaccatgaggtccctggattagaaaactaatttaaaagaggaaatattctcatatgtcccacaaacagatgtaagttttggaggcataaaaatgcataggagccgcgtgagtctgtagacactgccaccccacaatgccagacccaaaactagtgctggagaagggtgggagtttgatggagcttccctgatgaccccgtggtccaagctaagtccagcaaggccattggtgcctcgctgagcacagttgtccatcagggatcctcccatgtgtcccagcagcagccatgcctcagtatctccactgtgcacagccatcgtctgggaggagctcccaggatgggtgtctttggcacacacaggtgatgggtgttagagtgcagtgcagcagctggctgcctggtctattgggctcctggatattggagggattggaggtgcattctcaaggccagcacgctgtttgttaatttttgtataaaaaccatgtgatttaattcattttctcagatgacatagataattaataacacaatctgcaaacaattgtaattttcaactttaccccaagttcattgtttcttaattctgtgcaggatccagacatggtattgcccttctcatgagaaattgttcgacctaaactgaaaccagttgtttctcatatactttggttctccccacatgcagagatcttgattagagcaagtttggtactttccacgcactcaccctcacctccccagataaagagcagaagttctccttagactgagtctgagggaggagctgttcctgtaccactcagggcctgcggagacccccaggtgcagcttcactgagtcaggtgtttcactccctgtgattgctgctcaggtctaattgtgggctcagaattaggacagtcttcaggttatcacagatcaatcatattctaaaaatcatcattatcacacaccgtggtaataattcaatgttcatttttctaaacagcagtttctcttttttatttggttgcaagtttgaggaaaggagcatgtgataatactttttaatctaacctcaaaatctactgaattgttctaggagactcacaaattggacaagagtgagctccttgtgctcataaaaaatgcatgtatttgggaatttcaccgtgttgtccagaaactgttaacatcaacaactgtgttttccagtgcacttctggcttgagacatcctcacagaccctctccctcacctgcactgtctctggattccccatcataaccagtgtgtcctgctagaattgtatctgcttgcccctagaagatggacaggagtggatcaggttcatgggttgtaaagggagcaaaaattacatcccacttctcaagagtccatatccagatccaagaaacagttcttacagctgagctctgtgcccagtgaacacacaactacacattttgaagcaaaagacgcaatgaagggccttcattgtgagcctagacacaaacctccctgcaggggtgaataggagcagcagggggcattcggggcagtatgggggcttagcatgattgttgggggtcaagatgagcaggatcaaggctcatcatcagggcaagtgcaacagggcagaaaaggggctgtagatgtgggttgttctcaccatcatatttcaccaccagacaccctccactacatctcttctaatgtgtctgagtgttgatatgattagaaaatggcatttatgtaaatactaatgtatacccaaatggaggtgcatccagttgtcctctccatcttatgtggaccttgtccatcaagggctaagttcctgtatttacttgattacctcatacattatggtcaaaacaggtagggtctcattttggcatggtctctcctcctcccttctctctgtcgcacaaaaacacatgaactgacacacacagagcttcccaacttcaattatctgatgtattgaagcaaattgattagtgtgcagcttttctgctttgcctgctattcatgttatgtaaaaataagacccgtgtgtttctcagcttgttacttctctaagctaagtagcatctttgtttattatacccagagaccaaaagcgattcagctgttattcagcagcttaactggtaaacaaattgtggaaaattcatttactggaataatacccactgttacaatgaagtactgctggatacactcagtaccatgcttaaaataacaagtacctgaataagtaaaataagtcaaacaaataaaagtgcatacatatgattccacttctataatttctataaagtaaaaatgaacttaaagttacataaaaagatctgtagttgactggggacatggtacaagaagagaaggtatagaaaggagaaacgacaggagagcaaaaggaaatttctaggataattttttctctgttagtaaaagtgaggattatgtcactatttgtaaaattgtacactttatgtaaaggttcttatttgctaatttcacctcattaaaatattgcaaattttaaaatatctaatttggtagaaaaggtagtagagagagatgaataaaatacataaaattcagagagtcctgaatacacacatgaatggaccctgggtctcactgtacttttagggagacactagaatacaaaaacataatgacaggatttcagtacatgaaaggagcttctcagaccccaggaggcctgtccaactgcgtctgggagttaactcagggagcaggcatgtcctttggaaggagcaatgacaccaagctcccagcatccattgtagccgacaccatgccaatgccaagagatctcgactaaaattttctgtggatgttgagtgtgattatgccacacactcacaccaagtgagtatggaaaggatagttacctgcatccttaaggtgtctgctgagagcagggcaggtctctcattaaggtccaaagtggcttgatagagcagggaaggagactggctctgggttgttatcatggcttggtggggagcggggcagagcatcctacttgcaggaagggttttgtggggtttcaaggtcaaattggcatcaaatgagggagctcctgtgatttctaactagatttaccttgtatgcttaaaaaaagagatgatggaggaatgagcctgaagttatcagcagtcaggcctaaacacagagtctgatgacttactctaaatagcaagtatacaaatgatgagtaagaaaagagacaagactccaatatgggtggacaacagccaggtctgcagaaaatgagaagactgtttataagcaaagaataatgagtaggatatggaggaggattctggtccaatgtcttgtgtggaagcttctcatgatttgagatcatcagcttattctgaaggtcttaggtcacctgtcttcttcaaaatatcagaagtgcctgatgatatgtgaggatgcacagtttaacttcctctatttgagtagctttacaattgtgtagagttcttaattaattaatttttttttttggagacggagtctcactctgttgtgcaggttggactgcagtggtgtgatcataacatagctcacggtgatttcaaattcctggctcatagaatcctcccacctcaacctcctgactagcaagtagctaggtttccagggcccttcatctacacttggccggttcttttcattctttttttttttttttaggtggagtttccctcttcttgcccagactggagtgcaatggtgccatctcagctcactgcaatctccccctcccaggttcaggtgattctcctacctcagcctccagagtagctgggatcacaggcatgtgacaccatgccccgctaatcttgtatttttatcagagatgacatttctccatattggtcaggctggtctcaaactccctacctcaggtgatctttccacctcagcctcccaaagtgctgggattacaggcgtgaggcaccgcaactggcctcttcatttttattcatatgttccttcagcagccactatgtcttcccactgatttcttcagtttctgccttttccttttgaataaggcattattcctaagggaagtcgggaggtgggcctggacagggacttggtgcattcctctctcccgtcccagttcttattggtttctccagtggctgtagaacagcagttttgatggctttacctctgcagataatttctcttgcaatgtagtgctgatggggaggtgtgtctggatgcacttcacctatagttgctgttttgctttcccagacagcaccatcccaaggggtagagggtggagcattttgtgatgtatccccagtactgaagaaaaaggcttcaatagcaggaggaattcctcaactgtatacactctgagaatttaaacaataacttctctatcatactcaaattgaaaccatccaatgaatatgtctactttaatcgtgtgctaacttaaatggcatttggcagcctctgtgccagaaaagattatcatctgctcctgtttatttccctgcaagtccttatctctcttcagatttcagatatattgtttgtcctataacatcaaaaatttgatgtatatgtgctaatttgcagatcagtaagtttagtagctgttgtaagaataataacatatttttatggggtgcttacatctccaagctgagaagcacctctatgtgtaatactaagaaactagaaatgatacaaatatcaagaagatacgtagataaaaagtaatggcatgctaatttactgtaataacatccatcatgagaatcaatacattgttgatgctcaacatgtttgcatcataagtagttatgtgcgagaagccacacaaatagaacacatactatataattcctgtataattcttgaaactcaaaactaaagcattaaatatgaaggactgactcagaatatggtggggaagaaaatatttgggaaggaggaattgtagaggaacacaaggaaacttttaagtgtaatttgtttgttcattatttggatggcttttggggatgcaaaggtgagcacgagtggaataacattttgttttgtttgtttgtttgtttttctgaagagatgtggtccttctctgtgacccaggctggagtgtagtggtgggatcatagttcaatgtagcctctaacttctggtctccaacaatactcctgcatctgccatctaagtagctggaactaccgttgtgtgccaggaggtttggcttggcttgagtacttattaaaccacacactttttgcaatatttaatgtatagtaataatgtctcaataagactattacaaatcaatgaatgaataatttgttcagtacagattcatggaaaaatagacactaacatgatgagtgtctgacatttatgaaaatacagctgcatgaaatgtgcttctctttacattcattaggtaaacacaatagtgcatacacatcacaccgtgctttcattacaggaagaaagttctgaaaatgtcactggggtgaaccacacggtgctgggcttggttcagggagcagtcaggcccagtgttgtgaccttcaaccacagaatccttaaaaaaaaaaaaaaaaaaaaaaagaggctgcctcaaagtccgcatcagttcccggactcgctatgtttctggatcgtatcagtgcatccggatctccctggtggctttagtgattccttgcttgccatgctgaggtctcgctgtagattatgttgggttttctaagaccgttttgctattgtaagatccactccctgggacagagcgattccctctaaacctgatagaggttctgaactaaaaataacattaagtgaatcctggtgtgtctgaactcaagtgattgttacattaagctgctgttccaatctgtttcctcacctgggaaaagaggagccaggacatagtgagttgaggccccaggaagataactgaattctcagagggcacagccagcatcctcctcccagggagagtctaaaagactggggcctccctcatcccttttcacctgtccatagagaggcaccacccacatgcaaatctcacttaggcacccacagaaaaccaccacacatttccttaaattcagggtcctgctcacatgggaaatactttctgagagtcctggacctcctgtgcaagaacatgaaacacctgtggttcttcctcctgctggtggcagctcccagatgtgagtgtctcaaggctgcagacatggagatatgggaggtgcctctgatcccagggctcactgtgtgtctctctgttcacaggggtcctgccccaggtgcagctgcaggagtcgggcccaggactggtgaagccttcacagaccctgtccctcacctgtactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagacacaatgaggggaggtgagtgtgagcccagacacaaacctccctgcagggaggcggagggggcgggcgcaggtgctgctcaggaccagcagggggcgcgcggggcccacagagcatgaggccgggtcaggagcaggtgcagggagggcggggcttcctcatcagctcagtgctctccctcctcgccagcacctcagctgtccccaggcctcctctttctttattatctgtggttctgcttcctcacatccttgtggtaggaaaggaaggaggaaggcaaattttcctcttacagtcaaagtgtcactaattactaggaactttcctacaagttcctgaatgtcccatttttccttcttaattaaaaaaaatatatattctaatacttctcaccatctcttgatttgtgtcatcagttgaattgtgctgtctttgaaattcaaatgctgaaaccttaaatccaattgatctatattggaattttaaggatggaattaaggttaaatgtgatcataagtctgagattctaatgcaatagatctgttgtctttataagaagtggaagagtcaccagagacctctcacttttcccgtgcacgcagagaagaggccatgtggagacatagtggactagaaggtgcaagccaagaagaagccgcaccaagaaccaaccctgccagcacctggaccttggacattcagacttcagaatggtgagaaaatcaatgtttgttgtttaagccacccactcctgttgtcttcttatgaagacccagacagactaataccacataactctgttagctcctggagggagaagcagctccctgaggctgggcacatctctcagatatccatatgaagtaggcagaaatagtagttctcatataaaaatgtgtcatggccctgttggccatttttttttgacggagtctcgctctgtggccaggctggagtgcagtggtgcaatctcagctgactacaaaccccgtctcctgggttcaggcaattctccttcctcaacctcctgagcagctgggactacaggtgtccaccaccatgccagcctattttttttttgtatttttagcagagacagggtttcactgtgttagggtggtctcaaatctcctcactgcatgatctgcctgcctcggtttcccaaagtgttgggattacaagtgtgagccaccgcacctggcccctgttggccattcttggggcaatgtctctgaaaccagccctggtgcctgtaccacaaaattttcttttatctttcatgtggatataacaaatggacaatgaggaccagctgcatggagactgaccactgaacatcttctgctgtctcctaagtaagtcacaggaaaacacaccaacatcaccaacataactgttttccttcaacttcctcgaacgaactatagaaatgatcccttaaagtatagtctattccttcaactttctcaatttgcactgaatcccttcctaaattaggagctacatagggtctgagttttgttccctttctcccagtcttccccaagtatcaaggacagaatagatttaaattaaatttggccgtccatgcccccaacaccacatcggtttctaacatccttgtcatgtacccatccttctgtgggcaccccacatcaggttggccaggaatggccagaaggtgtcatcaccttatgggctgaggctacaagttatacacacgtgtgatttcagtcacacacactctactgcaggacacacctgtgttctgaggaactcaggcgcctgctgatctcaggtcttctctaataaattacacacctcttatgaatgaaggtccagatggccccatcagctgcagagcagtggattaaagctcatgggtgggtcagtcaggcagaagtcagacaatgggataatagaagtcagacaatagtcactgaggttcccaatgtattttaatggaataaaacaatattagcaacaaaggggcagtaaagaagactggctcttgaaggtatttaaggaccaggaactttatttggggggaaagtgagagacacttttacatggaaagccctaaagcacatacagcagctgacagagtggccactgtgcacatgagggctgaggagacggatgataggttacgttgctccaagatgtccctgggtgtgtgatggttggactcctcatgcatatgaaaataagagctggactcagggagaaacaagggccataccccatagaaaaggaagaaaaaaagcagatgggcacccctggagagagctcattagatttggtaggtttgagatgaaaattacttccaaaggttttaatgttctaagctaaatatgaatctcttcaataaagtgagaattaaaagaagaatggagctaggagttgagagaggaaacaaattatgagagagcagaaagcaaatccacccaaactgtcacatgacagaggccagaatggagctgatgcagctacttcactattctgcagacctagttgaccatgtggagaaggggttcgaacaaacggggatgttctccaaccttccaaaacaacctccttcttatgcatatgcagtaatcatgattctcagggtggccttcccaagtttcctgttcttacctcttcccccaggggtagagtgtcttttccaacccacagtggtttctctgccatgtcctcagcttctcctccattgtacttaacctgaagattaaggatttcatctggatggagtttcctgggaatcctctgttttctttggtttctgatgaccacatcacaggccataggacacaggttttagtggatttcccctggagacagtggaggtgaatccaggcgttccacagtccttaccgttcttctcttcctgtcagcaccgcaggacagcagataagggagctgactgtggatttttcagatccccgggaaaaagcctgcaaggactaatagtttcacatctaacaccattagcacatgcatccaaaattaaaaaaaaaatcctcactaaatatttccaggttagcctgttcctctctcaataccataccgtggcacctgccctgggttcggtaacatgtgggccccagtcctctctgtaggcgtctgcctcctcagatttcagtcctcttttttgctccgtgaaagcaactcagatatgttaaaaggttttcttcttcatttattcataatttttcaggtttgttgttaatgaggaaagagtaagatcatggtttcctcatttttcacattcccatactgagtaactgctctctctctatgaaagccagaaattaagagaacaactcaagtatccatatccattacaagtgaatgttagacaatttgatgtatgattatgaactaaagtacaacacaggattagaatccaggcatcctcattctcataaaatcatggctgcattcacaaataactgtgctgagtgaaagtagctaacaaattaacagtgcacttcataaacttctatttgtataaactgcagaaggtacagctattctaaagcaacagagaagattacatattggtgggaactgggttttgaaagtaatggggtggtgagatgaaattacagagaagtgacacaaagatttaggtgtgaattgtacacaaattaattgaagctctgattaaagggttgcacacatgttaccattttccaaattatgcagtatatatttgaattaattattaattgtatttaaataaagcagtaacaaagaaacaaatgaatacatttattgaggtggagccaaaactaaatgggaatgaacactcgaaacatctctgactcttgaaaatacacaagcgtgaacactggttctctctatgtatttcaggtcaatagcagaatacactaaaagaaaacagagatgtcctggcaggggtggaatcctgcagacctcactaggcatgtctcacactgccctggagttgtctcaggggagcagtctcctctagtggtcagaggcacaggccgagataatggggctaactctgtccagctgtgtgaccttgaatgcattgtataaacactctgttctctgtgtgatttatcttccttaaaatgtgacattgacacttgcattaaatgtattctacaaatatgtcaaaaagatgatgactgctaaatgattatcaaggcacaatcatataatataatgatattttcctgagtgataagatgactaccaatctcccccagggcactttgtctgctctgagccctgcacctcctcaggattcccatcccagagcttgctatacagtaggagacatgcaaataggtttctccctctgctgatgaaaaccagcccagtcctgaccgcacagctctgggagagaagcgccagccctgggattcccaggggtttctatttggtgatcaggactaaagacagaggacccaccatggagcttgggctgagctgggttttcactgttgctgttttaaaaggtgaactagagagattgagcgtgagtggatacccttgagagaaatggtggattatgtctgggagtttctgaccaggatgtctacgagtttgcaggtgtctagtgagaggtacagctcgtggagtccggagaggacccaagacaacctgggggatccctgagactctcctgtgcagactctggattaaccttcagtagctactgaaggaactcggtttcccaggctccagggaaggggctggagtgagtagtagatatacagtgtgatggaagtcagatatgttatgcataatctttgaagagcaaattcaccatctccaaagaaaatgccaagaactcactgtatttgctaatgaacagtctgagagcagcgggcacagctgtgtgttactgtatgtgaggcaccaggtaagaagacatcagtgtgaacacagacacagatttcctgcaatgataagggaggaggctgggctaaaaggggcactcaggacccactgaaaacgggcagctctagggcaggtacagatggttatcatgggctgctttccttcggggtctgtggcttcctctgcatctaccagttcccctcggagcctctggacatttatgtttctgtggccacccctgacatctctggattagaaaagtttattataggaagaggaaacattttcatttgtcccaaagcagatgtaagtaatggaagcaaaaaatgcacaggaggccaggtggggctgtagatactgtcaccccagaatgtcaatctcaccactagtactggagaggcatgggagtttgatggagcttccctaacaactctgtcttccaagataagtccagcaagaccattggtgcctcccagagcacagttgtccatcagggatgtccaatgcttcccagcagcagccatgcctcagtgtctccactgtgcacagccactgtctgggaggagctcccaggatgggtgtctttggcacacaccaggtggcgggtgttaagagtgcagtgcagcagctggctgcctggtctgttgggcctgatgctggagagatgggaggtgcattcttggggccagcatgctgtttgtgaatttttatataaaaactctgattttacttcattttcgcagatgacatagataactaaaaacagaatctgcaaagaaattgtaattttcaactttaccccaaattcattgtttcttaattctgtgcaagatccagacatattattgccttcctcatgataatttattctatgtaaaaccgaaatcattttttctcctactctttgtttctgttcaagtacagagatcttgagcaaagtaagttgggttctttccacacactaaccctcaccttccccagagaatgagcagagattgtcctcagtctgagtctaagggaggagctgtttctgcacaactcagagcctgcagagaccccccaggtgcagcttcagtgagtcagacatttctccatgtgggcgacctccagtgcctgtgactgctgctcaggcctaattgttggttaagcattaggacactctttaggtgatcacatctcaagcctattctgaaaatcaccatgatcagagatagttcaatggccattctcctaacataagtttctctttattacttggttccaagtatggagaaaaatgtgaccctatatttgtctgaatccaacatcagcatcaactgcattatgctaggagactcactaattgagcacaagtgagctcgttattctcatagaaatgtaagtatttggaaatttcagtgtgttctccagaacctgtggctgccaacaactgtatttctcggtgcactcttggcctggtgaagccttcacagaacctctccctcacctgtgccatctctgcattctccatcacaaccagtgtttcctgctggagctgcatccatcagcgcccccatgggaggtactggagtggatcgggtgcataggtcatggagggagcacaaattactcccctcttctcaagagtccagtcaccatctccagatccatgtccaaaaagtagttcttcttacagctgaactatgtgaggaacaaacacatagccatgtattttagagcaaaagacacagtgaggaaaccacagtgtgaactcatacccaagcctccctgtgggggtgcataggacagccagggttactcaggacaccaggctccctcaggacaccaaggggcactcaagaccattgtagaggcatgcaggtagctgggggctctcaggaaccatgggggaaaatcaggacaccaatgggtgcttggtacagcggggggctcaggattattgtggcgattcagaaagagcaggtccaaggctcaacctcagggcatgtgcagctggtgtgaaaaggagctggatgaggcgttttgtgtcaccatcatgtttcaccaccagacaccctccactacctctattctaatgcatgtgtttgtatgattagaaaatgatattgatataaatatataaccatagctaggtgtgtcaagttgtcctctccatcttatatcagccttgtctgtaaggactaattccccataattacttgagaacctcataaattgtggtcaattatgtaggattcctctctttttctgccttccttcctccctccttctctctctcacacagaaacttatatacagccaccccacaacacacataaatctataacttttattacctgatgtattgataagtaatctaaagttacataaaaatcagtagttcactgtcaatattgtaggagaagggaaggtctaggaaggaggaattacagaacaagaggatattttgagggtaattgacttgttatctatgtggataatgataatgtctgtgaccatatttgtaaaattgaacacttcgtgtggagactattatttttttatttaaccccatgccattattttgccgtattctagcatttctctaaaaatacagaaatgttcagcactcattcatgtgtatattcaggagtttctgacttttcatgtattttatttatctctgtctaattgctttgataccaaattttacctagtataattagtactacctttagcactgattataagtctcactcctccatcatctccttttttgccacacaagctgaatctagtttggactcataggagctgcttcattcaatgccagtggttgtttcaaaccctatcaacccccctacaaactgtcattaagaaagtttatcaaactccaccagtcatgtgatattagttcgttttcacagtggtataaagaactacctgagacgaggattttacaaagaaaagaggtttagttgactcacagtgctgcatggctggggaggccacaggaaacttataatcatggtggaaggtgaaggcgaagcacggcacatcacacagcgcagcaggagagagagggggaagtgacacatacttttaaactatcagctcttgtgagaagtcactcactatgatgagaacaacatgggaaaactgccctcatgatccaataacctctcacctggtccctcccttgacatgtggggattagaatttgagatgatatttaggtggggacacaaaacaaatctatagcaacatgtccagctgtgtcctggagttgtttcagggatccagtgtgtactgttgatagaaacagtgatcatcattctaactggtgtgagatggtatctccttgtggtttagatttgcatttctctgatggccagtgatgatgagaaatttttcatgtgtcttttggctgcataaatgtcttcttttgagaagcgtctgtgaaaaaaaaaaagaaacagtgacaccaagctcacaccatccgttgtagttgacaacatgcaaagccaagagatctcaactgagatttagtgtgtgtgtcatgtctgatgaagtcataagctcagagcaagtgaatatggaaaagtgtattatctgcacagtgtaggtgtctgctgagtgcagggcaggtctcacaggaaaatctaaaatggcttgaaagaagaggaaaggagactggctcagggtttttataatggtttagtggtggcggcagagtgaggcttcccactcacagatcggggtttataaggtttgaaactcccactgccattgaatgaagaagctcctgtgagtccaaactagattcaccttgtgtggcaaaaaaggagatgatggaggagtgagccttaagtaatcaacaggcatgcaccaaaagatagagtgacaacttattctaggtagcaagaataaaaataatgaaaaagaaataagggttcagtatcgatggacaagacccagatctacagaaatgagatgactttagaaatataaggaaataataatgagagaaagaaggaggggatggggaattagggtcctggccgaatgtcttgggtagaagcttctcacaatcaaggactatcagcttattctgcaggtcttaggtcacacgtctgcttaaaaacatcagaaatgccaggcaatcaatgaggatgctcagtttagcatctcctatttgagtagatttacagttgtgtggaattcttaattgattctttttggtttgtttttagaggcaggctctcacactgttccacagcttaaagtacagttgtgtgatcatagctcactgtaattttgacctccagactcacgtaatcttcctgtatcagcctcctgagtatctagaattagaggggaatgccacccctcacctgcttattctttaaaatattttttcatagaaatagcatctctttatgttgcccaggttggcttcgatttcctggtctcatgtgatttccctcactttgcttctgaaagtggtgtgattatagggaagatccactgcatctgtcctgaattgattctttacttgtaaaacatgaagccaataattaactgcctgactgttttgtgcagtgagttagttaaaagtttcctgataagattccttccaatatgattcaagagcagtattttctgccgatattcctttcagtttccttgttgaagatcagaagacactgcggaaaagatgtagtaaaaaggcagttttaactcttcatgattggagtggatatcacataggaatccctttccgtattttgtaacacatgcatgcaatagaacaaagatgatcccttggtgtaaaatctataaacgtatgggccttttagctaccaagtcatagggtaataactgatggaccctgaggagtgaaccatgattccatagtgctagtgggagaacccttggccaaggaagttcacatttcattaaaattgataatttttatgtagggatgccattttttaaacattcccagaaggttgtgagtgggattgactctgtcttctgtgaacaatgacagtgccctccatggttagataatattttaaactagattgagctagaatggttgctgtattgaatcactatatttttttagcttcatgttagctttttgtgtgttagcatttgctttaaaatgatattaatcagccctctagtaggtagaaattcatctgagggtttcttcccttgttgtccatctcaataggatttccagaagacgtaagaaccctctctgtttctaaaaatattccaggctgggcgctgtggctcatgcctgtaaacccagcactttgggaggccgaggtgggtggaccctcgaggttgggagtttgagaccagcctggtcagtatggtgaaacctcatttctactaaaaatacaaaaattcgccgggcatggtggtgtacactcgtaatcccagctacttgagaggctgaagtgagaggattgcttgaaccctggaggcgggggtcgcagtgagccgagattgtgccactgcacttcagcctgggcgacacagcgagactccgtctcaaacaaaacgacacaaaaaattccaaagttgtgcaccctctaaaagcatacgtacttaattctcatttttaatttattaaacatctctaataagttcaatgtttcctgccttctgagttgatttcctaacacatagaagaatatatcctaaatgaaagtttgtgttcttaatagaaattactagttaataacctttacttttattattgaggtattatacatcaatgttaatcctctcaatgggactcttacctaaagaatatataaaatattttcctgatcatgacataaagtagatgtgaacacattcttagcattcagccatgtctcttgtctattaatattataaaccacatgctaactttgattttattggtaattgttctaatttctttttttttcccacttctctggttgtttttttttttaactttaagttttagggtacatgtgcacaatgtgcaggttagttagatatgtatacatgtgccatgttggtgtgctgcacccattaactcgtcatttaatattaggtatatctcctaatgctatccctcccccctcccctcaccccacaacaggccccggtgtgtgatgttccccttcctgtgtccatgtgttctcattgttcaattcccacctaggactgagaacatgtggtgtttggttttttgtccttgcgatagtttgctgagaatgatggtttccagcttcatccatgtccctacaaaggacatgaactcatcattttttatggctgcataggattccatggtgcatatgtgccacattttcttaatccagtgtatcattgttggacatttgggttggctccaagtctttgctattgtgaatagggaattgttctaatttcaaactagttaatttttatcttcatgcagctagattattatgtgtggctatttattccgagagtgataaagacaacattaacaattttcactgcaggcatgtctaggcaactccctgtgcactatgaccctggggcgttggagattctatggggactcttccctacctgcctaggagagttctctgccttctacctctagcattttcctctttgaagaagtacatctaactgtcattagaatagagacaaagacaagtcttaactgcttccagctgaggagggatgctgtttggggaagatctctcttggaggtctaagggaccccaggaaaagggagccattatcccaggcttcagttgcatgaccatttggagtttgatggtctgaaaatgagaagaggcaaatctggttattagaagacatgtatgaaaaccaaacaaggtggcaaggacagcttgaaagaaaattccaaggctgctgacattcctagataactgcagctgtagttatgcctgctaaggtttgggcgcatggggcttggcttttgtcagctccctgggatttattttcccaaacaaagaaacctccaggttaggggcaccctattcattcccatcacctggcatgatttaaaggataattgcttagaattaaaatattgatccagattttttatattccccatcgctttttgtttcttctgggctgtagccagagatcattgattggcgctcaggaataagcagagttagtctaaaatgcaggcaaatacttaaacaactgaagagattagaatttaaagacaagtgtatgatatgttttgaaatacaatgtttctctttccagttttggtttttgtcagcagcaaataatgataagactgagttgtttgcaaaataaactttagtcttaaacttggcctgattatttgcataaagtgcagcaagaatattaataataattctgtaggaaaagcctgcaagcaccaggagcttcacagtctaacactatgagcacgtgcatcctcacgcaactcactgaatatgtccaagtcagcctgttccgatcttaaatgccatccagtggcatctgccccaggtacactaatacatgggtcctgcttctctctgcagccgcctctctcctcagatttcaggttttgtgtattgtttgttttctctctgacatcaacacagatatgttgaaggttttcttttttttatttgtagttgttcagctttgttgttaatgaggtcagaataagctcatagtttacacatttttacattcccatgccgagtagctgcttttctctatcaaatccattaactgagagaacaatcacatttcgttacaggtgaacagttaaatagtttggcatatatttctgtgctggaatctaatgcagcttgaaatcaagtcatgcctcactcattgaaaaaaacatggctaaattctcaaagaattgtgctgagtgaaagaaactaaggaatgaagagtaaattttatatgatacatttgtagaaattttagaagatgccactattataaattaacatggagaagatttatatgtttctgagaatatgctattgggagtaatggggatgtgagttaaatttcagaggaataagagaaagatttagggattaatttattcacaccttgattgaagtgctgagtaaatggttgcacacataggtctacatttttcaaatcattcaccataaatttgaattatttattaattacactcgaataaagcaataaagaaactgatgagataatatttgtctgaattgcagcaataaatagatcgatattaacacaaggaatataactgacttccccaaacatacacatgtgccgtggttcactctgcgtatttaggtaaataacagagagttgtcataacagatggggaatcctgcagacttcactaggcatgggccatactcccctggagttgtctcaggggagctgcctcctccagaggttagagcacaggcccaggtaataggactaaatttttagatgtgttatcttagacacactgcacacctgctgtgttctctatgtaaattatctcctgtaaaatataacattgaagcctgcattaaatatattgtgtaaatatgtaagaataaaagaaagttatgagagctaagtgttaatcaaggcacaagcatataagatataactatattttcctgaatgatggaattactaccagtctcccccaggacacttcatctgccctgagcccagcctctcctcagatgtcccacccagagcttgctatatagtgggggacatgcaaatagggccctccctctactgatgaaaaccagcccagccctgaccctgcagctctgggagaggagcccagcactagaagtcggcggtgtttccattcggtgatcagcactgaacacagaggactcaccatggagtttgggctgagctgggttttcctcgttgctcttttaagaggtgattcatggagaaatagagagactgagtgtgagtgaacatgagtgagaaaaactggatttgtgtggcattttctgataacggtgtccttctgtttgcaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagacacagtgaggggaagtcattgtgcgcccagacacaaacctccctgcaggaacgctggcgggaaatcagcggcagggggcgctcaggagccactgatcagagtcagccctggaggcaggtgcagatggaggctgtttcctgtcaggatgtgggactttgtcttcttctgacagttccccagggaacctcttaaatttagaaaactgtgcctaacaatgtcttctctatgcatatgaggaccttttctccctggcacaaaatgcagattgacgctgacacggatgaaaattcctcaaccatggtcacaaggatcagagtcctgagtaacctcagggcttcctggtgagtcttctccaatcagacccaggacagggacctccgtgagattccctgactggaacagtctttatggatcctggtcacagacaatagagaggctgaaccagggtcagcgtcatgtagaacctcacagatttcacgtctgatccttctcctgacacgaaagtatgcaaatcagtatcagcaccgatctggtgcttcttttgttcctaatccatttactttcttttttcgtcgtttttctcctttttccatttgtttttcctgctttttgcaaaaggaagatgttttccctgtgagatgcaggggatgacaattttgggagatggctggaacatccaatatcctcagggccggccatcagtaagtgcaggctggaagtctcagaaagagctgaagctgcttaatcaccgtggagttttaccttctccagttctgctctgatggaatcagggccaagcaggttatcaatgataatctacctaacatagagtcaaccgattccagtttcaataacgtctgttaaaaattcacaccaccacctggattagtgttttgtcaaatcaatacacagtattgtccagctaagtagacccaaagacggaccgttgcccatggagaaaaacattaacctgagttctaggttcttacagtgttaaaggtgtaaaactgattattaaaaatgaggctatttttctttttgctgttgagttgtagaagtttcttttccatttggacattaaaactttttgagatatatggcatattatccaattctgtaagttgtagttacttggttgctttgcagaatctttttcataatctattcccacttgttcaattctgctttttttttgtaggtgatttgaatgtaaaatccagaaaaagattgctaattttttgagggttgagagttttacaattacaggtattaaagttagacccttgaggcatttggagtgaatttttgtgtttattctaacctaaaattcttaattcttttcatgggaaaatccagttttcataccaccctctttggaagacactacaatttagccatgttatattgatggttctcatgctaaaaatcagctcgtcatcaatatgtgggtttatatctaagctctgtataggtatttatgccaaaactttctatgtttctaacaaatgttaaggcctggaagtgaaatgcctaaagcttgcattcttgccttgttacagatattggaccaaaatattctaaccttttactattgagtgtaataatagctgtggcctttcttaacggcttttattatgttcaagttgttttcttgtcttcctactttgttcatagtttttataatgaaactgatttttttcaaagtctttttctgtgtctgatgaaatgttactgaggtattttttctttagttttttaatgtggtgtaccaaattggttgatttgagaatgttgaatcaagtatgcatctcaggaagaaatttgagttggtcatggtgtatgtcttctaaaacactttggagcttagtttactattgttggggattaattcatgtctactaatgatattggtctgtagttttcttttattgtggtgcctttgtctattactggtaatactatcatggtagcctcatagaaagagtttagaagatatatggcagactacctttaaaatagattttatcagtggagaaatggtgatagttttttcttcacttttctgttgggaagaattttatgttgtttaaaagatattcagaatgacttaacctggtttatgagctttcattctattcctttcttccattctttttgaagaactgcttaccttttccttttaatttttaagtttgtttttagacatatgcaatacattttgaggtgaaacctggtggaattttttctaataaattagaaaaaaataaatcatttaattgactattttattcaggttgatttgtttaatatttgctaaaggccagttctttaagctatgacacataataaatcccaaatggcagtacctcattgtttacttagcttttgtacttatatttctcagaggaagaaccactactgtaaattgtaaatagccaatacataattgtattgtatgcaaatctgtgactgtttacagtgtcatctctgagaaacataaagtttatttactatatatatataaagagtttggaaggtggactcctcaccaatttttgaaagagttacagaagggctggcattacttctttaaatgttaaggttcattttatgatgtgacatataacccatcatggagaatgttcaatgtgttcttgagaaggatgtgtattacgtgactcttggttggaaggttctgtaaatatcattcagataaatttgttcaatagtgttgttcaagttcagaggcacattaggaattttctttccggatttgctatacattatggtcatgaggtattaaggtcttgtgttatttttgtattgttttctatttctttatatctcttacagtttgcttaatgcagttatatttgtatttgtacacatgtgtaaaaacaaaaatcataattgctaaatgagttttatggcacagtcacattataagtaatatttttccaaatgctaccattgccactaaactcctcctggagtctgacgtctgctttgggcactgccttcttctcaggcatcccacactggagcttgctatagaggaggagggagggcccctctcctggtgaaaacaagcccagacctgaccctgcagctctgggagaagagccacagccctgggattcccaggggtttccatttggtaatcaggactgaacacagagaactcactatggggtgtgaattaagctgaatttttcttgttggtattttaaaaggtaactcatagggaactagagtgagtgagagtgagtggatatgagtgagagaaacagtggatatgtttgccagtttctgaccaggatttgtttgtattttcaggtgttcagtgtgaggtggagctgatagagcccacagaggacctgagacaacctgggaagttcctgagactctcctgtgtagcctctagattcgccttcagtagcttctgaatgagcccagttcaccagtctgcaggcaaggggctggagtgagtaatagatataaaagatgatggaagtcagatacaccatgcagactctgtgaagggcagattctccatctccaaagacaatgctaagaactctctgtatctgcaaatgaacagtcagagaactgaggacatggctgtgtatggctgtacataaggttccaagtgaggaaacatcggtgtgagtccagacacaaaatttcctgcaaaaagaagaaaggagtctgggccaaaggggacactcagcactcacaaaacaggtgcagccccaaggcaggtgcagatggagggagggtaagggctgctttccttcaggatctgtggtttcctctgcttctaatatttcccctctgagcctctgtacatttatattttgtgcccaccatgaggtcgctggattagaaaactaatttgaaagaggaaatattctcatatgtcctaaaaacagatgtaagtattggaggcataaaaatgcataggagccgggtgtgtctgtagacactgccacccccaatgccagacccacaactagtgctggagaagggtgggagtttgatggagcttccctgatgaccccgtggtccaagctaagtccagcaaggccattggtgcctcgctgagcacagttgtccatcagggatctcccatgtgtcccagcagcagccatgcctcaatctctccactgtgcacagccattgtctgggaggagctcccaggatgggtgtctttggcacacacagttgatgggtgttagagtgcagtgcagcagctggctgcctggtctattgggctcctggatattggagggatttgaggtgcattctcagggccagcacgctttgtcaatttttatatgaaaaccatgtgatttaattcattttctcagatgacatagataattaataacacaatctgcaaacaattataattttcaactttaccccaagttcattgtttctgaattctgtgcaggatccagacatggtactgcccttctcatgagaaactgttcgatctaaactgaaaccagttgtttctcgtatactttggttctccccacatgcagagatcttgattagagcaagtttggtactttccacgcactcaccctcacctccccagataaagagcagaagttctccttagactgagtctgagggaggagctgttcctgtaccactcagggcctgcggagacccccaggtgcagcttcactgagtcaggtgtttcactccctgtgattgctgctcaggtctaattgtggctcggaattaggacagtcttcacgttatcacacgtcaatcatattctaaaaatcatcgttatcacacaccatggtaacaattcaaggttcatttttctaacggcagtttctcttttttatttggttgcaagtttgaggaaaggaacatgtgataatactttttaacctaacctcgaaatctactgaattgttctaggagactcacaaattggacaaagtgagctctttattctcataaaaatgtgtggttttgggaatttcactgtgttgcccagaacctgttaacatcaacaactatgtttctcagcacacttctggcttgagactccttgcagaccctctcctcacctgcactgtctctggattccccatcataaccagtgtttcctgctagaattgtatctgcttgcccctagaagatggacaggagtggatcaggtgcatgggttgtgaagggagcacaaattacaacccactgctcaagagtccatatccagatccaagaaacagttcttacagctgagctctgtgcccagtgaacacacaactacgcatttttaagcaaaagacgcaatgaagggccttcattgtgagcctagacacaaccctccctgcaggggtgaataggagcagcagggggcattcggggcagtatgggggcttaggatgattgttaggggtcaggatgagcaggatcaagttcgcatcagggcaagtgcaacagggcagaaaaggggctgtagatgtgggttgttctcaccataatatttcaccaccagacaccctccaatacatctcttataatgtgtcggagtgttgatatgattagaaaatggcatttatgtaaatactaatatgtacccatatggaggtgcatccagttgtcttctccatctgaggaggaccttgtccatcaagcactaagtccctgtatttacttgagtacctcacacattatggtcaaaacaggtagggtctccttttggcatggtctctcctcctgccttctctcttctgtcacacaaaaacacgtgaactgacacacacacagagcttcccaactttaattatgtgatgtattgaagcaaattgattagtgtgcagcttttctgctttgcctgctattcatgttatgtaaaaataagaaccatgttttctcagcttgtcacttctctaagctaagtagcatctttgtttattatacccagagaccaaaagcgatccaactgttattcagcagcttaactggtaaacaaattgtggaaaaatcacttactggaatcatacccactgctacaatcaagtaatgctggatacacccaacaccatgcttaaaatagcaagtacttgaataagtaaaataagtcagacaaataaaagtgcatacatacgattccacttctataatttctataaagtaaaaatgaacttaaagttacataaaaagatctgtagttgactggggacatggtacaagaagagaaggtatagaaaggagaaactacaggagaacaaaaggaaatttctaggataattgatttttttctctgttagtaaaagtgaggattatgtcaatatttgtaaaattgtacactttatgtaaagattcttatttgctaatttcacctcattaaaatattgcaattttttaaatgtctagtttggtagaaaaggtagtagagagagatgaataaaatacataaaaatcagagagtcctgaatacacacatgaatggaccctgggtctcactgtacttttagggagacactagaatacaaaaacataatgacaggatttcagtacatgaaaggagcttctcagaccccaggaggcctgtccaactgcgtctgggagttaactcagggagcaggcatgtcctttggaaggagccgtgacaccaagctcccagcatccattgtagccgacaccatgccaatgccaagagatctcaactaaaattttctgtggatgttgagtctgattatgccacacactcacaccaagtgagtatggaaaggatagttacctgcatccttaaggtgtctgctgagagcagggcaggtctctcattaaggtccaaagtggcttgatagggcagggaaggagactggctcagggttgttatcatggtttggtggggagcggggcagagcatcctacttgcaggaagggttttgtggggtttcaaggccaaattggcatcaaatgagggagctcctgtgatttctaactagatttaccttgtatgcttaaaaaaagagatgatggaggaatgagcctgaagttatcagcagtcaggcctaaacacagagtctgatgacttactctaaatagcaagtatacaaatgatgagtaagaaaagagacaagactccaatatgggtggacaacagccaggtctgcagaaaatgagaagactgtttataagcaaagaataatgagtaggatatggaggaggattctggtccaatgtcttgtgtggaagcttctcatgatttgagatcatcagcttattctgaaggtcttaggtcacctgtcttcttcaaaatatcagaagtgcctgatgatatgtgaggatgcgcagtttaacttcctctatttgagtagctttacaattgtgtaaaattcttaattaattaatttttttttgagacggagtctcactctcttgtgcaggttggactgcagtggtgtgatcataacatagctcacggtgattttaaattcctggctcatagaatcctcccacctcaacctcctgactagcaagtagctaggtttccagggcccttcatctacacttggccggttctttacattctttttttttttttttttaggtggagtttccctcttcttgcccagaccggagtgcaatggcgccatctcagctcactgcaatctccccctcccaggttcaggtgattctcctacctcagcctccagagtagctgggatcacaggcatgtgacaccatgccccgctaattttgtatttttagtagagatgacgtttctccatgttggtcaggctggtctcaaactccctacctcaggtgatccttccacctcagcctcccaaagtgctggaattacaggcgtgaggcaccacacctggcctcttcgtttttattcatatattccttcagcagccactatgtcttcccactgatttcttcagtttctgccttttccttttgaataaggctgttactcctgagggaagatgggaggtgggcctggacagggacttggtgcattcctctctcccctcccagttcttattggtttctccagtgtctgtagaacagtggttttgatggctttacctctgcagataatttctcttgcaatgtagtggtgatggggaggtgtgtctggatgcatttcagctgtagttgctgttttgctttcccagacagcaccatcccaaggggtagaggctggagcattttgtgatgtatccccagtactgaagaaaaaggcttcaatagcaggaggaattcctcaactgcatacactctgagaatttaaacaataacttctctatcacactcaaattgaaaccacccaatgaatatgtctactttaatcgtgtgctaacttaaatgacatttggcagcctctgtcccagaaaagattatcatctgctcctgtttatttccctgcaagtctttatgtctgttcagatttcagatatattgtttgtcctataacatcaaaaatttgatgtatatatgctaatttgcagatcagtaagtttagtatttgttataagaatagtaacatatttttatggggtgcttacatctccaagctgagaagcacctctgtgtaatactaagcaactagaaatggtacaaataccaagaagatacatagataaacagtaatggcatgctaatttatggtaataacatccatcattagaatcaatacattgttgatgctcaacatgtgtgcatcataagtagttatgtgcgagaagccacacaaataaaacacatactatgtaattcctgtataataaattctcgaaactcaaaactaaggtattaaatgtgaaggactgactcagaatatggtggaggaagaaaataattgggaaggaggaattgtagaggaacacaaggaaacttttaagtgtaatttgtttattcattatttggatggcttttggggatgcacaggtgagcacgagtggaataacattttgttttgtttgtttgtttgtttttttctgaagagatgtggtcctactctgcgacccaggctggagtgtagtggtgggatcatagttcaatgtagcctccaacttctggtctccaacaatactcctgcatctgccatctaagtagctggaactaccgttgtttgccagcaggcttggcttgagtacttattaaaccgcacactttttgcaatatttaatgtatagtaataatgtctcaataagactattacaaatcaatgaatgaataatttgttctgtacagatttatggaaaaatagacactaacatgatgaatgactgacatttatgaaaatacagctgcatgaaatgtgcttctctttacattcattaggtaaacacataggtgcatacacatcacaccgcgctttcattacaggaagaaacatctgaaaatgtcactggggtgaaccatattgtgctgggcttggttcaggaagcagtcaggcccagtgttgtgaccttcaaccacagaatcctaaaaaataataaaagaggctcccccaaagtccccatcagttcctggactcgccatgtgtctgggccgtatcagtgcatccggagctccctggtggctttagggattccttgcttgccatgctgaggtctcgctgtagattatgttgggttttctgaggccgttttgctatttaagacccactccctggcacagagcgattccctctaaacctgatagaggttctgaactacaaataacgttaagtgaatcctggtgtgtctgaactcacatgattgttacattaagctgctgttgcaatctgtttcctcacctgggaaaagaggagccaggacatagtgagttgaggccccaggaagataactgaattctcagagggcacaaccagcatcctccttccagggagagcctaaaagactggggcctccctcatcccttttcacctctccatacagaggcaccacccacatgcaaatctcacttaggcacccaagggaaaccatcacacatttccttaaattcagggtcctgctcacatgggaaatactttctgagagtcctggacctcctgtgcaagaacatgaaacacctgtggttcttcctcctgctggtggcagctcccagatgtgagtgtctcaaggctgcagacatggagatatgggaggtgcctctgagcccagggctcactgtgggtctctctgttcacagtggtcctgtcccaggtgcagctgcaggagtcgggcccaggactggtgaagccttcggacaccctgtccctcacctgcgctgtctctggttactccatcagcagtagtaactggtggggctggatccggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaacacagtgaggggaggtgagtgtgagcccagacacaaacctccctgcagggaggcggaggagccggcgcaggtgctgctcaggacgagcagggggcgcgcggggcccacagagcaggaggccgggtcaggagcaggtgcagggagggcggggcttcctcatcagctcagtggtctccctcctccccagcacctcagctgtccccaggactcctctttctttattatctgtggttctacttcctcacatccttgctgcaggttttaacagtcactggcacccttttttcaacaaattcccacaaggcccattttaccttcttgacaagcaaaatattctaaggcttctcactatcccttgattggcgtcatctactgcatcgtgtctttctcttaaattcatgtgatgaaaccccaatcccagtggctctgtattggacagagggattttaagagggcaaataagttaactgtggccataaatgtgggaccctaatccagtaggactcttgtccttatgagaagtggaagacatcagaggcctctctctccacatgcacacagaggagagtccatgtggggatgcgctgcatgagaaggtggccctttgcaagcctggaagaggcctctcaaaaaacttaccctttctgcacccagatcttggacgtcaagactccagaacaataagaaaattaatatttgttatttgaaatagcctagtctgtggtatcttctcatggaaagccaagtagattcagagattcaattgtgttagctccgtctcctgcatggagtagcagcccaccgaggctggacacatctctcaaattattttcataaagaaaaatagatccaagatgaaaaccccaccacatttctgctgagccattcacttagcagcagtctctgagatcagccctgggggtatgttctaggtcgtgtatctcactttccactatgagaatccatgtagataatgagaaccagccagatggagtcctgatccctgcccaccttctgcttccccccaagtgacacacggtcacagaaaaccactccagcatcaccctgtgtcttgtactctctaaaatcccactaaagctgaccctaaactaggagctatttggggctggactcattctgttcttagtcttccataaggtccaggtgccgagtagagcctcagtaaagagtgagcttcaattcccctaacccacatcattcccttacatccttgtcatgcacctgtcctctgcaggcacccagggcaggttacacaggaattgcctgaagctggtctcaggtgccctgctgagaccactggttatgcacacgtatgatttcaggtcatgcaggctcttctgcaggacagacctgtgtcctgtagagcacagacacttggtgacccaggccctcctctaataactcatacatctcatgtcagtgtatatccaggtgccccctcagtgcagcacactagggtgattaccctcacaggtggctttttcaggcggtgaacagaaaatggggtgggcacgctggtcattcccatcatcggtgatatccaagtgaattttaaataaatgaaacaaaactaacaacaaaggggaaggatatgtacctgtatctgggaggtagactgggtcccagaactgtactgggagtgggtgtgaaaggcccttttgtgtgggaagccctccagcatgagtgaaagctgaaggaatgatcactgtaggtggagcctgatggagaagctggcagggtacatttcctgaagctgttcccgggtgcgtgatggttcaatggcccatgtacatgaagaggagggctggactcatgtaggatcaaggaaactaccccatggcaatggaagaaaagaaaatggagatggacacccctggaggcagcttattagctttggtggaggaacgatgggaatttattccaatgaccccagcatcttcagctaaatatgagttgcattaacagacagaattatgaagggaagggagaaggagtttatagagggaaaaagcagaacagaaaaaaagaactacacaagtctatcaaatggcagatgacagagtgtagctgatgcagctacaccacacttcccggaacctaccagagaccttgacacccctgtaaggcaggtctagtggtgatgcacttgtccactttttgctttttggagaaacgtttgaaacatcctacattactgaagaaaagctttaattagtgtaatatttttacttgacagttttattggttttgttttattttcagcaacttgaatagaatcatgcacatcatgatatttgggtgaacaacaggccacatacacgataatgatctcattaaattataatactgtattttcactgcatttcttccatacttagatatgttcatatatatacatacctaccatggtgattcaactgcccacagtattcactacacttacatgatgtacagatttgttatctaggagcactatgctatcccacacagcctgggtgtagcagggtatttcacgtatgttcacgtaaacacactctatgatcctcgcatgatgacaaattgcctaaggacacattgctcagatgtatccctactgttaagctacacatcattgtatctcatctctctccatttttggtctctgataaaattctcgtgttgtttttgcattcttctctgagctcattgaacacatttataaggtttcctttgaattttctgccaggtaatcaatatacctccttttaatttgtgtcagtttctagtgctttgctttgttacagaatttggactgctttttttctctttcattattattatcactttgtacattctctgttgctttctgctcattagaaggaaaagccatggtaaccactcttcacagaatatgctcagggcaaatgccatcacctgttagcccagtccatgatagtggtgtctcttaaaatttcatactggtccaaactttttgttgttgttgttagtggcactcagacctatagaggattttaagttttcccctactctaaattaggtggcatcaaaattcatcctgcaggcagtctctgataaagtggagaaattggacaaagttttagcatgtatatggttcataaaaataatatgagtttaaggttttctcagccagttgctacatattgatattttataatcatttctttgaatgtctctggagtttatcttttgaaaatttagatcagaatatataccaggtttgaggcttcttgtctggcttaacgatctcctataggtcagcgtgtgaaaaggcacagagtctatctgaagaggagaactcagggaagccccaaaacaacagaggagacaaaactgaggactttgaggaatctaaagcttctgggacctgcagcctccagacatgctcagcaccctcttgttatccacggactaatttctttctcttttctgagtggtattttctagggttcccgtcctccactttgacactttggtatgtccatgtgtgtccattgtgtttcagccagggacacagaaccaggaaaacatcatggcttttctagagggagctgacctgggtaatcaacagttggagtagaaagtgcctttgtccatgtgtcacaggcctaagggccatgggcaggaggtcaggaagagaggatgaccagacggctggggaaaccaggatgaacaaagccactctccttcctggtgagaaggggcatgtggaagcctggtgtccctgtagggctgaaccacactcacctgcccactgctacctgccagcgaggtgacccacagagcagcagcagctcctgagtcactcacagaggctgcctcctcctccaaaccctccagtgtatgtgcttccataagtgtgagccccagcagatcccaaagttttcaatgggttcatctagctagtgtctgtcctcagccccatccccaggctcctgccctggttggtgtccacagtgtcccagcagcggtgacagtgacagccagggcctgcactttccagagcagcaagtttggaagaatcaagtcccagaaccagcctggatttggggcaaacacacaaatttcactctgaggggaagtgctggaaagtagccttgagtcttcctcagctcacctgtggctgatcctctgcatcccatcagcgatacatgagccctccccaaccccagcgtggagctgtttcaatcgcagcaggatgggaatgtgtcttctttctggggactttttaagcacagctcttatgttcctgagatttgaggtttataaaggtgtgtcagtcacccacagagtggacctgcacaagtaagacaaggacaggatccccaggagaggcacctcatatgagacgggacaggcaggtcccatcacagacactggtcctcagaaaccctgaccagctactcaccttcccaggtcacctgtgtgtgatcagttcctgtgtttgctcctgaaaagatccccatcaagggtccccaggtcctgcccccttccttgatgtgcctctgggagtggggctggctgggctgtgggtctgctgtgactttccccacaggtcagcggctcagtgcaggctgcgccaactcggtggggctgggctgtggccgaccctcccagggggagcctggatgcttctcgggggcatctgcaggatcccaggttctgggagaacagggaagccacagtgtgtgcagggccccatctccaggtgtaaagtgtttgctgtcactctgttgacaagggcatatccccaggcgcaggggcactgtgggtgcacaaccaatgtggtagacacagagagtgaggcacatatccctcccattactgtggggaatataggcactgtgtgtgtgtgtgtgtgtgtgtgtgtgtgtgtgtattaggagttttgcagtgggctctgagccccgtgattttgtaggtttagaaattatctgatgagatgttcatccacaggaaccgacaagagattaggtgttctcccaaagcccctgggagctcctggactcattgtgagtgtggactgatccattgcttccagagctccacagaaggggctccctggtggtttcatagaatccttgcttggggtctttctgcagagttcactggctttcctacggccagtttagtattgtaagagatggtgtcagcagcacatggtatcacatgtcactaaatgagcattctgagccaggacacagcatcttcatactggggggagggaaatgctttgggagcccagacaggagcctctctgcagtgcaagggctgggctgcagggggcgctcaaggcccacccatcacaggctccacccccagagcaggtgcaccggaggctggggagggattcctctcaagatctgtgtcattcttctaaaaaaaatctaaaatgagtatttgacaaagactgctgaacattctataaatatcctattcaattgtgagcatttatcaaatttgatgttgtaatgagaaccacttttatactagatatttctaaccctgctagatatcttaatagtatgcagctggaggttaagcaagcttttcttttatataaataagtgcaactttggagaaacacactcatcccccgaataagacattcatgtattaaagcctagaaatactttaaattacctctgagccattcaagtgtgtgttcacagtgaagtcctgttctagggaaaattgttctccagggggagaagctttgtcaacatagagcttagggatgtatcaggaggcacatgacctctaaggggattatagcttgaacccttagcatcctcctgttggtaatacatgtgtcactctccaatctttctcatgcagtatcaggtatgaaataggatcgctcatgaatatgcaaataactgaggtaaatatagatatctttgtgccttgagagcatcatccaacaaccacaactctcctcagaagaagcccctagaccacagcacctcaacatgtactggacctggaggatcctcttcttggtggcagcagcaacaggtaagggacctcccagtcaccgggctgagagagaaaccaggccagtcaagtgagacttcacgcactcctgtctcctctccacaggtgtccactcacaggtgcagctggtgcagtctgggcctgaggtgaagaagcctggagcctcattgaaggtttcctgcaaggcttctggatacaccttcacaagctatgctatcagctgggtatgacaggcccatggacaagggcttgaggaaatgggatggatcaacaccaacactgggaacctaacgtatgcccagggcttcacaggacggtttgtcttctccatggacacctccgtcagcatggcatatcttcatatcagcagcctaaaggctgaggacacgtgcaagaggcacagtgtggaaacccacatcctgagagaaccagaaatcctgagggaggaggcagctgtgctgagctgaggcagtgacagggacaacgtggctgcaccctttgttgacatagggttatacacatacatatatatgcacccaacactggagcacccaggtatatcaagcaaatacaattagagataaacagagagatagacccaataccataatagctggagactttaacaccccactttcagcattggacagatcttccagacagaaaattaacaatgaaatcttagactaaatctgcatgacagaccaagtggacataatggatattgatggaacacttcatccaatggctgcagagtacacaatcttttcctaagcatatggatcattctcagggatagaccacatagtagaccagaaaatttgtcatttttaattaaaaagatatcatgtaccttctctgatagtaatgaaagaaaactaaaataataagaggaattttgaaaacacatggaaattaaacagtatcctccttaattaaacaatgtgcttccaaactgaactatatgctctaaaatgggttaataaagaaacaaacaagaaaattttacaatttattgaaagaaatgataatgaaaacacagcgtatgaacacctatgaaatacagtgaacatagtactaagaggaaagttcacagctataagcacctatgttaaaaaagtagacaattataacataaacatcttaggaatatctctcaaaaaaaactagaaaagcaagagcaaatcaaaatccaaacatagtaaaataaaaaagttaagatcagaacgttaataaataaaattgaaataaataaaacaataccaaagatcgatcaaatgaaaagttgttttttaaaaagataaaagacatctataaacctttaaccagaccaagaaaaaaaacaaagaagaccaaagtaaataaaatcagaaagaaaactggaaatattacaaccaatagtgcagaaaatcaaaggatcattagaggctactaggagcaactaaatgccaataaatcgaaatatctggaagaaaaggataaatttagagacacatacaacctaccaagattgagccaggaagaaattgaacaggatcagtaacaagtagtgagagtgaagccataataaaaggtctcccagcaaagaaaaaacccgggacttgatgacttcatcactcaattatgacaaacatttaaagaagagataatacctaatctcactcaaaatattccaaaaatagataaaaagtagataaggaagggaagaattcttccaaacttactgtacaaggccaatgttacccttatatgaaaaccagataaagccataccaaaaaaaaaagaaaactacagttcaatatcactaatgaatatggatgcaaaactcctcaaggaattcttagcaaaccaaattcaataacatatcaaaagagcattcatcatgaccaagtgtgggttatcccagagatgcaaggatggttcaacctatgcaaatcaatcaatgtgacacatcgtatcaacagaatgaagggcagaagacgtaagatcaggccttaccttgttctcctcactcaaagtctaccattagttctttggtcctcttgaccagtcctgctgtacttggtctcccgtgattctgttcccaggtcctgaaacactgggcttctgcacacctggagtctctctctttgaacatggagaccctgtatcctcagagagggatgatgcctcattgtggctcccatgccccatgcaaacaattcttccaacacagtcatgatttttcctgttggaaattgaaaggggatgtgggaattgatgtgtgtgtgtgtgtgtgtgtcctcaggcctgttgggcctgttgagaacacagcagggctctatgtacaacaggaaagcaatgttttctctataccatctattttcttataaagtgttcataggtaatcaaaaggaaatgaatcacagtttataagatgttgtggactggactgatgttgtcactcaaggctactatgggggctccaggaaaagaaacctagaaaaggataagactgtgagcaaagaagcaaaacctgggaagcagcagggagagggtgagcaggggtgactcaactggggagggataacaccacttaccacagagggtgaaaactccgtgctcagcaaagaggagaacttactcagcatttcccctaatcctccctccagaagcgcgactgccaggaaagttcacaatgtatcatctccagctgggaacccaaaagaaacaggagattttagggcataggtcctgggcacaaggtgtttccctggttcctaccccttccctctctgtccagcaaaactgcttgtttctatcacttgccttcctgtccttggggtaagaatggatgctttgacactcagcagagggatgctctttcagaggaggaatgagtttgtgttatctgatgtctgagcaggacactcacctctgggaagaggctccaagacagaaggtcgccgtggttcctgccccttatatgtgaggggctcttgacacatgcacacttttcctcaaactctgtttataccccagcaacaatgctgggtgttgtcagcctctctcctccccagatactgctctatcatcagcttgagcacagtttccccatgaaaggcattattctctctctcaagaagatcaactttttacatgtcttcgatggatgacagtttctctgtgtgagaatctagaaataagaaatggggtaatggggacaagtgagctctctgtgtgactcactaggaagtccactgttattccaggtgtcctgtcccaggtgcagctgcaggagtcaggtccaggacccatgaggccctcagacactgccctctgcctgtgctgtgtctggattcttttttttaccatggatattatttgagatgaatccaccatcccgtgggcaacaggctggaatggctggggcacagttactagactggatcatcaaggaatacacatcatgcaccctccacccaggtccatgtccccatcaacagtgactcaaccaagagccagttctctgtgaagctcagctccatgaccacctaggacacggctgagtattactgtgaaagactcagtgaggaggtgtccttatgagccctgacacaaacctgtcagggcacttaggacctccaggaagactcaagaccaccaaggggactcacgaccacttggggaagggcaggttgcagtaagcacagggccagccccagagcaggtgcaggtggagatgagaggctggtttactgtcagggtctggggctgcttctccatttagatgtttccttcagagaccctcccttatttcatgatgctctgcttagctgtaagtctctgaaatatcacagttttgttgtaccaggaggaaaccttctctcaggtgctaaatgtagaacaatctctctgccagtggttgccagggtcacagccctgtggaagctgaagggtacccagtgagtcttctccagtcacattcaggacaggaaccttagtggggttccctgaggagaacagtctttaggaattctaacctcagccaagagaggctgggccagggtcagtgtcaggtagaacctcacaggatttacgtctgaccctcctcctgacactaaagcatgcaaatcagtatcagcactgatctggggcccctttggctcctagcccattctatttcttgttagttgtcttggttgttgattttcctttgggtgttcctgatccctgtaaagtggagacgtggttcctgctgtaaaaattccagggcctcaagccctttccctgcagctcaggtggggctcagactgtggctcctgcaaccacgtgggagaggctgatgggactatcttctctcccgttgctcagaaccctccagtgtgttgtgtggagactcacctgggaatgcaagtggccaatagttgtgaaaggtatgcgcttgtttggtcaaagtggaatgtggatgtggaatttatcctgtgttgtgcaaactaacacaggttcaccttcctcacctgtagtgttagaaagagtgtgaaagttgtaagaatcaaaacagagccacttgtgttaacaccctgacaaatggacctaggaatgaacatgaaggagggttcttaggcccatattcctgataacaaaaactatcataaatagactctgcttagccaccatcttggatagaagcccaccacaaccttattaaaaattacacttgcaagaacatcagctcagaaactggctgttcaaccttacactgatgccaccattgctattgattctacaactatatgataattatctcaaaacaacttttgtgacccacctcattttcacttcataaacctgtggattgacatgttggagttactgctgcatttgtagataatgataaataataaggccttttaacaatgtttgaagctgctattctctgatatctcttctaaaataaagaatttccaagtggatgacaatgaaaaaattgttagaaatatttggtggtaaggcatctttaacatcctgttgaatgtttctgcatagcacatcaatcccttaaaatactttgctatatctgcatttaatgaatgagtctaatattgaggtgcaattgaaaatacctgggcctttgatgaatcagctcatagggtgataatgtctgggtccttgagaaagcagaccctgtgttgtaagttttagtagaagtaccttttgcaaagaaagttcatgtgtttctgaacattatgctacttttaacttaagaatgcaatatatgatttatttttacttcaaactgggtatatacccagtaatgggatcgctgggtcaaatggtatttctagttgtagctccttgaggaatcaccacaatgtcttccacaatggttgaactaattttcactcccaccaacagtataaaaatgttcctatttctccacatcctctctagcagctgttgtttcctgacttggtaatgatcaccattctaactggaatgagatggtatctcatcgtggttttgatttgcatttctctaatgactagtgatgctgaacattttttcatttgtctgttggctgcataaatatcttgttttgagaagtgtctgttcatatcctttgcccactttctgatggggctgtttgttttttccttgtaaatttgtttaagttctttgtagattctggatattagccctttgtcagatgggtagaatgcaaaaattttctccgattctgtaggttgactgttcactctgctgatagtttcttttgctgtgcagaagctccttagtttacttagatcccatttgtctattttagattttgttgtgattcatacttggttaatttttaattgcattgttttcttctgattagttgtaagtatacctgcatattgatcaaaaaagccgtttaacaaatcaaaaggaaacatttaacaaatacgtgacttggaagtattttctccaagtctgttgttgtcttttactcccttgtcagtgtgtattgcagaaaaatatgtatgtgtgtgtgtgtgtgtttacaaattaaagaaacaggtataatttcatttatccatagatcacgtctttggcattacatctgaaatctcatcataaaatatactaatagtgatttttttttccatgtctctaatctcaggccacaatctactcatgagtgtttaaacatcacctacttgattagaggactatcaccctaagatatttggaatatttctggaaggagatgtgttctttttcccattatttcctctatttagtcatttattaatatccgtattggtttatgaatgtctatttcatactctgaagtaaatccatgctatattattcattttattgttcaaatcaccacagctttattatgtgcttggaactcatttagtttggatgctgcatccttacagcacacctcatcattttgtttttgaacactttcctgtttcctggtattacaatacattctaagcccattttctatattaactttttcatacatagaatcagacatttttctaaagattgcttctttctgatgttaaaatatagtattaaaataaaatttgtgatactgggtatatgtgttgttaatgtggtataagtacttttaggacctctcaaccaactggcctagtaaatgtgcatgtttatatgaactcatgtttaaggacacattgaaactatttatgtatcttatattctgtaactttattacattaaaaatgagaatacactggtctcctcacccaactatgttaccaccatatcgacctttctaggcttccttgactgtccataatcacccactgcaaagtgaggaaccccatcccatcatatgccattgtattactagctgcacatttcaggacacatgcattgcagcatcagaaatgtaaagctgtacccttcttggagccatttttatctactagaatagagtgcttatgtgcagtttctttacactttaaacttatagaatttcctcattttcaaagttccttagatcagcaacttcgttttccactttcttcatgaagtcatttcaattacactgtataatttctttatttgaattctgtaaaagccgaaaactacagtcaagtaaacatagagaggatattccaggaatttacagagtgggtatcaaataagttaaaaaggcaatgtttaagaagagtaaaactatttttagtgatatgcgatggttgagacatgacacaattaatttgtctaagctcataattttgtgatgaaaaatataaacctaaatatatacaatttaaaatgatgtttagcagtacattatccctaggatcaaatgcagactgtataaaattatctaataacttatttggtgaggatgccatgagacacatgcaacggaggatgaactaattttccttatttgcatataagatgttgacattcactaaagatctttaatttaaaaaaaaatcaattttctatgtgacccaggttttttcttccagacaagcaaataacccacaggattattttctttccttgattgagaaagattttccccaaacttcagctcagttcaggcatatactgtccctaaatgggcatttaccctcagatgagtccacacacctgtcaacacgtggagtcttctgtcagacaaacacacctttactgatgtggattcttccctcagacaaaaacacatgtccccacatggacactttcctcagactaccatgtatgtccttacatttacgctttcctcagaaaacagacttttcctcatgtggactcttgtctcagacaagcaaatatgtctccatgtgaactcttcactcagataagtacacatatgtccacatttactgtttccctacacaggcacatatattcaatgttgaattgttttgtggcaaaatgatctcaagataatggtaattataaaccccctccctaataaagtgtagatctgtattttttttgttgtaacctaactttgccttattgtcacaaacagtaatttgcagctctaaatgcaccagttagagacaggtgtccattttctctggaaatgtatttttattttcttactggacatatttgttgataatgttgctactatgaagatacctgaacagtatccacattaaagaataaaaaagagtaatgggcagaataaccctgtgcatccagacccagaaatccgttgaccctgccctcccgaaatgaagacacagaggatggatgagcagtgctgagcagtgtacccatgaccacaaacatgaagacatggaaatgtgtccccactcctcctcatgaaaggcagctcatgccctcttccttcaggccctggtatggagccaccccatgtctctgcccttccttagtgtccacaccatggggtctgcactgatctggattcccttctcatccccctcaatattagtgtgccttgtgaatcaggtccagctgtggctgttctcagtctgtttcctctgtattcacagaagtcctgtgtgatgtttactgatggagtcagaaggagaaaaatttaacagcccagcagttcactgagactgtcctgcaaagcctctggtttcgggtttactgggtgcagcatgagcttggtccagcacgcttcacaacaggaattggtgtgggtagcaacagtgagagatcatatgggagttctaagggttactctccatgagtacagataaatcaacattcccaagtgacaccctttcaagtgcagtctaccttacaaggaccaacctgaaagccaagggcaaggccgtatattacagtgagggacacaggggagggaagatctgtctgagcccagacacaaaaatctctgcagagagacaggagggaactgcgtggtagatgctgctcagaaccaccatggggtggccaggaaacaaggggtgcttaggacctctagggagcgctcaggacgccaggggggtgctcagaaccactaggggacgctcaggacactaggtggcgctcaagacaacactgctgcactcatgtcaccacggggtactcagaaccaccagggggcgctcagaaccaccagagggcgctcagaaccaccaggtggcgctcagcaccaccagggggcgctcaggacaccagggggcgctcagaaacactcggggacactcaggacaagagggggtactcagaaccaacagggggcgctcaggaccaccaatggttgctcagaaccacaagggggcgctcaggacataggtggtgctaaagacaacaattctgggctcaggtcaccagggggcgctcagaaccaccaggggacgctcaggacatgcaggttctcttaggaggcagctgcacatcaggagcttcagaggctgtgatttcctttcagaccctggaaattcctgacctggtcaagcaaaagtcttccccaggatgtctgatttttccttttaattccatgatttcttttacctacaaaacactaacttagaacagggatgtaatgcaacttttattgctgcgtattttctgagtaatactagcaatgatctctcgggacaattattaaaataggttatttatatattttaattattaaaaataatactattattaaaatagtaaaattttttaaatcacacttgtaatcccagcacttggggagactgaggcagacagattacttgagctcaggagttttagaacagcctggcaacatggtgagatgctttctatacataaaagaagaaatagctgagattggtgcaaccagctacttaaaaggctgaggagggaggattccttaagcctgggaggttgagcctgcagtgagctatgattgtgcctccacacaccagccttggtgacagagtgagaccctgtcttagaaaaaaaaatgcatatcctcaatacagactatttccatgaatagagttttgtgtttttgtgctgtaatagtcaaacaattgtatatgttttctaacgttaactcagcatatgcatggtgttgttgtttctttttctttcatctgctgtttgtggagaataaacagcactttaaaggctctgtttctccactttgtttggcttccagtgtcctgtttttcagactgtttctccaccttcccttcttctttgaaagccatttatcttcctcagtctccatgcagagaaagaaagtccctttactttctgtcttccaagtctggtgaatcagttcccttcttttcataatcactgaagccaaccaagtttagaagtataacagttctccttagaatacgctcatctacctgcactctctgccctcctcatccttttctaggtccctccagacatcaccctcatcccataccctcccttccttaagtaccacagagtgggctcttcacctcctgctgccctctatgtgctcagccctggggctcactagtcctttgattatgaagtccaaatccctatgtgcttgcacactctcacgccaccctctaggaagctgccattgtgagagagtcctgaaaagcagggctgggtttagttccataatgccatattatgggtcaattagttatcctagtgaacatcctatttaattaatagatagagttaattaaatagagttattcctatttaattctattaaactattaataaattagttattcaatttattaataccaggccaatatttaaaataaataccattgcacgtttaagtgacatatttgacaataattgcatttacatacagttttaccaaaacatgtatcgaagtgtatttgtttttttaaatattggaataggcagacatacacataggaaaacattattttgtactacaatctcaaactgcaaacacaatttaaatgccattaaataattagaataatatgaaacaaatgggcatggtgttttggtgtttaaatatacattcatttcacctgatcatacttatgtgtctttgctgggctgctgtgcatgtatgtgtatttgtatgaccatgaagctttcagatacatcattaaattacataaagtgttaccatgcacttccctcttttaggggacaaagtaaatctttcagggcaatcgcagggaaaatgtgtggttggatcttccacacagagtccctaccatgacattgccaagtagagctatggaagggggctaccaacctccagaccccagaatggtagatccacaggcagcttgcagctcgagtctggaaaagccacaggcacccagctccaacccatgagagcagccttatgggctgcattagggaagtcacaaaggtagggctgcccaaggccttgggcacccacccttgcaccaggtcacaagacatggagtcaatgattattttagagccttaagattgaaggactgtccgactaggttttggccttccataaaaatctttacccaatttttgggccattttctctttttagcataggactcctcacccaatttctgacccatcattgtactttggatgtaaataacttatttttgatttttcagtctcataggtgaaaggaacttttccttgagtctgaactttggattttgaattaatgccaaaacaagttcagattgtcagggaccactggggagggattattgtatattgcaatgtaagaaagacataaggggcagaatgatgtggtctggatgtgtgttttctccaaatcttatgttgaactgtgaaccccagtgttggaggtgaagtctgctgggaggcatggcattaggggcatatccctcatgagttacttcgtgtcatccccttggtgatgaatgagttatcagttcacatgacagctgattgaaagagcctggtaccactcccttctcttatcttcccccctattgtcatgtgacactcttgctccccttcatcttctgccttgactgtaagctttctgaggcactcagcagaaacagatgtcagcaccacacttgctgtacagcctgcacaactgtgagccatataaaacctatgtcctttataaattatccagcctcaggtatttctttacaattcaataatggacaaacaaaaaaattatttaattgtgcagcaaattaggggtgtggaatcattaaaatggacttaacgcctgtaaaggtaaaaacacaaaagtctctctctctctctctctctctctctgtgcccttctctgtgtgtacatacacacacacacacacacacacacacacacacacacacacacacacgctccacgtgaagatgtcatgtgaccaaatagcaatatggtggctgctatgagccaacagtagaagcctcaaaataaaacctatcttgccagcatgtttatctttgaatttccagaattgaggaactgagataaaattaaggttgtgtaagttaccaagtatgattgtttttaatgtttgaactgactaaagagaatttgggatgaagaagtggggttctgatgttacaattatttcaacactgtggaaagtgccttggaattgggttatgtgtaaaaggctggatagttttgacatgcataaagaaatttatatattaagtgtcattctgatagattaaaatgagtagagtgctattggaaactggataaatggtgatctttgttataaagtgacaaaaaaaacttgtctagactatgttgtgatatttagtaaaagagaactttgagcagcaaaattgaatatttagctgagaacatttctaagtaaaatgttgaaagtgtagtttggtttctcctgggcatttataataagaaatagatgaattgaaaatgaaattataagggagaaaatatccaaaacttaaaggcttggaaaattctcaatctatctgtgttgcaaaaatcagaaagtgcgttctgaagagaacagtgagtatgaggctgtaatatcacttgataaagaatttatggtattaaaagagaataaatgcaggttttaaagaacaaggatggagatgagacaaaatggacgaatactgtcagattcttcagatttaagaggatggagctacttggttgcaaatgtgcaccattcttccagaacaaagaaaaataaaccttgaatttatttagaagtaatcatgaccactaccttggtttcaacagaccagaccatccatgcttaaaaccttgaggaaaagacctcctaccactgcctggaacttaggaactcccagtgagccttgtgtgtaggcctgcatggggtctttgggatgggaccttaacccagcagttacccattggtgcctctacttaaagcattggaattaattctgctgctccaatgagctgggaaagaagaagcttggcccagagaagattccacttgagccttaaggtctatggtaatttgttttgttatgtgttgtacttgctggggacacatcacccctcctttcttttctatttttctctttgggggagaaaatgtctattttatgcctaactcaccactgtattttgaaatcaaataacttgtccagagctatggactgaatgtgtatgcaactccaaaattaatattgtggaaccctaatccccagtgtggtgtaattggggtgtgggccatttaggaggtgatcaggtgaaaaggttgaagccgtcataaatgagattagtgctctaataaaaagtcacgggagagcttttctctcttgcttccctgtcatgagatgatacgataaaattacggccatctgcaattcaggaaggaaacctttacatacacatgattggctgtcttgggcttcccagcattcggcactgcacagaataaatatgtcttgttaaagtcatgcactttatgacactttgttaaagcagccccaataaaataagatatctggttttactggctcagagttggagagaaatttgtttcagaaataattctacctcaaatcttactcatgtatggtttagttaatatttaaattatgttttaaacttgtttagagttgatgatgaaatgagttaagagtttggggactgttataatcaaatgaatgaactgcgaatgtgtaaatgccatgcatttgggggatggtcttttctattctgggtctttcatgcctacgtgtgaattgaaggattgcttttcttatttctgtgaagaaggccattattattttgatagataatttatctaatctgtaaataactttgggtagtatgaaaatttcaatactattaattcttccaatccataaatgtggagtatctgggatatatgtcctatttatgtgtgtccatttcattttctattaccaataatttatagttatcctctagaaatctttctcttatttggtaacatttattcctaggtatattttgcagctattgtaaaaggaaaggcttcatggatttcattctcagatgttttgctgtcaacatatagaaatgccaccaattattgtatgtagatgatgaatcttacaactttacttaatttgcttatgaattctaatagtttgtgagaaggctttagttttctttttttaatataagatctttttgtctgctcacaggaaatctgacttccacaattccaaatttgaggtcatttccttttactgttaactaaatactctggctagcatttcagtactattctgaataaaagtgataaaaatggttattttggtcttcttccacttcttagatgaaaatttcccggtttttccatgcttcgtgtgatgaaagctgtgtttttctcatatatgcgctttatttttggagatatccttcttgtatacctaatttttgataatttctatcagaaatgaatgttgaattttattctatgattttctaaaatatcttgactacacaataacacagtaatatgcaggtcaatacatatcaactgaatttcacttaatatcatcccaacttctaatatttattttttagtattagaacatgcctgtttccatattatatttgctcacaggtattggtacatattttagctaatttgtcattattttactctaagaaataactcaaaaaatcatttttattatgaattgaaaggtaacatcggcaaaattagcccaatcttaatctttcccagactttgaaacattattgaagacaatgaaggggaaagtcagctttagttgagcttctaagaggtaagtgaggtaaaaacccagggcttattggctacgactttgaatgttactgtcttcttttccataagccacatccagaccattttctaaatctaagaaaactaattttatctcactgcttcttagtcttgtttcctgcagctgacaaccaaaactgtcagcgatagagcccagtgtaaatcaccagcctttaattattgcagaactatgattttacaacaacattgtgagttacataatgatcctactttatggccgcggtgcaaatgcttaacttccactaaatcacagagctcagaatggctagcatggaggtgtatatgtatatgtgcattgttctagaaatttccaattactgtatattattgtttgcagtaattaggtcaatctgaactgacaaaagtctccatggccttataagcacagagaccacctccacggcaggtggaaatcaaggctgggaacaggctaccagctgctcccctgggattcctccaattaccctgtttaaagcctctgctcactcatgcgctggaagagggatgtcagagatgcagcctactcttcctaaagggctgacagggcataaagacaagactgattatccatggaacattcctataggaatgcacctatgtgcaggcacactaataagctgtgtgtcttgcagtgtgtaaatggctgagatgccatttacacttctttacacaatacatttttaaatgtttgggtgatgtattctctatcattcaaaaaaatcatcactttccccctaaacaaagaggatttttatcagaacacttatgggaagccccttgctctcccagattcccaccctcatttctcctgaaggaagaaagaaaaccatctctattgatttccactctcatcctctaggactaaaaccagaaagctgcatgctccctgggtgagccttagagaagaccctgtctgtaggagcaggaatctcagagccttggctgagaggcatggtcctgaaatgagatggagtcccccatggagatcccacgtggacgcccacacctgagggctcactgctcctcaccacagatgcactcccctactgagtcctgagacctgagtgcaccccatagagtaggactcagatgagggaatgcaaatctccaccagctccaccctcctctgggttcaaaagctgagcacggggcctcgctcagtgactcctgtgccccaccatggacacactttgctacacactcctgctgctgaccaccccttcctgtgagtgctgtggtcagggacttcctcagaagtgaaacatcagttgtctcctttgtgggcttcatcttcttatgtcttctccacaggggtcttgtcccaggtcaccttgaaggagtctggtcctgtgctggtgaaacccacagagaccctcacgctgacctgcaccgtctctgggttctcactcagcaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggataccacagagacacagcccaggatgcctcctgtacaagaacctagctgcatctcagtggtgctccctccctacctctgcagaacaggaaagtgtgactgagatgccatttcctgccagggcttgtgtttcctataccaaccagactcagagccctgtctgttttcctattctgtactattaaatggcatgttccctgttagtgattcacgcaagcagaggctgtatcctgtttgacaaagattgagcatgaaagattcccattacctgggccacatgcatcactgatatgtggccacttatttcttgagctcatatccttccaaggggctgaatacaaatatctataacataggccatcttaaactgcaggaagtaatgttggagaagaatgtggagataaaagagcaggatgattaattaaaatccagataccatctttttttgcagagaaaaatttacactaataaagtaattttatgaaacaacaagaaagatggaatgtgtcctcatcatggagtgtctcacttgcagtgcacaaataaatttctaaaaattttatagggaagatgtgatagatgaggctgatttccacacagggagtgattaaatacccaggtaagtataaaatccaacacttggaaaggaaaatgcctcagcttgacatcagaaacccagctcagtaagtctgaggagcaatgcggaaaagaaatgaaaaattcgacaacacttttcttatgaaatccctagctcatgtttgaacacgaaaacagaattgtccacaattttaggacagccatcgcatgacaacaaaccactacaatgataggagcatcactgagtcaacggagttcaagcagtgagcagatcagtactgaggccccaggagaaccaaggctctttggtacattttacagaacccagaaccgagccacataatctatggccaagtgatctttgacaaagttaacaaaaattaaccaacgtatacaccagggaaaggacaccccattcaataaagggtgctggggatattggatagctatatgcacgcgaatgaaactggacccccaccctcaacatgtaaataattaacacaaaatagattaaaggtttaaatgtaagtcttcaaactgtaaatgtattcaaataaaacaccaggacaactcttctggacaaaaagcaaacaatagacaaatgggacttaatgaatctaacaagtttcttcacagcaacagagtgaacagacaaagtgcagaatgatagaaaatatttgcacactgtgcatctgacagagtactaatatacagaattaacaagaaactcaaaccacaacaacaaaagaaaacaagaaccaaataaccccattaaaatgagcaaagaacatgagtagacatttttgcaaataacacataaaaatggacaatagatatataaaaatgctcagcattactaataatcagggaaatgcaaattaaaactagtgagatataccattcacaatggctgttattaaaaagtccaaaataacagatgttggagaggatgaaatgtaaagggaactcttagacactgttgatgagaatgtggacgagtacgacctctatagagaacagtatggattcagtatgatattgactgtgcatttgtcataaacagctcttattattttgagatacattccatcaatacatagtttaatgagagtttttagtattaaggggtgttgaattttattgaaggcctttgctgcatctattgagataatcatgtgttttttttccattggttctgtttatgtgatggattatgtttattgatttgcatatgttgaaccagccttgcatcccaggtatgaagccaacttgatcatggtggatttgaaaaccggcacaagacaaggatgtcctgtctcatcactcccattcaacatagtattggaagttctggccaaggaaatcaggcaagagaaataaataaagggtattcaaatagaaaaagaggaagtcaaactgtctctgtttgcagatgacatgattatatatttagaaaaccccatcatctcagccccaaatctccttaagctgataagcaacttcagcaaagtctaaggatacaaaatcaatgtggaaaaatcacaaacattcctatataccaataatagaaaaacagagagccaaatcatgactgaactctcattcacaattgctacaaagagaataaaatacctaggaatacaacttacaaaggatgtgaaggacctcttcaagagaactgcaaaccactgcccaaggaaataagagagggctcaaacaaatggaaaaacattccatgttcatggataggaagaatcaatatcgtgaaaatggccatactgcccaaagtaatttatagattcaatgctatccacatcaagctaccattgactttcttcacagaattagaaaaaaactactttaaatttcatatggaaccaaaaaagagcccatatagcctagacaatcctaaggaaaaagaacaaagctggaggcatcacgctacctgacttcaaactatactacaaggctacagtaaccaaaacagcatggtactggtaccaaaacagagatacagaccaatggaacacaacagaggtcccagaaataatgccacacatctacacccatctgacctttgaaaaacctgacagaaacaagcaatgtggaaaatgatcccctatttaataaatggtgttgagaaaactagctagccatattcagaaaactgaaactggatcccttccttacaccttatacaaaaattaactcatgatggattaaagacttaaacatgagacctaaaaccataaaaacccaagaagaaaacctaggcaataccattcagtacataggcatgggcaaggccttaatgactaaaacaccgaaagcaatggcaacaaaagtcaaaattgacaaatgggatctaagtaaactaaagacttctgcacagcaaaagaactatcatcagagtgaatgggcagcctacagaatgggagaaattgtttgcaatctatccatctgaccaagggccaatatctagaatcttccagggacttaaacaagcttacaataaaaaaaaaacaaccccatcaaaaattggcggaaggttatgaacatacacttctcaaaagaagatatttattcagccaacaaacataaaataaagttcaacagcattggtcgttcgagaaatgcaaatcaaaaccacaaagagataccacctcacaccagttagaatggcgatgattaaaaagtcaggaaacaaaagctgctggagaggatgtaaagaaataggaacgtttttacactgtggtcggtagtgtaaattacttcaaccattgtggaagacagtgtggtgattcttcaaggatatagaactagaaatgccatttgtcccagcaatcccattatttggtatatacccaaaggattataaatcattctgctataaagacacatgcacacatatttttattgcagcactgttgacaataacaaagacttggaaccaacccaaatgcccatcaaagatagactggataaagaaaatgtggcacatatacaccatggaatactatgcagccataaaaaggatgagttcatgtgctttgcatggacatgggtgaagctggaaaccatcattctcagcaaactatcacaagaacataaaaccaaacaccgcatgttctcactcataagtgggagttgaacaatgagaacacaaggacacagggaggggaacaaacatcacacaacagagcctgtcggggagtggggggctggaggggatagcattaggagaaatacctattgtagatgatgggttggtgggtgcagcaaaccactatggcctatgtatacctatgtgacaaacctgcacattctgcacatgtatcccagaacttaaagtatagttaacaaaaaagagagagagagagaaaggaaacagtatggagactttccaaaaaatgagaaacagtactggcctttattctaccaatcccactactgggtagctacccaaagagaaagaaatcatatttcaaaaagatacccacacttctatgtgtaccacaaatctattcccaatagcacatatgacaacctgagtgtccaccaacagatgattttataaaagaatatagcatatatgcacaatttaatactagtcagccacaataaggaatgaaactgtgtcttttgcagcaagatgcctagaactggcggacattataattagtgaactaactcacaaacagaaagccacatatcacacattattacttataagtgggaggaaaacagtgtgtacacaagatatggagagagggattatggacattggagacttagcagaatgggagggtaggagttggcagcatgatgaaaaatcacctaatgggtacaatgtacgttacttgggtgttggttacactaaagccaataccactgtgtaatatttccatgtaacacagttgcacccatagcccttaattttatacaaataaagataaaaccaattacaatttaaaatataaaattattaatagttgaccaaagatcttgaaaattaaaatttaaatcatgatcaataaatgaaattattatcagttgaactccatttaacttaaaatcctgtggtcctcaagtgatttcaagaaaatgaatgtcaagttttagatgaggagatttgcaaatcatatcaccacctatgtaattatagtaagaaccctcaaaactcaacagtgaataaaagaagaggcaacccattgataaaataggcaaaggtttgtgcaggcatttcattaaagaagatgtacagattacacataggcatataaacaggatctcaacaggatttttcatcacagaaattcaaatcaagaccacaataagatacccaaacaccctttttagaatggctgaaattaagaagaaagatggatcataccgatgctggtgagcataccaggtttctagagtctaaaacattgctaatgggaatgcacaatgaaacagctacacaggaaaataattcttagtttcttgtaaaattatatatgcccttaacacattacctaaaaatccccctcctgtaatacagtaatacatggctgtgtattactgtgaaagaggcatagtgtgaaaacccacatcttgaaaccctgagggagaaggcagctatactgtggctgaggagattacagggattatttgattaaagacttttttagaaagtgaggttaaatcagccgggcgtggtggttcacacctgcaatcccatcactttgggaggccgaggtgggtggatcacgaagtcaggaatttgagaccagtctgcccaacatggttaaactccatctctactaaaagtccaaaaaattagccgggtgtggcggtgtacacctgtaatcccagctactctgggcgctgagacaggagaatctcatgaatcggggaggctgaggttgcagtgagccgaaatcgacccactgcaccccagcttgggtgacagtgcaagactccgtctcaaaaaaacaacaacaacaacaaaaagaaagcgaggttaagtcattgaaaaataggaaaatataaatgtgtatgcactctaattatttgggaaattttccatacaacttgtattctgtaaacaaaattcagggagtggaaaacaaatcaaattaataaaactgatataagaattcctctgaagatattagtgtgagcactaacacacacttttgaatgggtgttgtaaatattttggaacacacctcttaggtcacattttaattctacatttatgtaaattatataaaatatcgaaattttttaatgtctccattttgtgcagttataattttggtttcatgccagcaatgcatgatagattccgttcttccacatcctcgttgccatttggcactataagcattgtgtattttaaccattctaatctattggtggtgatagctcattgttgtttaaatgcacatgtctctaaaattttatatttaattattttatataattgtgatgaagtgtttgttatggtatttggctcatttttgatagcattgtttatttttgatcagttgtaagtttctttacatacccattatataagtcacttaaaaaagtacttagctggtcatgaaccccaggatgagatgcagactgtatagaaatctctagcaatgttactcagtgtgggcagggatggcatgagatgcggggaataaagaataaagtaactttctccatttggatataagatgtgtccattcactagagagttttctttcagaaggttcccatgtgagccagtttccttcctgacaaggaaatcacccagaggattctcataatctcttaagtgagaaaagttttcctcaaactccagctcagtctagctcacactgtctctaaatgggcaattactttcagacatgtacacacatctgtcccaacgtggactcctccctcagacaagcacacacattgcaatgtggactctcccctcagaaaaccacacatgccccacaatgactccttcttcacataagcatatatgcctgatgctgaactgctgtgtagcaaaattagctcagaatacaagcacttatggactctagccataacaatgtgtagatctgcattttattttaaattctaaatgaacattttgccttcttgttaagaacagtggtttacagctctacatgtagagactacaggcagatatatgtttcctctgggaaaagtttattttcatgtatttactgggttattttgttgataaacattcatctataaagacacctgaaaagtgccctcattagagaaaaagaaagtgtagtttgcagattaactctgagcatccaatcccaggaatcctttgatctgccctccctgaaatccacaggcagaggggggatgatcgctgataagtagcaaacacatgtccacaggaagggagacatggaaatgtggtcactcccacactcaagaggagcagctcatcccctgtccgtagtggtcctggtgaggagccaccccacacctgtgccttcctcagtatccacaccatggggtctgtgctgatctgggcttcccttctcatcactctcaatattagtgtccttgcggatcaggctcagctgtggctgctccagatgaggctgttactcagtctgttccctctgtgtttgcagaagtcctgtgtgaagttcaccgggggagacagaggaaataacggtgcagccgggggctatctgagtctctcctccaaagactctggattcaccttcactgattgcagcataagcttggtccagcaagctccaggaccagggttgatgtgggcagcaacagggagaaattgaagaggaagctctcagtggtgccctccatgaatacaaagaatcttcacagtccccaggacacccttacgtgcatggtctcactgatatctttacttcttttatcacttttgttatgtaaatcacaatgaatagtgtattcctcatctattatacatttgttaagtcttttttggtgtctttaaaaaaactgataactttatagtatgtaatatccttaagtcctgaaagtgttttttgatgtctaccttgtcttaaatttatacagctactatagcttttcttggttcatgttttctcatatttatcttttctatttgtgaatatgtagagaaactttcttgtacatagctaatagttgtgtattgcttttttattttggcaggccttaaatattctaattttttatgatactttaagttttagggtacatgtgcacaacatgcaggtttaaacaaacaacctcatcaaaaagtgggcaaaggatatgaacagacacttctcaaaagaagacatttatgcagccaaaaaacacatgaagaaatgctcatcatcattggccatcagagaaatgcaaatcaaaaccacaatgagatatcatctcacaacagttagaatgacgatcattaaaaagtcaggaaacaacaggtgctggagaggatgtggagaaataagaacacttttacactgttggtgggactgtaaactagttcaaccattgcggaagtcagtgtggcgattcctcaggtatctagaactagaaataccatttgacccagccatcccattactgggtatatacccaaaggattataaatcatgctgctataaagacacatgcacacgtatgtttatagcagcactattcacaatagcaaagacttggaaccaacctaaatgtccagcaacgatagactggattaagaaaatttggcacatatacaccatggaatactatgcagctataaaaaatgatgagttcctgtcctttgtagggacatggatgaaactatctattgcttttttaaatcaactataataaattctattttttttttttgagaaggagtctcgctctgtcgcccaggctggagtgcagtggtgcgatcagggctcactgcaagctctgcctcctgggtttatgccattctgctgcctcagcctcccgagtagctgggactgcaggcacccaccaccacgcctggctagttttttgtatttttagtagagatggggtttcaccgcgcttagtgaggatgctctcaatctcctgaccttgtgatccacctgcctcagcctcccaaagtgctgggattacaggcatgagcaataaattctatttttaaaccaacaatatttttttccgttaatttttgtttaaattaacatttagtaatgatgcttatttctctattaacatggtatttaattaccttcctataaatattgtatagttaccataagatttacaataaaaattgtgtgtaattagattctaatgtaaatcctgtgatggccttgatatgaagaacacagatagtgtaactgtgtgctttgaattcctccttctcgccactctttcttgtttattctgtttgcacttacatatgctgtaaaatagaatatgtaatttattattactttatacagtcatatcttatagcaattacaaatgttaaagagtacaattcatctagattttcccatttttacaatctttatttcttcgtagagatttctatttgagtgcatatcacatggctactcgcagagaatctttgtaaaatgtgccctgaaacatgaatgtgctgacaacacatattctccagatctttttttctgacagaattttatttgccattcacctttaatgaaattttaatgcatgtagaatttcagtttgcatttcacctgtaatttattttcttgtaattattattagtttttcctggagatgatcacacattacattctgctgggcctttattaaccatgtttctgcgaacctagtcaggcttgggtttcaagtgtatggttgccgtggctatcagagttgaaatcagcttctcctgttcacaaaaacttcaggttcctctggtgatacctgcgtttgtgtccctgtttggctttggatcttcacatttcattctccccaaagaaaggctgtctctttcagctgtggcaggtgcatcctgctgacacatttacttggtgactttttgtgggatgaaggggcttggacacaggggcacgttttccaaccttctggctgagcctccttcttagctatgggtggtgagactggctctgatgcatgatcttccaagtgttcctgttccttcccttcctcagtgtcacagtgtctcttcccagtcatgctgttttttcatcagtgtcctcagcttctgacccactgtccttaccccacagattctggatttcattcctcaggaaacagacgggaggtgattctgggtagagtttccctgatgtcctctgtttccttgtgttctagttgattctaccagtgcccacaggacacaagatttaataaatgtctcctgcatataatgaagggggattcagcattgaacggagctactgttcttcctccccagtcaacaccacaggacagcaggtgggtgagttgtctggggatttccccaattctgtaggaaaagcctgcaagtgccaggagtttcacactctcacaccattagcacacacgtcttcaagcaactcattaaacatttccaggttagctttttcctatcttcaataccatgccatgagtggcacctgccccaggtactctaataaacgcaccctagttctctctgcgggcccctattttctcatatttcagggatttttttctctgtgacatcaactcagatatggtgaggggtttattttttgtaattcttcatgttttttgttaacgaggtcagaataatatcattttctcaatttttacattctaacgcttagtatctgatttctaaataaaattcagaaactaagacaacaaatgaagtatccattatttggtgcattgttaaacaatttgagaaatattcatgtactgaaatagaatgaaccactgaaatcaaggcatgcctcattcacataagaacatgagggcattatcaaataattttgctgagtggaggaagctaaagaattcaccatcaatttcatgtgatttcatttgtataaatcacagaagatgcaatattctaaattaacatagagaagatctgaatttctctgaaaatagggtgggcagagtaacaacgtggtgaaataaaattatagacaagttagataaaaaaattagaggttaacttaattgctaaaacatgattgaagtgctgattcaatgactgcacacatatatcaacattttccaaatgcttcactatcaatttgatttcattattgattgtttttttaataaagcagtaataaaaatgaatatattggctgagaaagagcaagaaatggataaataccgacacttgaataatcaaggactcctgaaaatacacacatgtgaacactgattgtagatttcaggtaaacactagaaaaggcaaaattacacaaagttgttatgacaggagggacatcctgaaaacctctctaggcatgtcccacaccaccctggagctgtctcaggggagcagtctcctccagtgtttagaggcacaggcacgcataatagggctaactctggccagatgtgtgatattggacacattgcacaactgctctgttctgtatgtaatttatcttctctacaaatgtaacattgacagttgcattaaatatattctgcaaatatgtaaaagttaaataagctgatgtctgctaaatgattaccaaggcacaatcacataatctgaagttatattttccagagtgataggattacctccagagttttccaggacactctcatctgctccgggcactgccttctcctcagccgtcccacccctgagcttgctatatagtaggagacatggaaatagggcccactctctgctgataaaaaccagcccaaccccgaccctgcagctctgggagaggagcccagcccccgaattcccaggtgttttcatctggtgatcagcaccgaacacagaggactcaccatggagtttgtgctgagctgggttttccttgttgctattttaaaacgtgatctatagagaactagagatattgagtatgaatggatatgagtgagaaacagtggatacgtgtggcagtttctgaccggggtgtctctgtgtttgcaggtatccagtgtgagatgcagctggtggagtctgggggaggcttggcaaagcctgcgtggtccccgagactctcctgtgcagcctctcaattcaccttcagtagctactacatgaactgtgtccgccaggctccagggaatgggctggagttggtttgacaagttaatcctaatgggggtagcacatacctcatagactccggtaaggaccgattcaatacctccagagataacgccaagaacacacttcatctgcaaatgaacagcctgaaaaccgaggacacggccctctattagtgtaccagagacacagtgaggggaggtcagtgtgagcccagacacaaacctccctgcagggccatgcgggtggtttcctttctcagctgcaggaggcgggcttattgttgcaggactctggagacttattaggttgtgatattttactatggttatttatcatgaacttttttattgggaattgtgttttattaatttttattttatatgtaaggttatttttttaaaatacataccttcaagaaataattcttcctaataatttgcacttgttctttttagagttttgttaacatctgttgatatcagctactacatagctatagggacattaatttacatctatagacatatgtgtaaatacacaaacttatacatatatgtggtcttttatatttaatgttataataaaattattataacaattataaaatacatcctaaagaatgaaacatatatagtaatccatattcctttcaatcattgcctatagtttacataaattgatgtctatttgtaaccttaaacatagtgtattggtcattttcaaacatccaagaacaaatttcaaatgtccttgtcacacacacaaaaataaaaatttgaggatttgaggtgatatatatgtcaatcagctcgattcaattattccatattgcattcataaatcataacatagctttattcactataaatacatacaaccaaaatttctcaattttcaatgaaattttaattatacatattttatctgtcctaggtcatgaatgtttttctccctgtccggatgtgattagattgtcctgagaaacaaattcagcttcctgcctcctgaaggcttcaggaagcagctcctagatggggtgaagcaggcaacccgtgtgtgtccacaggacccggagcctctctctccttggattaggccccctcctcaggattacagggctcttcagttttctcaacatgctgttataccagagaagcacaaaacacttaatttcattatatttttcttcaatttttcaaaacaacacaaaggtaataattttaacaataaacatattacaacctactatacatgagacccttcctgtgcttcgaggtttcttctcaggactttgtatgtattacatgttttcagtttttttctgagatggaatgttgacgtctccttattacagattattcttttaatttgtctcttagaataattttttccagagctcctgcccgcccgcgcctggcggaatggagcggcgccagggctgagccaggcgcgcaggggccgccgcacgtgccgcgcggggagcggatgcccagcgggcggagagccagcgccagaggccgggtcggagcggccgctggagcagcgtcagaatgggagaacagcccatcttcaccccccgagcgcgggtcttccagattgaccccaacaccaagaagaactggatgcctgcgagcaacaggcggtcaccatttcctgtttctatgatgtcacaaggaacagctatgggatcatcagtgtggacagcgccaaggtgaccataaacaacacaattacacagaatatgaccttcaccaacacgtcacagacgtctgggcagtgggccgacagcagagccaacacggtgtttggtttggggttttcctctgagcagcagctgacaaagtttgcagagaaattccaggaggtggaagaagcggccaagacagccaaagacaagacccaggagaacatggagccctcgagtaatcatcctgagaatcagggcgtggagccccatcttctactccggcatccagtgtcaacgggacggacgatgaaaggcctctcaggccgctgcagccgacacgcacctgcagtctgggaaccacaagctgaaggcggcctcgacgcagagctgcccacgggaagaggtgggagatggagctgcagacccggcgggagaccgacttccggctgcccacggcgctgcaggagtcgacggccagtgcggagcagaggaagaggccgtgagtcagagtgcgactgtgtctctgagaagatggaggcggcagagagaggatcaaaacctggaagataaagtgcgttccctaaagataggccctgaggagagcaaatcccgacagcgccacctggaggcgcttcctggtggcgctggaccggaagatccaggcctgcataacttccgcccaggcctcccaggctgggcaccaacaactagggctggcagaggcccgggatccccaacgtgagtcctaagtatgtgtgcgagaccagatggcgctaggacgttccctgtgtgcgttgcttctgtaaatgcaggcgccgtgtgtcgtgtttccaaaccagttgtgccatccactcactcctttccagaatagaaatctctcgcttctctggccttgtgaggttgtggacaactggaagattctgactgaggaaaccagaaccaggtctaccttcaacatttacgcagtcaggccagggatgtttatatcgttcataagggttgttggaaccatatgaactgaaaaaaagcattttctcatccaaatattgatattctttacaccaggccatcgggctccttttatccgatagcattcagagtatttgaaggtcctccaggtgccagccttgggggcacagggagaacaacattcctctccgaaaacatggggaagctttaaaataactgtttagtggagacttgcccagagatggaaaacaggtttctggtgagtacattttctggtttgggaatcacctgcatccccgatcctgccccgtgccccccagtttgtatggttgtgacaatgttccatttctttgttttaatttctgagcagttgactgtggtgcgggaacagcacacagtgagggtgcctagcacaatgcctggcgcaaagtaggtgctttataaatatttgttcaattaaaaaaaaagagggaggctgaggcaggagaatcacttggaagctgggaggcggaggttgtggtgagccgagatggcgccacttcactccagcctggcaacagagcaagactccatttcaaaagaataaaataaaataaataaaataaataaataaaataaaaaatattttttccaagccccactcaaaaccatggtattgttagaggtgtaatagttggaccaacattgaaaatacattccatttagttcatgggcgtgcaaatatccttttttctttaaaaattgttctcagttgtaatattacaaaaaatattggtaatttataccaatgacacaggttaaaatgttgtataaataatttaatgacgtttgattggaaaaaatacatgtgccacatgtcgacaattttttccttctctatgaaatatatactcattaataagtttcagatgttacagttatctttttgatttctgggatttaattttagtaggtatacttgaatgcattttattaattcctataatgatgttgatatttcatgtaggattttaatactaattttactatttactgaattttaaactattctacatgttttatttatataagaaaaaaattacatatgagaaaaaatgcgtagacctgaaatgtatcactagagagtttctgtcaaatgtgaatacctttgttcccaacacctaaggtagcctgaagagcaagtccttccccacaacatgcgtctttttctgtgcttgcggtcagctcctgcatggggaaatgttttgatttctgacactatagatccattttttttctgttttgaactttatataaatgcaatcaaacattttagaccttaatttggtaatgggctacattgctattttttgaggttatttcctgctatttaaggtattaaattagatcaacatattatcatttattcaagtaatggactgactctgatatgaaacctcaaagttttcacatatatatggagagagagagagagagagagagatgagggagagaggttttatatctgagtcagtctgttaaataagtaaatgacagtattttgatttattttcctgtaaatcgactttaaatttgtttccagtttatgaatattataaacaaagctgttacaaatgtcttagtgtaagttttcctatgttgtcttccttttattgagaaaatatgaagtatgtatttattataagcttaaattttttcagttttattgaggtataattgaaatattttaataatgtatagctttaaggtgccccacttgacgttttgatgttgtattagtccattctcacggtgctataaaaaatgcctgagactgagggatttgagaaaaaaagtgtgtttaattggctcacggttctgcaggctgtacaggaagtgtagtggcttctccttctggggagagtcaggaaagttaggatcatggcagaagacaaaggggagcaggtgcgtcacatggccagaccaggagccacaggaagcagggaaggtctacacactgttaggcaactagatcttatgagaactcacacactgtcatgagaacagcaccaggagtttgttctaaaccattcatgaaagacccaccccatgtcccagtcatctcccaccaggtcccaccttcacaattgaggattataatacaacatgagatttggggcaggacacagatccaaaccacatcagatacacattgtgaaatgctcatcatggccaaggtaatttgtatatccattttctcatggagctaccattttatttttttaaaatgtactacatgtgtgtgtatgtgtgtgtgtctcatgagaacacctacgatctacccgttcagcaaaaatcacatttacaatacagcattaaatacaagaacattgcagtacattagatctgcagaactcattcaccctgcacaactggacctctacccttcgaccgacatcatctgatttccctctcctcacaggcctgggacccactattctactctctgctttcaagagcttgaatattttagatcccacatgtaaatgagatcattaagtctttctgcatctggcttattccactaagcatcatgtcctctagccccatccctgttgttgcaaatgtcagaatttccttcttttcaaagcctaataaaattcagttttctgtgtacacattttctttacacattcatcaatctgtggtcattaaattattttacaaatctacactattataaataatcttgcagtgaacatgtgtttgacataataattttatttcttttgaatatatgacaagaagtgggatcaccagagcatatgatagctttatttttcaatataatgaataaccaaacctaccacaccatgcttttgaagtcttagtcatattttatttgcctaggccaatgtcccgaaaaatttctcctacattttcttcagtttgtacatttaaatattgaatccatattcaattaatttttgtctatggtgaaaaactagaagtctagttttattcttctatgtgtggctgtctaagtttttcagcaccacttactgaatagagggttgtttctccattgcatatttttgtcagttttgtcaaagaacaggtggttgtagaaacttgtctttatttcttggctgtctattcttttacattattattattgttattgtttttagtagcagtaccatgctgtctttcttactgtatctgtgtagtataatttgaaatcagggaatgtggtgctttcagctttggtctttttccttgggatttcttttgctattcaggctgttttttgattccatatatatttaaggattttttttaaaacatgtaatcaattatattggttacttgataaaaattgcattgaatatgtatcttgctttggacagtgtattagtctactgtgcattgctataaattaatgcctgaggccaagtgatttacaaagaaaagaggcttatttggcttacagttttggaggctgtgtgagaagcatggcaccagcatctgcttcttgtgagggcctcaggaagcttacggtcatggtggaagacaaaggggaagcagacggtgtcctgtggtgagagggggcacagaagaggggaggagggtcgctagactgtttttaacaatcagatttcaaattagctaataaagaaataattcactaattaccatgggggtgataccaagccatacctgaaggatcttttccccacaatccaaaaactcctactaggacccacctcaaatattttggatcacatttcaccatgagatttggaagggacaatcacctaaactgtagcatttcactcttgtgtcccctggtctcaaatccttgtaagattgcaaaatcatctttttttaaaatagttcccaaaagtgttaacttgatcaacctccaactgaaaattacaaagtctcgccagggtcttaaggcaatttccctccagctgcgtgctggcaaaatgttttaaagagttatgtacttccaaggtgcaatattgccattgggtaaatattgtcaatacaaaaggaataaattggccaaaggccccacacacacctaaagcctagcaggacagatattaaatcttaaagctacaaaataatctatcttgactttatgttcttagtcagggtacaccaggacaaagtgggtcccaaaatcctcaggcatctcatccttatggctgggcacattccatggggctaataacacaggccagagtcaagtgccagaagtagttccaggttgggagtacaagctgcctttggatctaccattctgggatcttgagggttgtggctgcatttctgtagctccactatgaagtgccctagtggggactctgaatggggttccaaccccatctttccccatctttggtactgccttcgtagaggttgtttgtggtggatccagtcctgtagcaagcttcctcctgggcacatagggttctctacacatcttctgaaatctaggtagaaactgcccagcctccttcactcttgcattctgcatatctgccagaatccagttatcccagcaccatttactgaacacagaggtttttttccacattgtttgtttttgtcagccttatgaagtatcagacggtttaagtgtgcagctttatttctgtttcctattttgttccatttcttctgcatatctgctcttgtaccagtaccaagctgtttttgttaccatgtcattatggtgtagcttaaagttgggtatcatgatgcctctggcgttgttctttttgcttagcattgctttggctattcagggtcttttttggttccatacaaattttagaatagattattttttctaattctgtgatcaatgatgttgatagttttatgtaaatagtactgaatctgtaaattgctttagacagtatgataatttttacaatattccttcttctaatccataagcatgaaatgttttcccatttatttgtgtcatgtatgatttatttatttatttatgctgtgttttgtagttctccttgtagagatctttcaccttgtttgttacctgtatttccaggcatttcatttgtgtgtgtgtgaatattgtaagtgggataagactgtgttcttgatttcactctcagcttggacatagttgggtatagaaatgttagtgattcttgtacattaagtttgtatcctgagactctaccaaagttgtttatctattttagaattattttggcagagtctttagaattttctatgtgtagaattatatcatcagtttggacagatatatctacttcttttcccatttagatgttgtattagtctatttgcacactataaagaaacacctgagactgcataatttataaagatttttaattgtctcatggttctgcaggctgtacaggaagcatggctggggaggcctcaggaacccaacagtcatgacagaaagggaagcatcatgtcttacatggctggagcacgaaaagagaggaggtaggtgccaagtacttggaaaccacatctcctgagggctctgtcatgggaacagcacaaaagagggtgaagcatccccatgatctaatcatccctcaccagtccccacctccaacactgggaataacaatttgacatgaaatttgggtggggatgcaaatacaaaccatatcagctccgttttattttttctattgcctggttgctctgactacgatttccagtagtatgctcaataggagtggtgagagagggcatccttgtcttatttcagttctcaaggggtttgagcttttgctcactcagtataatgttgagtgtggttttgtcatagatggctgttattatattgagtttttttttttttttttgagacggagtctcgctctgtcgcctaggctggagtccaatggcacgatctcggctcactgcgacctctgcctttcggggtcaagcgattctcctgcctcagcctcccatgtagctaggattatggttacgggcatgcgccatcacgcccagctaattttttgtatttttagtagagacagggtttcactgcgttagccaggatggtctccatctcctgacctcgtgatccgcccgcctcagcctcccaaagtgctgggattagaggcgtgagcccccgcaccaggctattttgaggtattttttgatgcctagtcttttgagagtttttatgagtgaatgttggatctcatcaaaagctttctcagcatgtattgagaaaatcatatgttttttgcttttattttgcttacatggtgaatcacagttactgaattgtggatgttgaatgaaacttgccttccaggggtaaagcctacttgatcatgacgtatcacattttaaagtgcttctggattctatttgttagtattttgttgagaaattttaggtctatgttcaccaagaatattcatctgatgttttcttttttaattatgtatcttcctgattttgtatcccaaggacacacaatgaaggaaggacagtctcccaacaaatgatgtaaaaactggacatccatatgcaaaataaataaaattagaccttctctaacaccatatacaaaaatcaacaaaaataaacataacatgaaaccataaactcatagacaacatggaaaaataattcatgtcattgattcagaaatgatttatttgaagttaatcccaaaagcaagcccagcaaaaaactacatgcaattatatatctgacaagaagttctatcaaaatgtataaataatccatacaactcaatagcaaatatcaaatgacctcataaaaagagcaaaaacctgaatagattttttcagaagacacatgcatgaaaaacagagcataaaaatgtcctcaagatgactaattgtcagaggaattcgaatcaaaagcacaatgacatatcacctcacaccacttaaaatggctattatcagcaagacaaaagataagaaatgttggcaagaatgatccacagccataaagagagctttgattggccaagagactgatttcagtaactttctcctgtgaagagaccactgaccatggacttgtcctggccaatttccagaggctgtgcactgtgtgtctttctgcccctgcacaaagcccttttgatatgcaggacccaactgtaattcatttagttcttaagtcctcaccccaaagcaaagctgaaatgcatgtatcatgtgtgtttgcttattagacatgagagcctccactccatgtgaatatccatagctccttctatagcctgctgagtgtgtacactcgaccaatccatttgcacaaatttgtttctcatctttccctctcttaaagtgcctgctcacagtctctgtgggaggctttccttcccagcctgttaagatggccatcctgcagcttcaaccctttctgagaaataaagtctcctttctaaatttataaactgggtgattcttccgttgaaagcacaagctgttgggaagagttatatggcaattccataaatgcctggaagacaagtgtggatagggtagggtaagaagtcctgggggctgcacaccccactctgatggaatttccctccagaaacttctgggttctcaagatgagaatccaaacagattccctcatggctctgtcatcaggagaactatactctgataagtatgcccagaacttcctccagacagaccctatagggaaaaaatacttttcaagatctttattctgtgaggggaagggattcttttccatcccagacagcttcatcttagccttcctgagtcatgaaaaggagtataattaataaaacatctggggtcagattcaagaaaataatctgtggatgctgcagccaggagggggagtggaggacggaggaaaatcagctgtaccactgaatactccttgtaaatggtacagcctagagaaagaatagcaagaaatcattggaattcaatttccagaacatatactgctcccctacccaccacatcacctcaccaccaatatgattatctggattaaagagaaaagtgtggaaaggcacagactccatctaaggactagaatttagggaaaccaaaggcagtgggagagaaaaagtcaaggacagtaaagtgacttaaaacctcttagaccaacagcttcaggaacaaggtcacatcctctccctcactgaaattagatttacctctcatggggcatctgcagggtgcgcaggtgagaactggcaaagagaacatgaaggcactttccaaatctccattagtacctagctcgctttagctgtttggaaaaagcaaaaccacaacaaacataaccaggactaggatcagtgttggaagcacttttcactggcaagacactaagaaggagggcaaattcgaggccagttactatgcaaatatgccactgtgagtgtgtgtggtggtgagctttgagacatagggtctgtgggtaaagttataatcgataaaatcttcaaccacagaatcctaaaaaaaagagccttccccaaagtcccatcagttcctggactcgccatgtgtctggaccgtatcagtggatccggagctccagggaaggggctccctgatggcttttatgattccttgcttgccgtgctgaggtctccctgtagattatgttgggttttctaaggcctattttctattgtaagaggtggtgggggaaacaatttctgtcactgaaagagcattctgagccagggcacagccccttcctactgagcttgagattctgggaggaaaaagttctctgacaggaggaaaaagttcccagacaggaacttccctgcagggcaggagctgagcggcagggggcgctcagggagcacccagcacaggacccagccctggggcaggtgcacaggaggctggggcagggttttctctcaggaattgaatgttccttatttcaaagcaataatgacctaacatttaaataagaatttagcaagtactgatgtgcctgtaagtattttattgtatacgcagcctatacctaacccaataatttaatgcaaaccggatttaaaaggagaaatgtctaggtctttcaaatgtatttctagttaggaattgaggggtggttttattaattcaatgggtgttactgtccggagacacactcatcccagaagttagatgtgcagagggcaaggctcaggaaaagttcaggtagacagtgagccatatgaacagggaatcacattgaggaccatgtcctgtgagattctgggtttctgtgagaggagttctgtcttcatggacttctgggcatgtcagaggacaaatattaaacaaagttcagggcagggagctcagcatcccactgtggcgtggtccacatgtcacctatcttcttcctcagggtggcgtggcctgagctatgaaaaacctgcctcatgaatatgcaaatgcactgctgtctaccgaggtaaatacagatctttccttgcccagagaccatcacacaacagccacatccctcccctacagaagcccccagagcgcagcacctcaccatggactgcacctggaggatcctcttcttggtggcagcagctacaggcaagagaatcctgagttccagggctgatgaggggactgggtccagttaagtggtgtctcatccactcctctgtcctctccacaggcacccacgcccaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagacacagtgtgaaaacccacatcctgagagcgtcagaaaccctgaggaatgaggcagctgtgctgaggctgaggagatgacaggatttatgaagtttaaatctgtttagaaaatgggttgagtaattgagtaaaacagcaatggaaagatgtgtacactgtcattatgtaggaaatagtattttcaactgtcaccctataagtaacactcacagagtgggaaaggcagccatcaatcaagctgatgcaaacattcccatgggggctttgtggggacatacattttataattggatcctataaatcattagaaacaggattgcttgatctcatggtaagactaaatataatttccaagaagtggccgaaatttcttccaaaatgtctttgcccttccttttacattgaatttattttaaaggagttttaggatcacaacaagtttgagtagaagaaacagagttcccatgcactcctgccccccgacgctcagccttctctgctatcaacaccctgcaccagtgtcataaatcggttacagaggatgaatctccacagacacattggttgtttccttttctggtggtccctggtataacaagcctcaactatcttgaagcaccccaggttcaagtggattcttcaagtgggttactgggaatgatgccaggtagaaggaaagtgggtgggaccattcctctttgcactctttcctcaaggatccataaaatgtacatttacatggagctcctctttctcctggttttatatgcctcttccccaatggtaaggtttcccagtgtttacagcgggggtccccagtccccgtgctgtggatccgttaaggtgtgcagtgcgttaggaactgggccacacagctggagatgagtgggggcgagccagcatcgctgcctgagctctgtctcctgtcggatcagctgtgcattagattctcctacgagccgaattcactttttttatatatatactttaattctagggtacatgtgcataacgtacaggtttgttacataggtatacatgtgctatgttggtttgctgcattcatcgaattctattgtgacctgcacatacaaggggcctagactgagcgctccctatgagaatctaatgcctgacgattgcagggggaacaagttcatcccaaaaccacccaccgccatcatccatggaaaaattctcttctaccaaactgttccctggtgccaaaatggttggggacactggtgtagaggcaggtctgtaccttggaaagccagcagcttctggtgaatcccataattaatgtcctttaatgagaagtggagactttggtcatgagggccttcgtgaataatgccctacagttggattcaaaacattgtaagctcttggggggtgtttctggataaagccctttgtgcagaaaatgcagacacatccatgggatccatgcaggaaaaaagcttcctttacaaagtggtttggcacctggaaggagctctcagggttgggcactgtaccctttgctggctgcactttagccagaggcttaagcctgattggtcttgcagtgggagagccttcctggggtcaaaggttacaaaaatgcctgtcatcttccagctgagcaagcccatctgcgtgcttgtcagtgtcaaccccatgaagggtgcactctggaagatgacaagatgcacacaaacctcctcccactgattatccactaccacacactcagctgcaacccgtgctccagaaacggacaggggcctgcaaggataaacagaatggaagtattttattacctgggaaagcactgccaaatgccacgtttcaggaaggttaactcataagtgttcaggaagtgactgaagggcagtggtgggtgaggtgacgggactgcctcagggctgcacatgaggagggctccctcccacacagccttttcctccaggagctgcaccaggaactcacagaggatcaggaaggattctgagaacattcttctgtggcgctgactagaggggcaaaataaattataaaaaataaatcaattctaaatataatatgatgtttgttattagaaactatttctggatcctgtgggaaccctgacataagccaccattctctgtgaacaaacatttaacctctccttccatggggaggtcgacgagcttggattggttctttcatggatagtatcccccaaactcctctccactccctgcgtatccccgggtctctcagtgacaagttctcctcagtggaatttggttgatgtagtgagatcttcaaatttcctgtcgtctgtgttctcatgttctccccttatctgagattaagaaacgcacctgcatgtagtaaattatagcctactgtctctcatggacaaaataatggccacgccaaccaaccttgtggctgacagcaaccactggcggccaccatcccctccacagcctgtgttggaacatcacctgagagattgtgttagcaactttccttcagaatcatcttaaaaactttgtgtcccatttcacatggagacgtcatttttccatttcatcttcatagagaaatagaaggagaagaataccaaatacacttcctatctccagattattcaaatataattgtccctttatcaccttctgatttctggtcttcacagaatactctacaaatttttctcactggcgttataccaaaagttgtgaagcaccagatactgggattaatttaaccaacattattattctaataattcttagaatttagaattacaattatcatcttttcgtatacggataaactaacctatgcctttgaaaataagcccttacatgagagtgaaaagctatagatttggaggatttccttgcaaatccaatatttggaaaacggattttatcacaaatatacaaattaacttacaattgaacaacaaaaccacagaatttaattttaaaatgggcagagacctgaatagaaaccatatccaaaaaacaaacataaaaagtgatcaacttgattttcattaggtgtacttatgtttaatatttaaaaagttctactaaactatgagaatgggtaaaaattacaaggtagacaatatcagatggtgatgaggaagttgaaaaacaggaactttcaccccttgctggtgggaatgccgaaatggcacatagaaaactacagttaataatttattgtatatttcagaatagctacaagataagatttggaatgttcataacactaagaaataatcagtgatatagatgaaggatatcctagttatccagatttgatcactgcacataaaatgcttttatcaaaatatcagttgtaccacctaaatattttgaaatattgtgtatctatataaatcaaacattaaaaaacaccaatgcagtggaatccagctaattgcagattcccattagatgggatgtgctgcatgatctgtaaactaatcagaatctgtgggtttgtaaaggactttagaaatcaactaggctgcttgtttctaaagataagtctccctagtttaaatattttcttaatgggtggcgattttgaacatagaagaaatagtaatatttgtgtcttgtaagttttcttcttctcgtgtcacgagaaaaggtttgcagggaggaatctgggaccatctttcaagtctcaacttcactgtgattacctcagtaagtattttctgatacccctgactaagataagtctcgtatctgtcctagaaactaaaagtagaattctaagcatctacctgaccagatggaccttcctcttcaccaaggagttccagagacacttttaaacctagctccggccgtgttagaaatagaggatcagaaatgcctcattataccctcctccctttggaattcaagcacaactaaccagcatttttatgaaaacagagcttaaggctcagaaaacagattatttgtagcagtaagataccaaattctaaccttattcgagaatatcatcacaggacagagagcaggcattgaaaggaatcaaaggcttttaccctaaaatatattcctttgacatattttaaaatagccaggcacagttatcttttgtgagagagatttacattctgtagagaatctccttccctttccaggtctttttcttataccgaggagattagctgagggtctagcttcttttaaaggtcttaggagaaaacatttcccagctattgcctctaaaggtggtcacataagagacttcatctacatagtaagaatcttgttctccaaaacctgttatcttaacctagaaacatttttctaccggtttcaggtctttagaaaaaagcttaaatctttcaatcaattgtcaatcagaaaatattcgaactcactgtaagttgtaatccccgccacacactgcctcacttctagctgttttgtctttatggaccaaatcaacatatatctcacatgtattgtttggtgactgtctctctagtacactaaatttaagctgccatcaagccactttgggcacatgttctcaagatcttctggggctgttcacagttcatggtcctcacattcgcctcagaataaatctctctaaatattttgcaaggttgctttttcatcagtagttctaacagaacctactctgtggtttttgttaaaagcattatattaatatagtattagtaatattagtattagttataacacatgttggaaaattcttatgaagttatgcatagactaacaatgggatcaagtgtaaatgtttcaaagtatttaagcaagttatttcaaaatttatcttctgcagatacttctatcagattcattatatcagctaattacttgctttatgatttttgcattttattgtagatgatcacaccctatattttcttggcctttattgtagaaaattgtgtgaaactagtcagggctacatttgcaagtaattgtcgcagtggctgcctgaattgcagtgggtttcctctgcagccaccagtcactcagattactccaatgacaccttaattttgtttcctgcttggctttgggccttagtcttgtgctctccagacagactctgtctttcatctcccctaggtcaggccagagccacatggacctgatgattgtcaatatggtgggaagggtcgcactgaacgggcactctctgtccttctgagggagccatactgcaggcagacatggcagtcctggctcagggtgtgtccttccaagtatccctgcccttccttcaggtgtgatgctgatccatgcatcttcctcccattcctgggtagagggtctccttgttctttccccaatcttctcccagcagccactatgtcttcccactgatgtcttcagcttcctcttttctgcccttcccagcagatgagtctgttattcctgagggaagagagaggaggtgggagatgaggctttattcctgaaagaatggacagagctttggagcttttctttcttctaccccagtttctacgagttcctccagtgcctgtaacacagagctgtcagtggctttgcccctgcatgttaattctttggtcatgtagtggtggtgagggagctgggtctggatgcatttcagccacagctgctgttccacttccccacacagaaccgtctcaggaggaagaggttggagatttttctgatgtgtcctcaatcctgggagaaaagttttcaatagcaataggaatctctcagttgtatgtccgctgagaatttaaacaataacttctttataatactaaattttaaacaatccaatgaatatatctaatttaattttttattagcttatgtgacatttgctggcctctcccccagataaggtcatattctcttcctgtttgttcctgcaagtcactgaatttcacaagatgtaaggtctcttgattatactataacatcaataatctggtgtactaaagaaaatgtgctaatttgcagcttactaaaattagttgttttagtaaaaataatatatttgttatagcatgcctacatctccaggctgagtagaagctttgtttgtaatactcagaaactgcaaataacacacatattaaggagctttctaaataaatactatgggtgaattctttaactggaatactgttcctcattagaatcaacacattctttatacacaaccaaattactgactcacaagtaattatactgagcaagaagccacacaaatgaaattgaaaatataagatttcactttaacaaaatcttgaaaaatagatctgaattaacaaagatgagaggttgactcagtatggtgagagggaaataatggggaggcaggaatgagaggaacacagggaggcttttaactgtaatcatcgttatctcgattgttattttggatacacaggtgagcacacgtgaaattacgttttttttccttcggagacatggttttgctttgtcgtccaggctggagctccgtggtgagatcatagctctctgcagcctcagaccctgggtctccagcaatcctcctccctctgccctatgtagctgggactacaggtgtgcaccaccatgctcggcttcagtgcgtattaaaccgcacacttcaattatgcagtatttattatatagcaataatgcctcaataagggtattacaaataagtggatagataatttgttaaagattgatggaaagatagataccaacatgagaaatgtatgacactcaagaaaataaaactgtaggaaacttgcttttctttatatttgttaggtaatcaccacagtgtgtacacatcacaccatgttcccattacagagaaaaggttctgcgaacctcacgagctgtgacccctgtgtgctgggcttggttcagggagaagtcaggtccagtggtgagaagcacaggcccagatgcccaggctcactctgaccaaaagtgagcactggggacattgtaaaacccacctgtgcttttgctgataatttttcatctttaacatggaaataatattgatactatataccatggtttctctgcgtatgtaaaaataaaagatgattggtgctaactttaaaaatatgcagtttatgtagatctatggtacctcaataaaactgttttaaaataaaaattacaaaattataagatttttaggttttaaggtttaagtttatcacaaaacaaactgacaataggaaagcacaatttcccaatgctttcaatatcacagatctccccgaggacattctgacatgctctgagccccactatctccaaaggcctctcaccccagagcttactatatagtaggagatatgcaaatagagccctccgtctgctgatgaaaaccagcccagccctgaccctgcagctctgagagaggagcccagccctgggattttcaggtgttttcatttggtgatcaggactgaacagagagaactcaccatggagtttgggctgagctggctttttcttgtggctattttaaaaggtaattcatggagaaatagaaaaattgagtgtgaatggataagagtgagagaaacagtggatacgtgtggcagtttctgaccagggtttctttttgtttgcaggtgtccagtgtgaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagacacagtgaggggaagtcattgtgagcccagacacaaacctccctgcaggaacgatgggggggaaatcagcggcagggggcgctcaggacccgctgatcagagtcatccgcagaggcaggtgcagatggaggctgtttcctgtcagggtgtgggacttcatcttcttctgacagtttctctagtgaacctctctaacctcagaattctgtgcttactaatgtcatctctacgtattttttaaaagatcattttaatatgagcacctattctcacacgcaccaaatgcagattgacgcttacagagatgaaaagttctcaaccatggtcaccaggatgagagtcctgaggaaattcaggggtgcctggtgactcttccgcaatcagtcctgggacagaaacctcagggacagcctttatgagttttgatcacatctaacagagaggatgggccagggccagagtcatgtagaacctcacaggttccacgtctgacccttctcctgacactaaagccaatcagcatcagcactgacctggtgctccttttgctcccaatccatgttctttctttggagagtttcttctcccttttttatttgcttttcctctttcctgaaaaagaaacagatggtccccttggtccacattccagggctcaaggcattttcttggagctcaggtggggctcaggctgtggctcctgcagccacgtgggagaggctgatgggacttccttctctccccattttctcaggaccctctactgtgttgtgtgtaggctcatctgggaatgcagttgaccattaatactgaaggggacaaactcatttgatcaaaatgggatgtggatgtggagttaaccctgttccgtgcacagtgtcagagtcgtctgcttcagaagtagtgttagaaagagctggtgaaatttatcagaatcaagatggagccacttgtgttaaagccctaatgaatgaagctggggaaggccatgaaggagggttctaacacacatattcctgataataagaactaccataaatagactctgcacaaccataaccttgcacagaagccaccacaacattaaaagaattacttctcccattgtatctgcccagcaactccctgttcaactttacaccgatgtgcccctgttattgatccttctagcccaggacaattgtcttaaacagctgatgtgaccctcctcatttttcctttattctttatcttcctataccaacctgaatgcacccatacatttcaattgcaatacacttcctagaatacatattattatattttagagtctctctctctctgttattcagggttgacaagctacagatggacatgccactttctttttttatgactttttttaaaaattttattattcttgtactttaagttttagggtacctgtgaacaatgcaggtgtgttacatatgtatacatgtgccatgttgttgtgctccacccattaactcgtcatttagcattaggtatacctcctaatgctctccctccccactacccccaccccacaacagtccctggagtgtgatgttcctcttcctgtgtccatgtgttctcattgttcaattcccacctatgagtgaggaaaaaaatgatgagttcatgtcctttgtagggacacggaagaaactggaaaccatccttctatcattctcagcaaactatcgcaaggacaaaagacatgccacttttctgtgagatgtggaggatgacagtttttggagatgtctgggaatacccagtgtccagaagatcatccatcaataagtgcaggctggaggtcccagagagaggcaaagctgctgaaacaccatggaatttcattttctccagttctgctctgatggaatcaggcccacctgttttgcttgtcttaagtaaattcacagcaccacatatattagtgttgcagtgaataactacaaagtctatcctaaccaagtgtaccatcaaatttaccattacccagagggaagaatctttaacatgagatctatgttcataattttttaaggtgaaaaagtgatcactatccaatcaggcaaatatgattttgctaatgagtggtagatgttgcatgtatttttggatgtcatccctttttcagatgcatggcttgcaattatattttcccattctgtaggttggaattatttccacactttgtagaatctttttgttgtgatgtagttccacctgtttaattctgcttttgttgtctgtgcctttaatgtgaaatataggaaatcattgttaatatattattttctgggtcggggaaattttacaattgcaggccatatgtttaaatatctggcccattcagagtgatttttgtgtttattctaacccaaaattcttaactctttgcatgtgtacatccagtttttctaacacattcatagggagagacttggtttatctgttttatattgtgggttcttatgctgaaaatcagtttgccattgatacatcagtttatttctgagctctttctacatatttatgccaactccatcctgtttttattattctacttttgttattacttttgaaatctggaagtaagatgtaagtttatttttgcctttttacagatgctatagcaaaatattttaacctttcactcttccatataaaagtatggctttaaataatgacttttattatatacaggttatattcttgtattcctaacttttagaggttttattatgagatcttgaattttttaaatgttattttctatgtctggtgagaagttaactgatgcttttcctttattctcttaatttaccacatcagatttattgatttgaagatattgattcatcagcgcatctcaaaaataatttggagcttgtcatggtgtacaatccttttaaagtcttatagaacttagttgactatgaattgggagtagcttgtttatatatactaagaacatttgtcagaagtttggttttcttcttttgccttgtctattactggtaatacagtgattggagcctcttagaaagagattagaaggtggggacctcacggattttttaaaaagttagagaacggttgtcatcacttttttaaacgctgagagtcatttgttatctaatatataacccatcatgaggaatatctctagtgtgcttgggaagcatgcatattacgctgctgttggttggaatgttccgtagatgtctgttagggcagtttgttcgagagtgcttgagtccacgggcttcctaagaatttttctgtggatgctctatacattattgaaggcgaggttttgaagtctcctaatttttttatagttttctatttctccttttatacatcttaaagtttcataaatgtagttatatttctagtttttcaaatatgtaaaagagaaataaaaatatttgcttagtaattttaatgagaaaatcacataacaagaaattatattttccaaatgctgccatcaacactaaactcctccaggagtctcacatctgccctgggctctgctctctcctcaggcatcccacctcagcatttgctgcagaggaggggacgtgaaaatagggccctccctttcctgatggaaaccatcgcagccctgagcctacagctctgggagaagagccccagtccagcattaccaggagttttgatttgacaatcagctctgaacacacatggctcaccatagagttagggctgagctgggttttcttgttgctattttaaaaggcaaataatggagaactagagatattaagcatgagtggatgtgagtgaaaatacagtgattatgtgtggcaggttcggaccaaaatgtccctatgtttgtaggtgtccagtgtgaggtgcaggtggtggagtgtaggggagagacaagagtcagaaaagtgtgcaggaggccgggtgaggctgtagacactgtcagcccactatgccaatcccaccacgagtgctggagaaggtgggagtctgatgaagcttactaacaaaccctgtggtccaagctattccatcaaggccattggttcttcccagagcatagctgtccatcgggaatctcccatgtgcccagcagcagccacgcgttagcaacttcactgtgcacagtcattgtttgggaggagctccaggatgtgtctctttgtcaaaaactgggtgatggtgtcagagagctgtgccgggtccctggtccacgtgctccctgacattggaggtataggaggtgcgttctcagggtggaaacaccttttatggaaatgtacataataaatcacgattttccttggttctcttagacgacatggagaagcaagcatgcaccctgcaaacaattgtaatttcctgctttaccccaagttcatgatttcttgtaaactttgatttctgtccaagtacagagatactgattagagtgagtttggttctttccacacactaaccctcacctcccccagatagagcacattgtcctcactctgagtctgagggaggagctgttcctgtacaactcagggcctgcagagacccccgtgtgcagctttgcagagtcagatctttcctcatgtgaggcgacctccactgcccgtgattgctgctcaggtctaattgtggattcgggattatgacaccctttgggctatcacaggtcaatcttattctgaaaatcaccgtaattatagacagaggtaataatccagtacccattcttctgtccgcagtttgtctttcttatttggttgaaagtttgaagaaaaaatgtgaccatatattcatctaattctaacctctgaatctgctatttgctctcggggacctacaaattgcaaaacagtgagttcttcattttcatcaaaatgtgcaaatttgtgaatttcaacatgttgttcagaacctgtgcatgccgacaactgtgattctcggtgcactcctggcctggtgaagccctcacagatcctccccctggcctgtggcatctctgcttctccattacaaccagtgcttcctgctggagctggatccgtcaccccccggggaagggactggagcgaatcaggtgcacaggtcatgagggagtgcacaatccaacccactcctcaagagtccagtcaccatctccagatccacatccaaaaaacagtttctcctacagctgagctaccttaacaaggagtacacaaccatgatttttatacaaaagacacagcgaggggaagccattgtgcgctcagaacactctacaaattttcctccctagtgttttaccaaaactggtatatatttcagatactgaaatatttacaacctacgttattatgctaagaattctaagttagaagttagaatgataattgtctcttttttttcctttttttttttttttttgatactgagtctcactgttgttgcctgggctggagttcaatggtgcaatctcggctcactgcaacctctgcatcccaggttgcagcaattctcctgcctcaaccccccaagtagttgagattacaggcgcctgccacgatgcccggctaatttctgtatttttaatagagacggggtttcaccatgttggcctggctggtctcaaactcctgacctcaggtgatccaaccgcctcagcctcccaaagtgctggaattacaggcaggagccactgcacctggccaattatcctcttttcatagatggataaactaacctaggcctttgaaaataaacccttatctgagagtgaaaagataagccatagatttggagagtttgcttgcaaatcaaatatttggaaaaggacttttattacaaatatacaaattaccttacaattgaacaacaaaaccacacaatttaattttaaaatgggcaaagacctgaatagaaagtgcatctaacaataagtataaaaagtgaccaactggattttcattaggtaaatgtatgtttaatattgaaaaaatcctagtaacctaatagaatgggtaaaatacacaatatagacaataccaaatgttgacgaggaagttgaaaaacaggaattttcacccattgctcctgagaatgctgaattggcacatagacaactacagttaataatttattgtgtatttcaaattagctagaagataacatttagaatgttcttaccacaaagaagtagtcaatgattgagatgaaggttgaaggttgtcccagttatccagatatgcacataattttctttttttcaaaatatcacatgtaccacataaaggttttgaactattatgcatctatttaaattacacattaaaaaacaccagtggaagggaatccagctaattgcagattgccattggatgggacgttctgtataatctgtaaactaatcagaatctgtgtttttctaaaggacattaggaatcgttatactagtttctaaagataagccttgcaagtttaattattttcctaatgggtggcgattttgaacattgaagaaatgttagtatttgtttctggttaagttttcttcttctagtctcaggagaaaaggtttgcagggaggaatctgagactatctttcaagtctcaacttcaatgtgattacctcagtaaatattttctgatacccctgagtagggtaagtctcatatatgtccaataaactaaaagtagaattttaagcgcccaagctgactgaatggaaccttcctcttcacaaggagttccagagacttgaaaacctagttcaggccacattagaaacagatcagaaatgcctcattataccctcctcactttgtaattcaagcacaactgaccagcattttcatgaaaacagaggactcaaggctcagaaaacggattccgtgtagcaataagataccaaattctaacctgactcgagaatagcgtcatgtgacacagagcaggccttgaaaggaatcgaaggcttttaccctaaaatatatttctttgacatatttttaaatcgccctgcacagttatcctttgtgagagagatttacattctgtagagaatctccttccctttccaggtctttcgttatactgaggagattagctggaagtctagcatctcttaaaggtcttagtagaaaaacatttgccatctatttcctctaagcgtggccacataagagacttcatctgcataatatgaattttgttctccaaaacctgttatcttaacccagacactttttactactgatttctggtctttagataaaaacttaagtctttcaatgaattgccaattgaaaaatcatttaattcacctgtaagcggtaattatctccccacactgcctcacttctagctgttttgtctttatgaaacaaatcaacagatatctcacatgtatcaattgatgttattaaatttaacctgcaatcaaaccactttgggcacatgttatcaggatcctctggggctgcgtcacagggcatctaccccacatttggctcagaataaatctctctaagtattttccaaagttggctttttatcgatagaatctactctgtggtctctgttacattcaaaagcatgatagtaataaagtattagttattaaaaataagcacatgttggcagtttcttacgaagttacgcatagactaactatgggatcaagtgtaaattttcaaagtatttatgcagttatttcaaaatgtatgttccacagatacttctatcagatcctttatattagataattatttgttttatgactttttttgtagatgatcatgccgtatcttttctaggcctttattgtagaaaattgtgtgaaaccagtcagggctacatttgaaattcattgtcacagtggctgcctgaattgcagtgggtttcctctgcagccaccagacacccagattcctccagtgacaccttaattttgtttcctgcttggcattgggccttaaattgtgtgttccagagagactctgtctttcatctcccccaggtcatcccagagccacatggacctgatgattgtcaatgtggtgggaagggttgcactgaacgggcactctctgtccttctgagggagccacactccaggcagacatggcagtcctggctcaggacgtgtccttccaagtatccctgcccctcctgcaggtgtgatgctgatccatgcatcttcctcccattcctgggtagagggtctccttgttctttccccaatcttctcccagcagccactatgtcttcccactgatgtcttcagcttcctcttttctgcccttcccagcagatgagtctgttattcctgagggaagagagaggaggtgggagatgaggctgttattcctgaaagaatggacagagctttggagcttttctttcttctaccccagtttctacgagttcctccagtgcctgtaacacagagctgtcagtggctttgcccctgcatgttaattctttggtcatgtagtggtggtgagggagctgggtctggatgcatttcagccacagctgctgttccgtttcccacacagaaccatctcgggaggaagagggtggagatttttgtgatgtgtcctcaatcttgggaggaaaggtttcaatagcaataggagtctctcagttttaagtcctgtggaaatttaaataataacttcttcattatacttaattttaagcaatcgggtaaatatatctaatttaatcttgcattaacttatatgacatttgctggcctctgcctcagataaaattatattcttttcctgtttatccttacaagtcactgatttgattttcacaagaggtaagttctctcatttgccctatacatcaataaactcatgtattaaataaaatgtgctaatttgtagctcagtaaggctagttgttgtaaaaataatacttttttattggatgactacatctccaggcggagtagaagatacatttgtaatactcagaaactggaaataacacaaatgttaaggagatttataaataaatgatagggttgtactcattaactggaatactgttcctcgttagaatcaacacctttatacacaatcaaattactgactcacaagtaattattctgagcaagaagccacacaaatgaaatggaaactaaaagatttcactttaacaaaatattgaaaaatagatctgaattaacaaagatgagaggttgactgagtatagtgagagagaaatgacgggaggcaggaatgagaggaacacagggaagcagggaagcttttaactgtaatcatcattatcttgattgttattttggatacacaggtgagcacatgtgaaattacattttttttctttggagacatggtcttgctttgtcatccaggctggagctcagtggtgagatcacagctctctgcagcctcagaccctgggtctccaatcctcctccctctgccctatgtagctgggactacagttggcaccaccatgctcggcttcagtgtgtattcaactgcacactttaattatgcaatatttattatatagcaataatgcctcaataagggtattgcaaataagtgaatatataatttgttagataaagactgatggaaagatagacacgaacatgagagatgtatgacacttaagaaaataaaactgtgggaaacatgctgttctttacaattgttaggtaatcacaaaagagcatacacatcacaccatgttcccattacagagaaatgcttctgtaaacctcactaggtgcaacccctgtgtgctgggcttggttcagggagaagtcaggtccagtggtgagaagcacaggcccagatgcccaggtcactctgaccaaatgtgagctctggggacactgtacaacccatctgtgcttctgctggtaatttctcatttgtaacatggaaataacattgatactacataccatggtttctctgcatgtgtaaaaataaaagattattggtgtgaacttcaaaaatatgcagtttatgtagatctattgtacctcaataaaacttttaaaataaaaattacaaaattataagatttataggttttaagggtttaccacagaacaaacttacaacaagtaaccacaattcccaaatgctatcaatatcacaaatctcccccaggacgctctcacatgctgtgagccccactctctcctcaggcctctcaccccagagcttactatatagtaggagacatgcaaatagagccctccctctgctgatgaaaaccagcccagccctgaccctgcagctctgggagaggagccccagccctgggattttcagatgttttcatttggtgatcaggactgaacacagaggactcaccatggagtcatggctgagctgggtttttcttgccgctattttaaaaggtaattcattgagaactattgaaattgagtgtgagcggataagagtgagagaaacagtggatacgtgtggcagtttctgaccagggtttctttttgtttgcaggtgtccagtgtgaggtgcagctggtggagtctgggggaggcttggtacagcctggggggtccctgagactctcctgtgcagcctctggattcaccttcagttactactacatgagcggggtccgccaggctcccgggaaggggctggaatgggtaggtttcattagaaacaaagctaatggtgggacaacagaatagaccacgtctgtgaaaggcagattcacaatctcaagagatgattccaaaagcatcacctatctgcaaatgaagagcctgaaaaccgaggacacggccgtgtattactgttccagagacacagtgaggggaggtcagtgtgagcccggacacaaacctccctgcaggggcgcgcggggccaccaggggggcgctagggacccactgagggcgggacaggagcaggtgccgggagaaggttttcctttctcctcagctggaaaagtcaggtttgtgtttgccggactctggagctttctaggctgtgacgttttattacttgtgtttattatgaatttattatcgttagtatttaaattttagtaatttaaaaattatatatatatgtttacactttaatgaaataagcattcctatttgcaccgattcttccagagttttattaacatttgttgacgtcagcagctacgaagctatagggacataaatttataaccatagaaagatgtataggccaggcgcggtggctcacgcatgtaatcccagcacgttggaagccataggtgggctgatcacttgaggccaggagttcgagaccagcctgggcaaaatagtgaaactccatctctactaaaaatgcaaaaatcagcttgtgcgtattggcatgtgcctttaatcccagctactcggtaggctgaagcaggagaatcacttgaacacggaaggcagagattgcagtgagctaaatggcgccactgcactccagcctgggtgacagagcaagattcgatctcaaaaaaaacaacaaaaaacaaaaacaaaacaaagaaagaaaaaatatataaatacaaagacatatgcatatatgtgtaggaattcataacaaacattacaataaagtaattctaaaaatatgtcctaaagaatcaaacttaatgatgagctaaatgtaaattatttgagtatttcacaattgattttggttatttttaattgtttccatcaattgatttatatttgttcatttaactactgttaaataatggttatttcaaatgttgtcacaataaataataagaatgtgaattgataaatgataattatcttaatcatttcttaattatcttagttatcccatatggtattcacaaatcataacattgcttcttaccttgtaaatataaacaaccataatgtgggaatttaaaataaaattttttattttaattttttaaaatttatcccagatcattatctttttcttcagctccagctctcatgtgatggtctcaagggcccatctgcacccctgtctcctgaaggcttctgggagtggctgtgggacagggaggaagcaggagcccatgtgagtccacacgacctggagcctccctctccttggattaggccatctcctcgggatcacagggctcttcattatcctcaccccgctggtggcccaaacaagcaacatcacacttcaattcatcacgcttgggtttaattttcttaatcatcgggaaggtgataatgttaacaggaaatgtttcactaacaaataggataagcccttttccatgggacagggtttcttacaaggacttgacatgtattatgtattttccatttctttatagatgagatactaatatctccatattggagacaattcctttaagtcatttcttaaaattaatttttcctaggactccaaacaaatccatgatatagttgaaaatttcaggtgtaagagctgggccaacattgagactatattaacatttataacatgtgcttgcaaatattgttatttttctgtcggctgtccccagttatggtttgatacaaaatgttagtaatttatcctaataaaacagtttacaatattatatcaatagtttattaactttgtataactaataatataaaatgttcaacatattttagccatattttacttatttgtgaaatgtgtgcttattagtttttcgttttaagatgtcacctttatcttttttatttctgggattttattctagtagatataactaaatgtctttaaataattattgtaataatcacatttatattttctatttgaattatcatatgcatgttattaagattttaatttcaataaaaatattttcctccaattgtctattttctgtttttatgagataacatatacaaaaatgcatagctcttcaatgtacagtttgagggtttctggcaaatgtgcacgtttgtctccagcacctaagttagggtgaggagcaggtccatctccacaagtgtcctctcagtgtttccagtcagctctcacataaggatttttttttaatttcaacttttaatttagatacagaggggacgtgtgtggacttgtcacacgggattattgagtgatgctgaggtttggaatccagattccatcaccccctccctccactctccagcagtccacggtgtcttttgttcttctatttatgtccatgtgtgctcaatgctgagctcccacataggagaatatgtggtattcggttttctgttcctgcatttatttgtttatgataaagaccaacagctccattaattttggggcaagggacatgatttcattctttttcatggctgtgtagtattatatagtgtagatgtaccatattttgtatattcagtctaccagtgatgtgcatctgggttaaactacgtctttgccactgtgactagcacagccatgaatacgcatgtgtaggtgtctctttggtagaattatttatttactttttagtgtataccctgtagtggaattgctgggtaaaatgatatctctgttttaagttctttgagaaatctccagtctgctttccaaagtggcaagactaatttatattctcatcaacagtgtataagtgttctcttttctccaaagtcccacaagcatcctttgtttttcgacttttttgtgataccattctgagtggtgtgttgctgctcacctacaatcatctcatatttgataaggctgatgaaaagaagcaatgaggaaaggactccctgttcaataaatgatactgggacaacgggctagccatatgatgaagattgaagctgaccctgtactttcaacatatataaaattaactcaaaattgattaaagccttaaatgtaggacctcaaaccataaaactccttgaagacacccttgaaaacactcttatcgacactagttttgacaaaaaatttttggctaagtatccaaggccagttgcaacaaaaagaaaaatagacaagtggaacctaattagttaaggagtttctgcacagtaagacaaacaaacaaacaaacaacaaacaaaactatcagcagtgtaagcagacaatctacagaatgtgagaagatattcacaagcattgcatcccacaaagccctagtatccagagtctgtagataaacaaatcaaaaagaaccaaaaaaaaaaaaaccctttaaaaattggctgatatggtttgctgtgtccccacccaaatttcaacttgaattgtatctcccagaattcccatgtgttgtgagagggacccagggggaggtaattgaatcatgggggctggtatttcccgtgctattctcttgatagtgaataagtctcatgagatctcatgggcttatcagggatttccgcttttgcttcttcctcattttctcttgccacccaccaggtaaggagtgcctttttcctcccgccgtgtttctgaggcctcccaagccatgtggaatgtaagtccaatcaaacttctttttcctcccagttttggatatgtctctatcagcagtttcaaaatggactagtacataggcaaacgacacagacacttctcaaaagaatacatgcaagtgcccagcaaatatattgtaaaaatgtttaacatcactaatcatcagagaaatgcaagtagaaaaatgttctgatttctgtcactataggaggtccctttttcttgttaagaacttcatatacatggaataaaatattatagatcatttttgtaaggggccacttttactatttgtgaggttcattcatgtaatagcatttatcaaggttttgtcatcatatgtataaatatgtatgtactcatacacatatagatatttcatatctaaatcaattacattaataaatgacagattattaaataaataaatctgtttattaagtaaataagtgacaatatgtatatctattttcctgttgatgggatttaaatttgtttccaaaataaacatcataaacccaaactattataagtatctttgtacaagttcttctgtttatattcacacattttattgataaaatatgtagatatataggtatgcattataacttttcagctttatggagctatcactgacaaataaaattgtatatatttagggtacaccacttgatgtattgatgtacctggggagatgctcatcatgatcaaggtaatcggcatgcctgtcctctcagagagttatcattttatgtctttaatttcctgtgtgtgtgtgataaaaacacctaatatctactcttctggcaaaagatacctttataatacaatatttattagtatagtcacattgctttacgtttcatctccagaactatttcaacctgtgttttagtccattctcaccctaatgtaaggaactacctgagactgggaaatttacgaagaaaagtggtttagttgactcgcggttctgcaggcttaacaggaagcattattgggaggcatcaggaaacttacagacatcatggaaagtgaaggggaagcaaggaccttcttcacatgctggcaggggagagagagagaaagagcaaggcgagatgagccacacttttaaaccatgagaccttgtgagatcttgcaagaatcacaaaggggaaggtcgcccccattattcaatctctccccatcagacccctcctacaacacttggggattaaaatttaacatgagatttgggtgaaaatgcagagacaaaccatatcattccacccctggtccatgacagatctcatgtccttctcacattgcaaaatatatttatcccttctcaacggtctcccaatcttaactcatttcagcataatcataaaaatctatagtctaaagtctcctctgacaaggtcagtttcttccccctataaatctgtaaaattaaaaaaaacttagttatttccaagatacaacgggggtgcatgtactaggtaaatgctcccaatccaaataggagaaattggccacagaaaatggattacaggtcccatgcaagtccaaacaccagcagggcagtcattaaatgttaaagctccaaagtaatttttcttttaccccatgtctcacatgcaggacacactgatacaagagatggtctcccaaggccttgggaagctccacccttgtggctctgtagggtccagcgcccatggctgctttcataagctggcattgagttcctgtggcttttctaggcacaccgtgcaagctgttggtggttctaccattctggggtctagaggatggtggccctcttctcatagatccactagacagtgcctcaatggggactctgtgtgggggatccaacatcacattttccttctacactggcctagtagaggtactccattagggctcagccccttcatcagacttctgcctgaatatccaggcattttcatatatcatctgaaatctaggaggaggttcccaaacctcagttcttgccttatgtgcaccaacagactcaacaccatgtggaagcaaccaaagcttagggcttgcaccctctgaagcaatggtctgagctggaacttggtcccttctagctatggctggcacgagacagacaggggtgtaaggtgccatgtctcaaggctgtacagagcagtgaggtactgggcctggaccatgaaatcatctttctctcctgggcttctgggcctgtgatgggaggggctgccacaaagatctctgaaatgccctgggaacattttccccattgggctcctcattacttattcaaatttctgcagccagcttgaatttctccccaggacatgggttcttcttgtctaccagatggtcaggctgcaatttttttccaaccttttatgctctgcttcccttttaaatatgagtttcaatttcagaccatcttttcatgaatgcataggacttatgttttcaggaacagccagggaaaatcttgaatgctttgctggttagaaatttattctgccagataccctaaatcatctctccctagttcaacatagcacagatctctagggcaggggcaaaatgccgctagtctttttgctaaagcataacaagtgtgagcttcactccaattcacaagaagttcttcatcttcatctgagaccacctcagcctggactttattgtccatatcactatcagcactttggtcaaaaccagtcagtaagcctctaggaaatttcaaacttttccacgacttcctgtcttcttgtgagccttctaggctttcccaacatctgtccattacaaagtcacttccccattttcaggtatcgtaatagcagtaccgcactcctggtgcaaattttctgtattaatccattttcccactgctataaagaattacttgagactgggtaatttatgaagaaaagagggttagttggcttacagttctgcaggctaaacaggaagtgttactgggaggcatcaggacacacaatgatggcagaaggtgaaggggaagcaagaacattcttcacatggtggcaggagaaaaacagcaagtgagcggggaggtgccacacttttaaaccatcagatctcttgagaattttatcatgagaacagcaaagaggaagatcacctcatgattcaatcactttatattagaccctttcttcaacatgtagggattacaatttgacatgagatttgagtgggaacgcagggccaaaacacatcaacctgcataaccgaaatttttaccctttgacctacatcgcccaatattttcctcctctcaggccctgggagctactattctactctgcttccaagagctgaaatattttacattctacatataaatgagatcatgcagcatttgtctttctgtgtctggcttattctaattagcataatgttctctatgatgctgaaaatgtaagaatttccttcttttaaaggttgaataatattcaattttatgtatgtatatgccacattttatctgttcattcataaatggatattgacttattttccatatctaggctattatgaataacctcacaatgaacatatttgatacactcacttcattttctctagatgtacacttagaagtgggtataccctatgttcaattcattcagtaatcttaatgttgtttttataatggctgtactaatttacattttgttccaaaccatacatggatacctttgtaccaaattttcaggtctacgtttaagtgttaaatccatttcttgttgatttctgtgtattttgtgagggaaggtcctttttttttttttccttagagttagaatctcgctctgtcacccaggctggagtgcaatggcatgatctcggggcactgcaacctctgcctcccgggtttaagcgattcttctgcctcaggctcccgagtagctgggattacaggtgtgcatcagcacgcctggctaatttttgtatttttagtagagacagggtttcaccatattagccagctggtctcaaactcttgaccccgtgatccacctgcctcaggctcccaaagtgttgggattacagatgtgagccatcacgcccaaccagtccatttaatttcttctacatatggatacccagttttcacaccacttgctgaagagactgtcctttgtctattgtgtgttcttggcaacttgtcaaagatcagtttattgagaagaagtgggttgattatcaggtgcctataatgttccattagagtatatgtctgtttaaatgccagcattatactgttttgatttatatagatttgattttgaaattatagaatatgatatattcagctttgttatactttccccaaaattactttggctattggaaagcttttgtatttgtatataaattggagcattttaaaaatatttttgtaaaaacatgccacggagattatttactttattgacaaataatagatatacctaatttatgggagcatgcaatatatttatacatttacaaatatgtgaagatcagatcaggattggtatatctatcacgttaaacaggtatattttctttatgctaggcacattggaatgactctcttctagttattttaacgtgtacattagattatttttaactatagtcaccttactgatctatcagacatttaggttgtatttctcctatataactatgtatctgaattcagtaatcaacctctctttatccccttctctcttgtatccacccaggcttctggtaaccaacaatctactcttcgtcttcaggaaatccaattttttagttttgacataaaagtaagaagatgccatatttgtctttctttgcttggcttatttaacttaacataacggcttccagttccattcatattgttgcaaatgacaagatatcgtattttatggctgaataatattctattgcatacatagattacattttctctatccatttgttcacctgcagacactgaggtgctttcatatctgggctattgtgagtagagctgcaaagaacatggagtgcacatgcctttatgaggcggtgattttatcttcttcagaacatacccagaagaggatttgccacgtcatcaggtatttctatttttaatttattttggagtcttcatattactttgtacaatagtggaaatgcaataggaatatccattataaaaagcagtttcagttttgaggtatgatccaaaaacaaataatgtttgaccatgattctcactgggagtctctaatgagcctggtggaaatgcaggaagttttctaaccttgttaagaaaattatgactttgcacatttttctttttaaggctggtaattggcgtgattccagatgcatactgttggcgggtttcagaatgatacagaaaatcattatgagaaggcaagaaaaagaatgatagagagagagagggagagagggagagagtcaggccaacaatgagaaaaaataaatttcacaagaggagaaagtgctggatatcagtgctgggttttggtcatagacacatctgtactgagtaagaaactatgaagtcaagggaggagtctagaatttgttcaagtgaagcatcagcatattctctgaggcacgtattgtcaccccatcataagggtgatgaatttttgaatgccatgaaatgtgagttcacggtaagtaatcatgtttccatgaaatttagttaaaatgccaagggtgtgttcagatcacccatgcacaaatacacaaaatttgcctttgcatttatagctatctagagaaaaagtgcattgagatgtcagcaggttacagagatctgtttaagtttgggatcccatgggagagtgcctcttagtgaaggttggtctattaattcagtaagtaaaaattctttctatgggagtagcttctaattgtgtggaaatttcaattccttattgagtttttaaaaaatatctcagggactgactccatggagttttactgctgtattgataaaaattatcatcaaagaccaagggtagataaaacccaaagatggggagaaaccagagcagaaaagctgaaaattctaaaaatcagagcacctcttctcctccaaaggaacacagctcctcgccagcaacagaacaaagctggacagagaatgactttgacaaattgagagaagaaggcttcagacaattggtaataacaaactactctgagctaaaggaggatgttcaaacccattgcaaagaagctaacaaccttgaaaaaagattagacaaatagctaactaaaagaaacagcatagagaagaccttaaataacctgatggagcttaaaaccatggcacgagaaatacatgatgcatgaacaagcttcagtagatgattagatcaactggaagaaaggttaccagtgattgaagatcaaatgaatgaaatgaagtgagaagagaagtttagagaaaaaagagtaaaaacaaatgaacaaagcctccaagaaatatgggagtatgtgaaaagaccaaatctatgtctgatttgtgtacttgaaagtgacggggagaatagaaccaagttggaaaacactcttcaggatattatccaggataacttccccaacctagcaagggaggccaacattcaaattcaagaaatacagagaacaccacaaagatactcctcgagaagagcaactccaagacacataattgtcagattcaccaaagttgaaatgaaggaaaaaatgttaagtgcaggcagagagaaatgtcgggttacccacaaagggaagcccatcagactaaaagtggatctctcagcagaaactctacaaaccagaagagagtgggggtcaatattcaacattcttaaagaaaagagttttcaaaccagaatttcatatccagccaaactaagcttcataagtgaaggagaaataaaatcctttacagacaaacaaatgctgatagattttgtcaccaccaggcctgccttacaagagctcctgaaggaagcactaaacatggaaaggaacagccagtaccagccactgcaaaaacatgccaaattgtaaagaccatcgatgctaggaagaaactgcatcaactaacgagcaaaataaccaactaacatcataatgacaggatcaaattcacagataacaatattaaccttaaatgtaaatgggctaaatgctccaattaaaagacacagactggcaaattggataaagagtcaagacccatcagtgtgctgtattcaggagacccatctgacatgcagagacacacataggctcaaaataaagggatggaggaagatctaccaagcaaatggaaagcaaacaaacaaaaaaagcaggggttgcaattccagtctctgataaaacagactttaaaccaacaaatatcagaagagacaaagaaggccattacataatggtaaagggatcaattcaacaagaagagctattttaaatacatatgcacccaatacaggagcacccagattcataaagcaagtccttagagacctacaaagagacttagactcccacacaataataatgggagactttaacaccgcactgtcaacattagacagatcaacaagacagaaagttaaaaaggatatccaggaattgaacgcagctctgcaccaagaggacctaatagacatctacagaactctccaccccaaatcaacagaatatacattcttccaaacaccgcattgcacttattccaaaattgaccacatagttggaagtaaaacacccctcagcaaatgtaaaagaacacaaattataacaaactgtctctcagaccacagtgcaatcaaactagaactcaggattaagaaactcactcaaaactgctcaactacatggaaactgaacaatctgctcctgaatgactactgggtacataatgaaatgaaggcagaaataaagatgttctttgaaaccaatgagaacaaagacacaacataccagaatgtctgggacatatttaaagcaatgtttaaagggaaatgtatagcactaaatgcccacaagagaaagcaggaaatatctaaaattgaaactaacatcacaattaaaagagctagagaagcaagtgcaaacacattcaaaagctagcagaacacaaggaattactaagatcagagcagaactgaaggagatagagacacaaaaaacccttcaaaaaaatcaatgaatccaggagctggtctttggaaaagatcaacaaaattgatagaccactagcaagactaataaagaagaaagagagaagaatcaaatagatgcaataaaaaatgataaaggggatatcaccaccgatcccacagaaatacaaactaccatcacagaatactataaacacctctacgcaaataaactagaaaatctagatgaaatggataaattcctggacacatacaccctcctaagaccaaatcaggaagaagttgaatccctgaatagaccaatgacaggctctgaaattgagacaataattaatagcctaccaaacaaaaaaagtccaggaccagacggattcacagccaaactctaccaaaggtacaaggaggagctggtaccattccttttgaaagcattccaatcaacagaaaaagagggaatcctccctaactcatttcatgaggccagcctcatcctgataccaaagcctggcagagacacaacaacaaaaaaagagaattttagaccaatatccctgatgaacatcgatgcaacaatcctcaataaaatactggcaaaccaaatccagcagcacatcaaaaagcttatccaccacaatcaagtttgtttcatccctaggatgcaaggctgattcaacatatgcaaatcaataatcgtaatccatcatataaacagaaccaaagatcacaatcacatgattatctcaatagatgcagaaaaggccttcgacaaaattcaacagcccttcatgctaaacactctcaataaactgggtattgatgggacttatctcaaaataattagagctttttatgacaaacccacagccaatatcatactgaatgggcaaaaaccggaagcattccctttgaaaactgtcacaagacagggatgccctctctcaccactcctattcaacatagtgttggaagtatggccagggaaatcaggcaggagaaagaaataaagggtgttcaattaggaaaagaggaagtcaaattgtccgtgtttgcagatgacaaggttgtatatttagaaaaccccatagtgtcagcccaaaatctccttaagctgataagcaagtttagcgagtctcaggatacaaaatcagtatgcaaacatcacagacattcctatacaccaataacagacagagggtcaaatcatgagtgaactcccattcacaattgcttcaaaggggataaaatacctaggaatccaacttacaagggacgtgaaggacctcttcaaggagaactacaaaccactgctcaatgaaataaaagaggatacaaacaaatggaagaacattccatgctcatggataggaaaaatcaatatcatgaaaatggccatactgcccaaggtaatttatagattcaatgccatccccatcaagctaccaatgacttttcttcacagaattgtaaaaaactactttaaagttcatatggaaccaaaaaagagaccacattgccaagacaatgctaagccaaaagaacaaagctggaggcatcacgctacctcacttcaaactatactacaaggctacagtaatcaaaacagcatggtactggtaccactacagagatatagatcaatggagcagaacagagccctcagaaataataccacacatctacaaccatctgatctttgacaaacctgacaaaacaagaaatggggaaaggattccctatttaataaatggtactgggaaaactggctagccatatgtagaaagcttaaactggatcccttccttacaccttatacaaaaattaattcaagatggattaaagacttaaatgttagatctaaaaccataaaaaccctagaagaaaacctaggcaataccattcaggacataggcttgggcaaggacttcatgactaaaacaccaaaagcaatggcaacaaaagccaaaatggagaaatgggatctaattaaactaaagagcttctgcacagcaaaagaaactaccatcagagtgaacaggcagcctacagaatgggagaaaatttttacaatctacccatctgacaaagggttaatatccagaatctacaaaaaacttaaacaaatttacaagaaaaaatcaaacaaccccatcaaaaagtgggtgaaagatatgaacagacacttctcaaaagaagacatttatgcagccaacagacacatgtaaaaatgctcatcatcactgaccatcagagaaatgcaaatcaaaaccacaatgagatgccatctcacaccagttagaatggtgatcattaaaaagtcaggaaacaacaggtgctggagaggatgtggagaaataggaacacttttacactgttggtgggactgtaaactagttcaaccattgtggaagacagtatggcgattcctcaaggatctagaacaagaaataacatttgacccagccatctcactattgggtatatacccataggattataaatcatgctgctgtaaagacacatgcacatatatgtttattgtagcactattcacaatagcaaagacttggaaccaacccaaatgtccatcaatgatagactggattaagaaaatgtggcacatatacaccatggaatactatgcagccataaaaaatgatgagttcatgtcctttgtagggacatggatgaagctggaaaccatcattctgagcaaactatcacaaggacagaaaaccaaacactgcatgttctcactcataagtgggaattgaacaatgaaaacacttggacacaggatggggaacatcacacactgggtcctgtcatggggtgggggtagtggggagggataccattaggatatatgcctaatgtaaatgaggagttaatgggtgcagcacaccaacatggcacatgtatacatatgtaaaaatcctgcacgttgtgcacatgtaccctagaacttaaaagtataataaaaagattatttaatatgattccttccagtgtttcaagaaaactttttctccaaaattttttccagcgtataaatttttctggctgaatattataagaggctgttgctaaaaagacatactagaatggcagctttaatctgttcatgataggagtgagcataatacatgatctctttgagtgttctgcctcatccaaatgcagtgtggcaaaggctaatattggaggtaaaacctctaaatgaattttttccagctaccaagtcataggacaatagcagatacgtccttgaggtagaggaccataatgccacagtgttagtagcagtacatttgtccaagggagttccagggtttattaaaattatgataattttaatgtaagaataccattcttttaaacttatgtggaagattgtaggaggttttcacaatgttgtcctttactatcagccatgcctcacataatcactttataatactttcatgggtgttcttcactcagttcatgcaaaccctggcagtttataggctaaaaacacaaaatacagaagcttttaatcaactgaaagagctgtagccttttctcaaggaattatttcaagacacggagaacacagatggatgataaataaagtacattcacatccccttaagggtagaaattgaggaaaatttacccaaaggtgtccaaagggccctgtgacttggtttctgtctaagtcccagtgttagggttcttccaggattttgtggctagctcgtcactcctcatcaagaattaacctctgctgtttcctcaaagtgtttatttaatctgataaccagtttgtctataaattatagagttgaaatgcaacaaatttcatttgaaataatctggcacaaattatctaagcaaagtcgataatgatgttttttcattcatttgtatttaagatcatcagctaagcgttgatatttttgataacacccatgtctctctcagcagttttgtcttctgaggatatgatctggcgtggcagttctcttagcttcagtgttacctctttttgccttgacttccacctttatatttgcccggaatctgggatataggagtgcctctaagagtcccctaacttgcccattttggtgagtgttctggaacctatgagatgctcttttgtttacaaagcaccccaaagccatgtactgtgccaaaaggtgtttatttcctagtttgacaaattagaaagttctaataaatacaatcacttctgccatctgggctgattttatatcagatagaggactgtgttctaaaggaaatcttacattagtaagagcaattttagtcattaacctagagttgtactattgaggtgcaagtcataagaaataatattaggtcgaggttctcagtgggagtgtctaaatgtcttgtgtgtacagggtctcctctattaacatgaagcatttttgagcacagtcagtttccagctatgcttctccctgtctcactatcaccacaaactaactatgaccccacctggaacctaggttaatttccaaataagtcattctttaatctttgtgcctctagattattatgtgagtcaatttcagtagaaacttaaaaagaacatttgaacggactaaacaacacagaaaaacactaataaaatgcaaagcctagatgtgagaggctccaggcctggataatggaacacttcatgtatgcaggtaatttcttttcccaattcaacactgatacacccagcatatcagcttcatgccccattttactcctattatgtagagatatggcaatgacattctcaaggtccacacacatatatgaaaattggtaggactaggggaggagatgagtctgcacttctcctctgaaggaccaggaaagcctggacagaccatctccccggcctccatgactgcacctcctgcccacatggacactcacccctgataggataagaggattccattgatgaggctgagtattttatgatataagttactagagagtgacattgaggtttcaaaaactaatatttataacctaaatttaatttcccccaaattgttacctctttcttcagtgaaaaattgcttgccgtgattgagatttaggtagattccaaatgttcacaactaagcttccaagagcgtattgggagcaaaaactgaatgagggtagagaaacccatcatcatgtattcaacactaaattcaagtggactcagcactgcctttgatcactgctgcttctctgcagagttcaggtttctacttctcacgattccaacatagactctctctctcccaaatgtttggcctccacttgctgtaaggtcgcactctgttcttagtttgttctctgaaccattttatgagggtggtgatgagccatttaatggaaattttatatcatttcagctgaatcccatgggggatcatgaattattcttctggttatagtaatggatttttcttggtgtgttcattaccagtaatattcaaagtcatttcatttaaatctttgatgcttcattttttgttgctatgacattctttcttctattgaatcttcccactaggcattataacatggatctagtatccaggctcagttgtcatcaataataaccacatatgtcaaaacctatgtcttctttccacaggagacatatttttctcttttcaggggatgaacacacactgctgagtgaccccactcacaagtacatatacacaattatgagatttttatttatttgactaataagatgtatcattctcccttaaaattcttcaacccccagaagcccgtgacaaactcttctgcatctgttcataccataaactcagaaaacaaaccacatggtgagtaaaagctcacacggttctggatatggggtccatctcttcccctgcaatgtcctgcagcacctcagaccacctgtcctggttctatcaaggaagtttacctccagcacagtaaagaaaacaattgaaggaggagagaacctgcagatgatagacaatattcaaaactattcatatgacaagggattactatcaagcacataaactcaactgaactgcaaataacaatatgattaataatgggcgaataacatggataaacgtctctcagaggaagacatgcaaaggatagatagatagatcgatagggatatatacatacatatattgctagaaataactaatatcaggaaaatgcaaattcacaatgagctatctttccttaatctttgctggaaagtctgttagcagaaagacaacataaggaaaacaaaagctggccaggcttcatggaaatgaacacttttatagaccacttgtggaaatgtaaattagtacagccatcatgggaaaaaaaagacaactaccatataaatcagcaatgcaactgctgagtgtgtgtgtgtgtatatatatatatatataaaattaaaagaaaaaactaatattgaagagatacctgtcgacccatatttattgcagccctaaacacaattacgatatgaaattaatgtatgtgtccatcaaaacgtgaatgggtaaataaaacggggtatatttacacaatggaatattattcagccttaaaaatgaaattccgctgtttgaaacaacatggatgtaactgggaaccgttgtgttgagtgaaacaagccagacacagaaaaaaaaatacctcattttctcaatgttatgtagaagtttaagaaagttcatcttctagaaggaaatagtagagtagtggttatgaaatatcagaaatgggtggaggccgagagataagaagtggtttgttaacaaatgcacaattacaggtagacaggtgggatacgctctagtgccctacagtgcagaagggtgactacagttaacaatatattgtacactttatgtttacaagtagccagaagagagaattttgtatgctaccaagcaaagaaatgttaatgtctgagctgatgaattagctcgttgttctgatttggtcaaaccacattgcacagatgtattgaaatatcacactgtaccccataaatataaacaatcattatctgccaacttaaaaaatcctttaattaaaaaagattttatttgcatacattacaaatgattcaacacagagccaggaaaatataacatttttatttgaaatagttaaattcctaacaaaatagttacattctttggcaccaaactgtgtatttgatcatggtaagtatagacagacttatgcaaagaataatatattttaaacttagacttctacttaatactataaataaaaataattttagaacagctaagtaaaaggaataaagttgaggaaatgtgtgtgtggtgtgtgatgtgtgagctttttcttgtaaccacactgtccatggtggatgtgtggtgtgtgtgtcttgtgtcttgtttgtgtttcctctgctaggggttctctgtgattctaggatctgtagctccagtgtgtttcaaaaaattgggaacattcttagccattactttttcaaatacttctctttatctgcaatttctccttttcagaattaaaatatacatatactacactttttgatattaatgtttagtttcttcagtctctgttcctttgcaatttacattgtgaattttctagagacaatttaagtgcatggtttcatttaaaagctgagccagctctactgaggggtatgcccaaagtttgctcaatgtttatactgcattgcttttggtttcttatgcacttccatttgattctttcttaatatttatatctctcagttccctatctagtcctgcattatgtccacagtttcttgaagagattctcacatatgaattacaggtactatacatatcttgtttaatcagatatttctaatatctgtatcatttacaaatctcattctgaacatttgtttattgtgactttagtatttctcattaatataggtaataattgttgttgataaccagacatgttgggtcagacaggggatattatcttattatttcattttatccattttctgcctgtatgtgaccacactttatctgtgccaggcctttaatgtggaaatgtctgaatcttctcagagctacatgtgacatttacttgtggagtggacgtcagagttgaagtctgctcttctgtgcccgacagagacttcagatcctccagtgataccttgtttttctttcctgcttggctgtgtctctacacctgttccctcctccagagaatctccttcagttccttcaggggggttaagatgttatattcaactgacaattgtaaaattgtcatagaataaagggatatttagaataaagggatattttctgacctttcatgggtccatattgtgatcctgagtctgggtgtgacctttccattgtttctgaacttcctccagatgagatgttggtctgtgtgttcttgctgttttccctgggtgagagtcctcttgttttccccagttgttccctcccacagctccaatgttctcttttggtgttatcatcttccagatttgctgacctgacccatagattaaggctctgattcagtatgaaagggggaggtacttctcaatggaacttaagtaaagacctctttttccatctcattttctaagggattgtcccagtgcccctaagatcctggttttggtggcttgcccctgcagagtaatttcttagttcctgcaatggggataaaggaggtgagtctgaatgcatttcaaagtgtgggttctttttctctcacagacagacacattggcacggaaagatttttgtgactctccacattattgggaaaactgattcaagaggataggaaagctcttcagtatgtggtccctgagaaattcatacaacaccttttaccacacttgacttcaagcaatccaatatatatatgtgtgtttttctcttgtagtagcctacattttacatgccagactctgcccagttcagctcatatcctggccttgttactgcctacaagaacttgcctctccctgcatttcagatttgatgtttttcttaaaacttcaagtatttaaagtatttttaaaactttgcaaaatcccattttgctctgtttacctgatattgttgatgttgttattgtaaaaagtaagtagaatatattcctcatctatgtacgtttcaaaactgagttgcagctttttttggtaagacccagagtcataaaagactgcaaatactgttaagctgcttaacagaaaaacaaatgctggtaaatgtgttcactggaatactacccgtcatttataataaataaatgcctgacacacagaacaacataaaatatctaagtatttataccgagtaaaatatgccaaacaaataagaatatatactatgtcatttcattttttataaatgctgatgaataaaaaatgcatctgaagtaaaataatgaggatccagtagttgctgggggaaatggtagaagggaaggggagaggaggaggaatacagcagaataagaggaagtgttgagaagaattcacttgtccactttcttgataatgacgacagttacatcacgtttattaattgcacattttaaatatgtgaagtttattatctttcaattaagccacataaaatgtattacaagcaaatggaaatttagacaagcacggagtaatagaaagatccaaacatatgttaaatgtcagaagtatctgaaaattagtgtgtctggaccctagttctctccatattttcaggtgagtgctggtggcaacatcacacatgctcttactacagaaagtgggttctgaaaaccacaccaggcacgtccagctttgtcctggagttggtttagggggatgtcacagccagtgacggaggagcacagggccagataccagcgttcacttatcccagacatgaactcctggatgcatacagagccccctccacttgtgggtttacttccacttctgtaaaaggagaaaatattgactcctacagaacataatttacacaaatatttacagatgaaatagggtgatcagggcaaagtgtttatcacagcacaatttcataagacagcatattttccaaataccatcgtcagcaaacatctgcagggcaccgtcttattatctgggtacagcctattcctccagcgtcccaccctagagcttgttatatagtaggagatatgcaaatagggacctccctctactgatgaaaaccaaccgaaccctgaccctgcagctctgagagaggagccttagccctggattccaaggcctatccacttggtgatcagcactgagcaccgaggattcaccatggaactggggctccgctgggttttccttgttgctattttagaaggtgaatcatggaaaagtagagagatttagtgtgtgtggatatgagtgagagaaacggtggatgtgtgtgacagtttctgaccaatgtctctctgtttgcaggtgtccagtgtgaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagacacagtgaggggaagtcagtgtgagcccagacacaaacctccctgcagggtccccaggaccaccaggggcgcccgggacactgtgcacgggtctgtctccagggcaggtgcagttcctgctgagggctggcttcctgtcatggcctgcggcgccctcattgtcaaatttccccagggaacttctccagatttacaattctgtactgacatttcatgtctctaaatgtaaaacttttttgtcctttttgtttctttgtttttgtaacaggaggacacaccctcacctccacagaaaccacagtgtcactttgggggcagatgatccttctgtggtcagcaggatgaaagttccgaggaatctcaggggaacccgaagagtgtttgccagttagactcagggcagcgacctccacgggaatctctgattagaacaggctttgagttctgataggagccaagagagacgctcacacagggtcagggtccttaaagcctgatggttttcacagctatcccccctggtcttgtaaaactgtgtacatatgactcagactgattcacttgaccccctttctgctaatccattttccttctctgcatacttgattctcacaattccctttcttctcttccccgaaaactgaggatgtgttttctgtagtctaaattccagggctcaggtctgcaggacctgggtaggctacggggactttctcactcaccattgtctggactctcctgttgtcgtctgtgaacagagatgtttggaagatgaagtggacattagtcatgaagggaataatactagttttctccaatgggatactgatgtagagctggatcttgtgcttctcacactgtcacagagtttggactctcacccgtgactttgaggagagctgaggatggacactccattgtgctgtgagctctgggtaacaatagtagggccctggctaggcagcctaaggtcaatactgctggccttcaggaaagacaggctggaattcctgggaagacctgcatctgccgtccaccatggagtcccatcgtcttctattatgccctgattgaatcagccccacctaggttatctagaacactcttcgtgacttacgaaaaaataatgggaggctctactaacacctgtgttatgccatgggagcaacacctaagctagtgtgtgattgagtagatgagactgtggtctagtcaaggtgacacataaaattaattgttgccattataatattttattatatatttggcaatatagtcgtgctcatattataaatacttttgctacgttgttgttatgtcagaagcttttgaataagaacagcttcatcttgaataggggctaggaaaaataagactgagacctgctgggctacgttcccagtaagctaaggcgttcttagtcacaggatgagataggaggtctgcacaggatccaggtcataaagaccttgctgatgaaggttacagtaaagaagctggccacagcccaccaaaaccaagacagtcacgaaagtgatctctattcatcctcactactcattatatgcttattgtattgccttaacatgctaaaagacactccccctagtgcatgaccgtttacacatgtcatggtaacatcaggaagtttccctgcatggtctacaaaggaggggaggaaacctcagcttcaggaattgcccaggggactcatgaataatccatccgttgtgagaaatacattcatccctttgagagaaaatgcacagggggtggaatgaggctgggaagctgatggcacatggtggaagcctgtccctgagtgaaggagagggggaagctggattgggtggaaggtctctatatttgtgtgctgtgcaaggaagtgcaaaatataattgagttttgtgcaagtcagtgctgcctctcaggtgatccccatgactcccagaaatggctctgcttaggaatccctggggagtcagtcatttcattagagtagaccacaggacatgggcttcagcacacgccatgccacagatgtcagaaagcagctgctgggaacctgacccacctgcattttgctgcctgtaggaaaaggcagggaggtgcatcctcagggacaacacactgttttggatttctataaagaacgctgcttttactgtgttttattggaaaatacatgaacaaatgtgagcctgcaaacaattgtaattttcagttattttaattgcattcatttgtaattctgcatgatatgctgacacagagtcgcatttttcatagatattgttcaatgaatcaagaacatgcattttccactttcactggtttttctccgtgtgcagagaccttgagtagagcctgtctggcccttatccacactatctcttgtgtccccgggaaaaagcagagatttgcctgactgcagaatctggggtaggagtctgctcagctcacagcctgcagagaagcccagtgaagttttatggagtcagagagctttcccatgtggggaacctctagcttacccatggccagagattactggtcagctgtaattgagagtttaacaattagagcactcagaagcctatctcatcgcagcttcattatgtaacttaccaccattagactgcggtaataactcaatcttgatttttctgaccccattttctcatcttattcatttgtaaattgggttatagaaaatgttatgttttagactctgattcaaatctcagaagtttatgaactcatcaggaataatacaaaatgtgtctagttttggggaaatgtaaatgaatgtccatgcagtgtgtgtgtttgttgtgtggggatatgtcagtcacaccccaatgaacatgatttctgaattacatcatcaaactacaattagatttgctgaaaattgcctgcagtaatgtctgtgatgatgaacctgtcaccttgttgtgaggatgctcagtgcacaggcgaggttgcacaggagacatccaaggagcagcccccaggcttggcagaattcctggccaggagccagacataggactgggtgtctcaaaagcagattccccaaccccatccctttatttggactgcatgggcatcatgaggaccagcaggagatgctcagaactcactcaaggcagagcaccatttaggagcaggtgcagcgaggaaacagccagagaacctctgactagaagcttgggttgttttcttttgcttaagagcatccaagcctaagtatatcaaccactatatgtatatatataagtagactatccactatatatagagagagatagatataatctgtatatatatacagattatatctatctatatacattatatatacagattatatatatatataatctgtatatataagaaagttatgagttacagattatatatatacatttatatatatacatttatatatatttatatacatttatatatatacattttatatatattatatatatacagagcaaaacgaggttaatatgactctgccattaactccttgaacctgggtcattttttctgagaatgccgtcatctacagcatgatggttctcatgtcaaaatcaacacgcatagttagtcaccatgaagactgttttatctcatggtagaaatgtttatttaattaaaaaattacatttcatacgaaagggtctgtattatttctttctcacactgctgtaaagacatcacctgagaccgggtaattcgtaaaggaaagaggtttaatggactcacagttctgcatggctggggagcctcaggaaacttacaattatggtggaaggtgaaggggaagcaagtcccttcttcacaaggcagcaggatggagagagagagagagagagagaaggagaagcaggataaagagccggaaacttatcagacaaaccaatctcctgagaactctatcaggagaacagcgtggaggaaaccactcccacaatctaatcacctctcaccagacccctcgcctgacacttggggtttacaattcagtattagctttgggtgaaaacacagagccaaaccatgtcagaatttctaggtgagaattggtcaattcataagttattagtgaagtatcagaaaaataaatagcaccagtgttgttgttatccagttaatttataaaccatgtcaatatccattttatgagaggtgtaggaaaagtgtgagatggatagatagatagatagatagatagatagatagatctaccaaatacaatatatataactatattatatatattactatgtatataatatgtagtaagtgatatatggtatatatatatgacattaattctaccaaatacttcacatatgtatgtgcatatatatataatattaggtatgatatatatatgaaatatcaggacatatatatatatatatattttataatgtctcctgggatttagtgttgaattttttaatatctacatgtattccaggataaatgttggtggacttcataaaatatattctaatttttatgtgcaagatgatcactttcaaataaggtttagctacagaaaccagatgtatctttctaccagaaattactggaaagcacagtgaaatttcttaatcaggattttaagatgcttgacaccactcaacaaagacagtgattactaagagagagaggaaataagcataaggagccctccggtgaatgcaggctcagatacttcctcaaaggtgttgccaggctacagtgctggagtggaaaccatgtggatttagcattaataaaatggagctggaaacccatgtaggccaagaagtgtggataccacaggatagcaagtggattgcagaaaactgtcagagagtgaaccccatagatggcaggaggaacacccagacttgacagagtgcagatcagtgtgtagaaagcagggaaggttgtacgtgagaacacaccctgctgcaggaagctctccctaaaatccagagccatggtaaatatatgaatatacacttacaaactttaaaacatacggaaaggcaccataataaagtcaaataaaggaaaggtgggttggctacattaaaatataaaaagagtatttctgagcaaataataatacttatgaggggaacaattttattctaccatggcaaatgatttcagagaacaacattcgaaatgcttatggccataatgaggaagcttcaaacaagtatacgaatagaattattaccagagtggtagtaccagagccctcagctttctgatgaaaactgattcttattatgaaagctaattattattataagcttattattattaacactaattattattaattataatattatataattattataatattattatgaaagcttattattattatgaaactgatattactagagccctaagctaagtgttattaccagagtcctcagctttccgatgaaacaacaacgtctgataaaaattgtaataacccaaacatataaaatcaattcaaattattctaaggatgcacagtaaataaaaatcattgattgataaagtgtgctgctatagactgaatgtttatttccgccctcagacatttgttggaattctaaccccaatgtgatggtgttacgaggttgggccgttggtaagtgaatgggtcacctttggaagatgactaggccccatccaccctcatgaatggaatcagtgcccttgttagagactccagaaagctccctctcctcttccaccaggtgaaggaaaagtagaaagatggtcaactatgaaggaggaagcaggttctcaccagataccagtttcaaagcatgttggccttgcacttgctgaccttcagaattgtgacaaatacatttatgcttgatctgaaccacccagactattctcttacagcagctaaaacatcaagtctcagctagggcagtgagggcccacaatacttgagagacgagcatcaccctctcctttccagttcaggatgacagaagcttgatctcgggctgaactgacaagcagagagtccttcctctcccccagatcgcagttgaggccgtggtgtcagatctctgtggttgagagtgaattccagtctgtgatttcatggatgcctttcttcatctagttccacttatgagacagagattccatgctatgagttataggccaagaatagaggaaccccaattattcccacccagctcacctgtagggcagaggatctggagagctttctgggtgaggcacaaagagactgtatgagtccacccctcccatgcagtttcctgtacttaaagcagaggtgtccctctgacacagatgaaccctttcttccgcaccaaggcagaggcggttatatttttacagtggcagacagagggcataaaaacagaaatgcagagctctctctaatggatgtgactttatttgcagtaaaaggagaataatttcaaccctaggttttttctaaaatattataaatatttatggtaagttattaatagaaagctggtggcttcatgagagcaacacattaaacaggaatccactcatttcagcggacagaaggagaaaaaccataatttaggaataatgagctgggcactgtggcactgcctgtggttccatccacttgggagtctgatgtgagaataacacttgagcccaggatttcaaggccaacctgaaaacgtagctagaccccatttagtaaaataaataacattttggggtcaggacaaagttcaaaaactgcccctgaaatgaagcccaaatttaattgtgtaacactgtggattaatggatgacacaacagtgtcaccatgcctgctgtgagtgcagtgtaacacttggatgacatatgaagagatacagacacccaaacagagacatcagacagtgaagctgtcaaaggctgcactgccgagcgtcaggctttttatggaaaccgtgtgtacatctggaactgcacctgggaatgacgacatcaaccctttaatagtgtcggggaaagagacgtcactgaaatagacaaactaagggactcaagaaataaatagagcgattggttttaccaatacaccagagcgttttgggtgatcactattcagagtttctgaattgtgttacctaactgtcattcagaaaataattatgagatacacaaagaaaaaaataacgtcacgaatgtacaggaaaatttccagaaaacacaaactgtctttgagttggtacagattttggacttaacaaatggagacttcaaaacaattattataaaaatgcacaaatcacaaaggaatactatcctagaaaagttaaggaaggtatgatgacagtatctcaccaaaagttaatatcaataatgagagagggtttttgaaagaaagttatagacacgctaaaattaaaaacacagtaattcaaaactatatgtcagaggtgataagcagtatacttgaacctaaaaagaaaaaaaagcacacttagatatatattagtagatatgctatattcaaagaatagtgaaaattgcaataaaatgaaataagcttaacataaaaggtggacccagctagacaaatcaacatatgtttagtgtgaacattagcatgagaagagagaaagaaatatgtcacaaaaatatgtcataatataatgacagataattccatgatttttatgataaatactaatatacacattgaagtatgaatagctcaacaaactcaaggtaaaataagttataagagatcctcaacaaaacacattataataaaatattttacagaaaaactactgagaaaatcttgaaggcagtgagagaaaaacaacttctcatatacaagataattctatcaacagctgatttctcatcaataacagctaatgctaaaaggcagcaggatgacatattttccctttgtatcccattttatcctcaaaggccacctgcatacaaagtagaccagtcttacaagaaaatcacagccctagtgttcttctctcaaggagcccggctatggacctaatggtgccctccccaaagtcataagtataattcccaacctgcaatgttacagtatttggaaatgagacttttgaaagtgatagagtttgaatatttgtcctctcccaaggtcatgttgaaatgtaatcaccaatgctggagggggggcctggtgggaggtattggataatagaggcagatccctcaagaatggcctatgcaatccatgtggtgatgagtgaattttctgttagttcgcatgaaatctggttgtttagaaaagtctggagcctcctccatctcttctcttgccctttcttggccccatctcttctcttgccccttctcttgtcatgtaatgcacctgtgtgcctgctgcctctttgccttccacaatggttataaactttctgaggccctcacaaagcagatgctggcaccacgcttattgtaaagcctagcaaatggaaagccaaaatgaaacctgttttatttataaattttccagcctcaggtactctttcctagcaatgcaaggacacagcaacacagaaaattggtatcaagaagtggagcattgctattaaaaatatgtgaaaatatggacgcagctttggaacaggataaccgtcagggatttggaaggtttggagggctcagaaaaagtcaggaagataaagaacagttgggaaagttttagagactggttaaatggtttgaccaaaatgatgaaataaatatggacagtgaagtcaaggcagagaatgcctcaaatgtaaatgagaaagttatagggaagtgaagtaaagatcgcctgtcaagcaaatcacttgactgcattatgttcatgtcctggggatctgtgcaagtttgaacttacgagtgacgacttagggtatctgacagaaaaaaaattgtcagtagcaaagcattcaagatggagtctgcctgcttctaacagtctaaaatcaggtgcagaagtgaataaatgacttaaagttggaacttctatttaaaagagaagtggaacatggaagtttagaaaatgtacagcctggttctctggtaaagaaataatccagttacactgtgaagcaaccgcttgctagaaagattagcttgactaaaaaggagctgactgtggtaatacgaaacaataggaaaatagtcttgaagtcaattcagaaatctttgaggccaattctctcattacaggcttaggtataggagcagagaatgtttttgggggtgagaccagctagggctcaaaggtacagctcggttcaccacgtctgatggcgcaagctgtgatccttggtggcttccatgtggcataaagcctgggtctgcacagtatgcaagagtcaacatggcttggtgactggcctctagatttcagaggatgtgtgagaaaggctaggtgccagaaatgagcctacctcagggtcagagtacacacagagtaatttttccagggcaatgctgaggtgaaatgaagagttaaatcccccaaaagagatccccaggagaacactgtgtagtggagctgtggagagaaggtcactggccctctagaacccagaatgggagatccaatagcagcatgtgccccaagcctagaaacgctgaaggcactcagctctaaactgtgacagcagccgtgttggctgcactgagaaaagtcacataagcggttttgctctcagacttgcgagcccataattgcaccggctgcaagatgtggagtcactggtcactttggaggcttaagatcgagcgcctgtcctgctaggttttaggcttgcatagagcctgttactcattcatttggcaagttcctctcttttaaaatggagatgtttacccaatgtccgcaccaacattgtacctttgaagtaaataagttctttctaattttacaggctcacagatggaagaaatgtgggcatgaatcttagacaagactttggactttaatggtgaaacaagttcagatttaaggggcagatttcgaggggtgggtattgggaagaaaatgatcccattttgcagttgagaaagatataagattttgggtgataagagttatgtggcttccatatatgtccattcaaaaatctcatgtttgactgttatccccaatgttcgttggggttttgcgttacgggggcggattcctcctgagtggcttagcgccatccacttggtgacgagtgagttctcacatagttagatcactcaggatctgattgtttaagggagacgtggatctccccctttccttctttcccctgctcaccatgtgacactcctgcttcccctgtgccttttaccagaaatataaggtttttgaagccctcaccagaagcagatagcagaaccacacttcctgtacagccttcaaagcagtcagccaaattagaatttattttttataaatttctcatccccaggaatacttttatagcagttaaggaatttctataagaaagaaagtactgaatttaaaggagacgatgagggtgaaacatcagaatgaaattactgacctcaggagtaaagacaccagacagtctctctctctctacttctctctctctatttctctctctctctctctctctctcacacacacacacacacacacacacatgccctaaatgaaaagatcatatgatcaagtaacaatatgatggctgctctgagccaaaagtagaagcctcaaactaaacctatcttgtcagcatcttgatcttggagttcacagcactgataaatggaataaaattaatgttgcacgagtcaccaagtatgacagtttgtaatggcagcttaaactgacgaaagaaaatttggggttaagaagaggaaatctgatgttacaattatttgaacattgtgaaagtagcttggaattgggttatgtgtaacaggatggatacctttgacatatatgaagaaatttgcatattgagggtcatgctgatagacagaaatgagtggttttggaaaatggagcaacagtcatccttatcataaagttttttaaaaaaaacttggctgggcagtgatataatatttagtgaaagagaagttgtgagtagtgagaaattgtgagtagctgagaatagttctaagtgttgaagatattttgcttgattcctcctgagtgcttaaaataagtgaggtagataaattaaaatcagaaaaaaataaaagaaaaagaatacaaaagctgagggcttagaaaattcacaacctatccatattgcaaaaatcagaaactgtattctacaaagaacactgagtatatggctcaaatatcactcagtaagaagcttaagatactctatgaaaagaaatatttcaggttttaaagaatgagaattgacctgagacaaatttgatgaatactgttagatttttcagatttaatggcctggaataatagagctacttggctgcaaatgtacacaattcttccagaagagagaaaaataagctttaaatttatttagaaaccatcagaccactgcctctatttcaacagaccagaaagcctgtttctaaaatcttgaggaagaaaccacccaacagaggcttgggttgggagcacccagcaagccctgtgtgtagggctgcatgaggcccttgacatgggagctgggcctagcagtgcctcaggagcggtgcctctgcctgcagctttggagctgattctgctgctcgaataagctgagaaggaaaaagaatgtttcagagaagattacagtggaggcttaaagcatatggaaatttgttttcctatgcattgtatttgctggagacaaaccacccattttaccccctatttttttctttggcaatgaagctttctattctatgcctaattcaacaggacacagcagcggctgtatccagtttgacaagattcagcatgaaaggttcctattacctgtgccggatgcatcactgatatgcggccaccagtttcttaggttcatatcactttaagggaccaaatacaaatgtcaatagcatatgtcattcttaaactgcagaaatggtgtcaaagaagaatgtggagataagagagcaggaggaattatgaaaatccagatagcatcttctcttctagagtggaaggtacactagtaatttcatgaaacaataaaatagatgaaatgtgtcatcatcatggagtgtctcacagtggcagtgcacaaataaatttctaaaaattccataaggtaggtgtgatggatgaggcttatttccacacagggagcccataaatacccagataagtaaaaaatccaacacctggaacgaaaaatgcctcatcttgacatcacaaacccatctcagtaagtccgaggagtaatgtggaaatgaaacggaaaattcacaaacacatttattgtgaaatttttagcacatgtttgaacattaaaacagaattgtccacaattttaggaaaaccactccatgacaatgagtcactacactcatagaaacaccactgagtcaacagagttctaactgtcagcaggtcagtactgaggcctcaggagaatcaaggctctagggtacattttacagaacccagaattgagccacacaatctatagccaaatgatctttgacaaacttaacaaaaattaacaaaaatatacaccagaaaaaggacaccccattcaataaatggtgctggggaaatggaaatgaacatgcagaagaacaaaactagacccctaccctcaacacatacatactcaacacaaaatgaattaaagacttagatataagacctcaaactataaatgtactcaaataaaataccaggacaactcttctgggcattggctgaggtaaagaatttatgactaacaccccaaaagcacacccaagagaaaaatagacaaatgagacttaattaacctaaagagatatttcgcagcaacagagtgaacaggcaagttgcaaaatgacagaaaattttcgcacaccttgcctttgacaaggaactaacatgaagaaattacaaggaattaaactatacaacgacaacaacaggaagaagaaccaaataaccctattaaaatgagcaaaggacatgagtagacatttccaaagaacacatacaaatggataataaatacataaacaatgctcaacatcactaaccattagggaaatgcaaattaaaactacaataagatattatcttacaaaagccacagtggctattattaaaaactcaaaagtatcagatgttggtgaggatggaaggtaacaggaactcatctacactgtagatgaggatgtggacgaggacaacctctatggaaaatagtatggagtctgcccaaaaaactggaaatagaactgccatttgatgcagcaatcccaccactgggtaactactcaaaggaaaataaatcattacttcaaaaagatatccatgcttctatgtttaccacaaaactattcttaataacacacatgtcaacctgagtgtccaccaacagatgattttataaaagaacatagcacgtatacacaattcaatactagtcaaccacaataataaatgaaactgtcttttgcagcaagatgcctagaactgggaacaacataattagtgaactaactcacaaacagagagtcacatgtcacacattattatttataagtggaaggtaacaacgtgtccacaaggatatggagagagaaatgatggacaccggagacttagaaggatgggaggtggaaggtgggagcatgaggagacattacctagtgggtacaatgtacattatttgggtgagagtacactaaaagccaagaccactgtggaatatatccatgtgcaaaagttgcactcatagcctttaaatttatataaataaatgtacaaacaaaaaaattaaaaatataaaataattaacagttgaccaatgatcttaaagttaaaatttagaccaggcgtggtggctcacgcttgtaatcccagcactttgggaggtcgaagcaggtggatcatgaggtcgggagtttcagaccagcctggccaacatggtgaaaccccatctactaaaaacacaaaaattgaccagatgcggtggcaggcacctgtaatcccagctactcgggaggctgaggcaggagaattgcttgaacccaggaggcggaggttgcaatgagccgagatcatgccactgcactctagcctgggcgacagagcaagactccatctcaaataaaataaaataaaatgtaaaaaatgatcaataaatgaaattactatcagttgaaactcattaaatttaaagacattttctactcaagtaactataagaacatgaatgtcaagtttcagatgggaaactattttcaaatcagataaccaccaatttaattataataagaactctcaggactcaactgtgaaaaaaaaaaaaggaaggaaggaaggaaacaccccatggttaaaataggaaagggttggtgcagacatttcatcaaataggatgtgcaggtgacataagcatttaaacaggctcttaacaggatttcccattaagggaatccaaatcaggcccacaatgagaaaccactatacactttttagaatggctgaaattaggaggaaatacaggtaataccaatgctgatgagcataccaagttcctagtgtctacgacattgttaatgggactgcaaaatgaaacagctactctggaagataatttttagttttttctgcaatcaaacatgcccttaacacatgacctaaatatcccactcttgaattttgcttcagagaaatataatcttatattcacacaaaacctctattcaaatattcaagatattgcgtgtgtgtgtgttagaaactaaaaataacataaatatctcaaaatctgaataggtgaaaaaactaggaagcaactataaattgaataccatcagcaataaaaaatatcaaatgatcgattcacaaaccattacaggtggaactccaggcattacgctaagtgagaggaagccagtctcgactatcaaagggacacagctgtaagcagcacggtcatcctcaggtgtcagtggtttgggctgggctttctttgtctctttcctgaccagacccagatgttgagctctgccacttggagatggaaaattctactattttcaaccatgcactgaggtgtgaattacttcacagactgaccaaacaaacatgggctccactgaagagtgtctggcatttgtttcaaccacaagagaacttttcccagctcttccatgtccttggttctctcctgcaagccaggagccctggagtgtagcctgcatctcccatgtatccacccagctccttccaagggtcttccaccacaccctccactgtttgtgagagcactgggaggctttcaatttttccacattctgttgttactgaagttaggatgtttaggacttattaagatcatattttatgactgaatttcattgccccctctctcctgggacagagctcctaaacaaggttctgcaggtgtagacaaagttgagctgttttattcctcagcctaggagctgagcgctcagtggagggtcggagaggagcttcccaccttctcagcacttcggttatggtgggggagaacctctgccataggacagagctaggaaccagagacccaatgttcccagtggcgctggacccaggggagagcctccatccatgagtggggctctatggaaggagtgagtctctggctctcagtagctcttgtccagcactgaacctcagcatcatgtgctgtgggcagggtcagagggccaacgtactgccccctggggaagagtttcctctggtgggagttggtagaaggtgccctgtcttcttggctgcatctgtccgcagtggagtttacatcatgctgagctgggatgtggaaggaaggaagagcaccttagatcaaatacgatgactggccttactgagttttctatattttcttaaataaatatttcttcacttgctttatgctgttagatcctttccaaaccctgtaattttttcaaaataattttcactggtctcatgagggcatggattcattgagcccctcatgctgttaaagagaaatagaactgtttttttttttcactttttagcgaacatccatgggttataaaataattagttgacatttcttccaacactttacagataccatcaactttcctcttgcttgtgaggttttaaccagaagaatgctatcatcatcttttctgttcttttggaaggaatgccccctctactcacctccacttgcctgcatatatttctatttgtctttgcttttcagcagttttaataagatttacctaaatgtgtgtgggggaagcagggggtgttattctgttgttctgtgttctctgagatgcatggattcaccatttactctgcctccattttggggaacacagttagaaaaaatgtcagtgtgagcccagaaacaagcctccctgaagggggaacaggaccacccgggggcgctcaggacccactgagcacaagagccagcctcagggcaggtgcagacgggggttaaggtctggtttcccgtcagccctgtggcttcctctccataaaacagtttcctctggggcacttctctggattccttatcctgttcttcctattcttcctgaagaagaaacatttgtcgtaacaagagaaaaattttctcacatgcaccaaaggcagagtcacctacagtcacttattccggtttctcaatgtgaataaattatcaatgcttctgaatttaatcagctaaacctattaaaggtgcggtgtttaactcaacactgccgccagctcaacagaactccaagggtcagtgagcaggagggaggataaagggcatgctgggcactggggcagagggagttagcatccagtgcaagagaagaaaggccccgtggtggtcactgtcaggacttcaagcccatagttccaattgtaggtgaccacgttcaaaagaagagagacctcatccatgattagtgtgatgtgtcaagtctgatagtgccacactcacacctcaggtgattatgaaaagatttaccaactctactattgtctgctgagagcagcacaggcctctcaagaaattccaaactggaatttcctcaatggaacaggaaaggaggctggcttagggctttataatgatttggtggtggggtcggggggtcatttattctcaggagaaggagcttgtgtgatttaaacctcacattggcatcagatgagggagcttctacgatttctgactagatttcccatatgtgggggacaagggagaagaagaataaaccttaattcatcagcagcaagcaccaaaataggacctgacactttattctccctagcagcttaagaaaatgagtgaaaaagagagatgagggtccactgtgtgtgaaaagcaaacagaaataaagaaaataaaaatttttattatggtaagcacataataaaaagaaagagaagaaggaatgagacagacagtggtgctgaatcaatgtcctgggtggggccttttctattatccactgtcatcagtttattctgaaggtctcaggtcagcttcctgcttcaaactatcacaggcccttatagggtatataaaaatccttataggatatccacagtttgtcatactttactaaagtagtctaataattagatgaagttctgaatttaatattcagttataataaatattaaaaaataccacaatctacaaattaggaaaccgagactatatttttatcaagggttacagccatcccatatgctggaaagcatagttttggtaaagatgagagacagacactcccaagaagaaggagttgggcagaagatttatgctgaactgtttggctaaacagacttagtcaacaggttacagagaggctactgatgttcatggaggtggtgctgacacatgcatactgaacacacatgcatttaacatgtgagtcctgttcaattgccagtggtgacttagcatttaaattcattacagtcaggccctatgtgcaaacagcagaagcagagacacaaaggcactcagggtgcagcctctgtaaacagccagagccaggccatggtcagcggtctctgatcaggagaaaggtcctgatatcaaatgttcaatcaaagctggggttatggcttgtggaacagggggtcagttcagcagggatgggctgcaattgtcttcatagtgcttgtctcagtgccagtgcttactgagccaccagagaaaacgaataacctattggcagttagaacatagtttatcttttaagtgtagaagtgagtggcaaaatcctcgtctagcaaggccttaggtcttgtttataatttgacatcttactgccactgttctgtcagtcttatgatttctattttaacataagtgttggccattgctgcgtctaaaccacaaagggaagaaggtataacgaggcgtgtctgatctcttgtttagacatggttggaaacagtttttggatttttacggggttccctaggccaagagatggactatttaatcagtcgtgggttttagggatttatttttaggttacagtttataaatatgaacccaactattgactttctgcaatttcactgctgtgttgtggttaaaagtacctgataaaattccttccaaagtggttcaagagcaatattctaccctgatgtttcttacaatagatataattccctgctttaatgttattagaggctattgaaaagatgtagggaaatgatggtttaatctgttgatgaatagtgtgggtaaaatgcagtcatcactttcaacactttgtcatgcatgcatgtaataggacagaggtgagcattgtgggtaaatctctaaatgtatgggccttccagctaccaaataataggctaataactgatgtctccctgaggggattaactataaggctctcttgctagggagagaatctttggccaaggaagttcaagattttcttaaggtttggacaattttagtttaaggatgacaattttcttcaacattttcagaagattgtggatgggatggatgctatgttgtatacataatgctaatgccttccatatttagataatattataaacccctgactgataagactgcttgcttggtgtgatgacccactacaatatgtatactttcagttggtatgctatgtcattttccttcaggtttttactttccaagttacattagtcaggtctctaaaatgcaggactgcatctaaaatgtgttattttgttgtgcattttcacatgttccagaaggtgggagaaatttctttgtgtgaagagcatcccaaagtcaggcactcctctagaacacgtgtttaatccttgtctttggcttattgatgagctctgttgactgcaataacttctgccatccgggctgacttgacatcacatagaggaacaaattctgaatgaaagtttgctctactcaattgagtgcataacctcatttcattactgatgtataatgcatcagagataatattagatcaaggatttcaatgggaatctaatctaaaagatgtaaacaaattttcataatttagataaaattactgtgagcacactgctgctattcagccatgtctcctatcacactgaatccacactaactttgacctaaaagttagcatttgttctaatgttcagaattgttatttttatcataacgtctctagatgattacagagtgtggctatgttggccatcagtaaaggaaagctattttaactgaatgaaaatgagacaaagcacacaacctaatgtaatggaagtcaggacatgagtgtctccaggcttttgtgtttcaagagttcatgcaccaggggatttcttttcttacttgtacacagagcaacacccaaaatgttcatttcctctcccatcgactcttatcatctgtttctatgtcagttagctttgaatttttgaccccagctgcattcaagtagctgcaaataagcgtgatttcattcttttttatagctgcatagtattccactgtgtataagaaccacgttttctttatccagtctataacggatggacatttaggttgattccatgtctatggtactgtgaattgcacagtgatacacacgtgagtggatgtgtttttttgttacaataatttgttttcttttgggcatatacccagtaatgggattgctgaggggaattgtaggtctgttctaagttatttgagaaatctctagatcgatttccacagtgctttggccaagttacattttcaccaaaagtatgtaagtggcgcttttctctatagccttgcctgcatctgttaatttctgatcttttagtgatagcaattctgacatgtgttagatagtatgtgattgggttttgatttgcacttatctgatgatttgaggatgctgagtatttttgtatgttagttggccacttctatgtctgtatttgaaaagtttctgtgcacgtcccttccccatttttaatggggttatctgatttatgctgctgatttaagttccatatagattactgacttgcacacacggagaaagccagtattcccaactaaatagaaaaacataatcacttgtaggtatagacatactgaatttggaatggtcatggcttgcatgttggtattgaaatgggacagcaactttggaaaatggtcttcactgaaaatctcatacacaagtgtacctggtgtcaccacttacagtagttgaatggagaatacaactcaagtgcccatcgactgccacagggatgaagacgccgcggtgtgtctgtgtgtctctaacccacagggatgaagacgccgcggcgtgtctatgtgtctataacccacagggatgaagacgccacggtgtgtctgtgtgtctgtaacccacagagatgaagacgccgcggtgtgtctgtgtgtctgtaacccacagagatgaagacgccgcggtgtgtctgtgtgtctctaacccacagggatgaaggcgccgcggtgtgtctgtgtgtctctaacccacagggatgaagatgccgcggtgtgtctgtgtgtctgtaatgcagctttaaagaggagtgaagcactgacataggctgcaacttggatgagccttgaaaacattgggtgactgaactgagggagacacggaagtctacatccctaattgtcccattgacacgaagcacgcagagcaggaaaatcccagatcacaggaggtcaggggaagggaaacacagagtgaccgcttaatggaggtgaggtttccttttctgtgatgaaaatgttcccaaaccaaatagtggaaatggttgcacagcattgtgaatgtgtaaagtatcactgacccatacacttaccaagggctgaaatggtaagttttatgttatgtgtatctcaacacaataaaaatgagtgccacattttgtttagcatatcaatgacaataacagttcaggtgaatgctggattcctcatcacaaccagtgcttcctgatggagctggattcaggggagggactggagtgggttgggtgcacaggtcatgaaggcagcaaaaattccaacccactcctcaagagtccagtcgccacctccagatctatgtccgccggggcagctcttcctatggctgagctacatgagcaacaagcaaataaccatgttttttgttgttgttgtttagttttgttttgctttgtttttagacagagtctcgctgtgtcacccaggctggagtgcagtggtgcgatctcagctcactgcaatctctgcctcctgagttcaagtgattctcctgcctcagcctgccctagtagctgagactacaggcactcactacgacgcccagctaatatttgtatttttagtagagacagggtttcactatgttggccaggctgttcttgaactcttgacttcgtgatccacccgcctcagcctcccaaagtgccgggattacaggcgtgagccaccgcgctcagccacaaccatgtatttttaagcaaaagacacagtgaggggacatcagtgtgagcccagacacaaacctccctatgcgggttcacaggacagcatggggtgctgaggacagaggtgggcactcaggaaccagcagggaaacccagggggcgcttggcacttcatgggggctcaggaccattgtgggctcagtggtcaggcaggctcaaggctcagcctcagggcaggtgcagcaggcggggaaaggccctggagactgggtttagtgtcaccttctcattgcgccactggacaccctccactacatctattctaatgtgtatgagtacttatgagtttagaaaataacattgatattataaatctatagccatatgtgggtgcatcaagttaccctcttcaacctatgtggaccctgttcatcaggaataagtccctgcatttgaggaccttataaatcaataattatgtagaatcactttctttttcagtctcatttcctccctctttctctctctcacacacactgacaaacacgctgggtgctataactttaattacctgatgtgttaaaaaaaattgattcatttggaacttaaccagtttagctgttgttcacgctgttatgtaaaaaagatccctaaatgacttctacctggtaagaggagggaaggcgttggaaggtgaaattgcaggagaaggagagaatcgtgaaacggagtgagttgttttctctatgaatggtgattaggtcaatatttttcaaacggtgaacatattgtgtgaagattatttgtcaatattatctcattaaaactattgcaaataaaagtgtataatttggtaaaaaaaatgaagagagaaataaaaataatacaagaaaagtcatgaactcctgactccacacgtgagttaaccctcagtttttctatgttacttagaaaaacactgagatacagccaaataatatcatgatatctttataagaagagggttttgtaaccctcactcgaaatttctagctctgtcctagagttaatttagggagcagtcagatccagctgtgagaaacacgggccagacagtgagactggcttttaccagatgtgagctcttagacatgtcacatggcccttccgtgcttgggggtttaccttcacatctgtaaatgaaggaaactttgactcccacagaacataattcatgtgcatctataagtagaaatgctaatgagaattaattatttatgaagtataatcactcgcatccactctgggacacagcctactctgaggcatcccttccagaagtcactatatagtaggagacatgcaggtgggtcctccctctgccgatgaaaaccacccagccctgaccctgcagctctgggagaggacccccagccctgagattcccacgtgtttccattcagtgatcagcactgaacacagaggactcgccatggagtttgggctgagctgggttttccttgttgctattttaaaaggtgattcatggatcaatagagatgttgagtgtgagtgaacacgagtgagagaaacagtggatttgtgtggcagtttctgaccaggtgtctctgtgtttgcaggtgtccagtgtgaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagacacagtgaggggaagccagtgagagcccagacacaaacgtccctgcaggaagacaggaggggcctgggctgcagagggcgctcaggacacattaagaacacagtaaactcagggaccaggtgcccagggaggttaagggctggtttcctttcagagacttagctgtttctccatctaacagtttccccagaaccctgcctagatttgtgatctgtatctgctcaaactatctgtgtcaccttcctcacctgtgactttgaggaagcttagtgtggacattccagtgggtggagagatcttggtgacagcaattgtgtgttctgtctaggcatgtctatggctggccatcaggaacgacaggctggaattcttggaaagaggcacacctgccatccatcaggaaattttgttgtcttctgttctgctagaattaaatcaggcacgcccaggttaactactactatcttcctagcttgagaaaattaatggtgggcttgaataacacctatatgaaatcatcagagcaacacctagattcgagtctcatttaataattgagactatgttctagccaaggagacacataaaactggtgattgccgtggtcagttcatatcatatatttgtcagtagaatctggctggtattatgaacagctttgccaacacatgtgttagtgttggtcttcggagaagcacattctatgaatccattaggtttatgtacagtttcctaaggaaccggtccacgcttttgagaggaaacgcagagcgggtggaaagaggctggggaagctgaaggcatatgagggaagttggtccctgagtgaaggagagagggaggataactcagtggaacttccttaaactgtgctgttctaggaaggtccagcaagtcactgtatctgagtcatgtcaaagtttcccatcggggacccccgtgactcccagcagtggctctactcagatcagcgcggagctcattgttctcctgagagtggagcacaggacgtggccccagcaccagccgtggcatgcacatcagagtgcagccccaggcgcatggctcaggtgcactgtgctccctgcaggtggagggagggaagacctgactcagaacccatatgatgtgggttccatacagaacacaacttttacttaatttctgtagatgacatagaaataaacatacagtctgtaaacaatggtgattcctacatttaccttgagagctttattctttgattctgcagaatgtcctggcatggtgttgcctttctcatgtggaagtgtaacataagttgaggacatgtgttccccactttcattgttttcctccatgtacagagatcctgagtggagtacagctgaccctccttccacactgttcctctcctccccacgggaacagcagataattacctgaggctgaatctgaggtgggatatgtcctgtgcacctcagagcctgcagagacccccggctgcagattcatggagtcaggtgtttgtgcatgtgggaatctcgagctgtgctgttgtcagtgaatgctgcttagaactaattgcaggattcagaattaggagaccccctgatctatcacacctcagctcattctgccactcatcatcttcagaaattctgaatatggttcagtttacatttttgtgatgtactgttctcatttcatttagtcatgagtttggtcagcagaaagtgctaccatttatgtgtcccaacctgatgaagctaatttgcttcacgagaagttaggaggctcctgaatcttatcctaagcctgtctctctgcactttcctttaaaattcagttttacctggaattctgttgtgttgatttagccagttttccccatactgagtgtctgattttcctggatatctgatcagtttccttgtccttcaccataacttgggtgacatctgatcaccctggtctaacttcaacaaaaatcctggcaggctgccctaagcaggatttacctcactcctgatgtttcttcttggtgattttccatcctgtgccccaaccctgctgtatgcctataaatcctcacgttctcattctgtatttggagttctgctgaatctctcccccactgcaaaatcccactgccctggtccctacacctatcatgagggccctggatgaagtcttccttactgtgctggaacaagtgtcttcatatatacattttttctttaacaaatcaacctttagtatttcctaattgatcaaaggacctcaaacattgcatgaaagcgaggatctccattttactataaggggtgttgtgtgaatttcagtttccatgtgtggtgtccagaagtcctgggcaccaacggttgtgcttctctgtccaattctgtgattctgaaacccgggagtcatctgaacatgagtaaataggtgacttttctcactatttagtgactgccttatttcatttaccctgaagcttcacgaacacattgatgaaaagtagatagagaacttgtttggaaatgcaagatttatagtagacgtaaccacctacatgattctggaggtcttcttagtgttccaagaaccagatgtttttcccaccacaggacaaagatgagaacctccacgctgtgaggatagaggacaggcagggcaaagatgagaacctccacgctgtgaggatagaggacaggcagggcggtgtgaggacaaaaggggctgtggtcacgtccagggtgttctctcctagcaacgcctccagctctttcctcactctgtggtatttgtcagatgggaaacatacctcaaatttatatttgacatattgatggaagtccaggcaagaggcatctgaaagcttatttctgaacctgcttctgtaaggaatgcccatatcccttggtctctttcctctttcttaactccattggctcccttcccctcctgcacacacccactgacgtttatggccacttccccacacccttcactgtagtaccattttcttgggctcctgggaaacccaacagctttagttaaactcacagctatgtacacccataggcccctcaggaggttctcagtttcactcctacagtctcccaggctgctccttggggtcctaacctgaccatctctaccctctctcctgagtctggccatccattgaacgtccctgctgccctctaatctggatttgtgtacagtagaaggttaactcagcagacctggattgtttaaaccctgcacattcctgaaaaacattgttcatttatggctctcagttacctcctgatgagaactctgagcccttaaaatgctatgccagataacagtgtctgtggttgtctgcagccttgggacctgtagtacacatttaatcatagtgctttgtagtgaatgccagctatttttttttcctgggtagcgggggagctgttgtctgagtattgtggtcagttgaaatgcctaaccttgttttcactctaactcactactttgaatcttccctgtttgtctctttaatcacctagccttgcttctcatgtaagtaagactctctctagctgggaaagctggacaaactccaattgaccccttaatttacaagacactaagggctcctcacccaacccccttccgtaaggagttaacctgtgtaaacagattctcagcatttcaaaggagcccagttaactgataaggtactagcaccaacaatgtatgaagttcccaggatttttctcaaggagataacaacataaagccttgagttcatgcccggcatagcccctatatctaattataatgaaagatttagagccctgcacctggtactgttgctctttttgtaaccatttgtcttttaaattgtttatctctctgtaaccattttgcttcttttgattcttgcatgtttttacttccgtagaattattgcacttgagttcccctccccttcctaaacctaggtatgaaagttaatcaagccccttcctcggggcccagagaattttgagcattagccgtctctttggccgctggcttaataaaggactcttaattcgtctcaaagtgtggcgttttctctaactcgcctgggtacaacatttttggaggccgcagcgagatattaacaccactgggcgagagccggtctcgctccgggctcccccggaaggatggccagctcggaggagggacaccacctgaggaaagaattttcaggtccgcaaagagtgaccgccttccagaggagagcggatcgaccactgtgtcagcgccctaaaagtcaacatctgagtcctcagcttctgaccccggggtcaggtaggtcggatgtgacttcgtttccggtgagaggggagcggccctgacgagggcgctgagtcctcagcttctgaccccggggtcaggtaggtcggatgtgacttcgtttccggtgagaggggagcggccctgacgagggcgctgagtcctcagcttctgaccccggggtcaggtaggtcggatgtgacttcgtttccggtgagaggggagcggccctgacgagggcgctgagtcctcagcttctgaccccggggtcaggtaggtcggatgtgacttcgtttccggtgagaggggagcggccctgacgagggcgtccctcttttgactcagcccattactctaggatgctagtgggttgagccttcgttttccggtaggcgccttcgtatcttggtttgggtgggaagtggtcctgaccaggaccctcccttgacttagctcaagacccaggacgctggagagctaagccttggtttctggcagacctctctctctctcttctatcttccatccttcttttggaaatctccgggaaaggaaaaaaaaaaaaacctgttataaactctgtgtaaatggtgtgtgaatgtgggaggacaaaggcttgcgtttgtcttccagtttgtagctccatggcgaaagctacggagtttgagtgggccctcacctgccgttctgtggtgacctcataaggcttaaggcagcatcgggcatagctcgatccgagctgggggtttatactggcctgccaatgctaagaggaacccaagtcccctcacggggagtggccaggcaggcatctaaatgatcccatcacgggacccccttcccttgtctgtctaatagagaaggtaaaacaggaaaactgtcatcattgtttacatgccctagggtcaattgtttgttttatgtttattgttttgttcggtgtctattgtcttgtttaatagttgtcaaggtgttacatgtcaggacatcgatatagtccacgaggtctgggtaaaaatttcttcaaggtccttagtgctgattttttgtcacaagaggttaaatttctaatcaatcatttagactggccaccacagtcttgtcttttctgtcataaacaagtaagctgttgttacggaaaagagtgtggagaacattcacctgattggaatttctggcaccatgaaggttgcgggtatttagattgtcataccccacgtcctagtgattggtccccttctaaactgaactggtggtgggttcaaaacagccaccctgcagaccttcttgctcacctcttctgtcattctgtaacttttcctgcgcccttaaataggaccttgtgtaaagaaacctacgcccgtcatgctttacttcgtttagactcctattctgttccactgtggctactttctcatcttaaggacgatccgagtggtccttttccccctcgtccctgccccttaccccgcacatctcgttttccagtgcaacagcaagttcagcgtctccaagacttcgctctgctctcactccttgaacccttaaaggaaaaagctgaatttgaactgtttgcctttgaatcgtggagacataaaaaacacttaggatataggtctagaagaagaagaagagggagaacgcctagatcgaactggcccaggagacctcagactggccaccaatccccctccctcaatcttaaagctacagcaatgtggcaagtggtattagctgttgtggtttttctgttctttctgatcatgttaattctgtttttccgacactccagccccccagggaaagagtttctctgccggtgttggatctgatatctctgctcaagactttgctaaattgtctttaaataataataataataataaacgggaaacacctcctcctggccccgtaagggttggagccctctccagtgtatgctggaaaatttttctcttggtttctcagaggactatggagtccgccttagaaaaggcaaggtctggacactctgtgaactagaatgaccaaagtttggagtcggatggccctgtgaagggtcattaaatcctaccattgttcaagccgtgtgatgggttgttaccggaactcccggccaccctgatcagtttccctatatcgatcaatggctaagtttgattaggaatcctcctccatggctctgttcatgtgccattcgcaattccacctccaaagtcctcctgagccaggccgcgtttttgcctcaaccctccgccagttcggctccccctgttttgcctccctctgaagaagaggagagtcttcctcacccagttccaccgccttaccaccagcctgctcccttggcgccatcccgtgtctcttcgactgcgtcccctgtgggctgtgaccgcccattgccttccgctacgaccgcatgggaggaagcagcccctctactcccactgagagaggcacgagtcccgcggctgatgagcgctcagcccccttcctggtttatgtccctttttctacttctgacttgtataattggaaaacccataatcctcccttctctgaaaagcctcaggctttgacctcactgatggagtccgtgctccggacccatcgacccacctgggatgactgccaacagctccttttaactctgtttacctctgaggagagggagcatatccgaagagaggccagaaagcacttccttgcatcagccggtgggccggaggaggaagactagagacctcctggaggaggaggaagctagagacctcctggaggaggaggaggtctttccctccacctggcctaattggggcccagattcctcaggtggaaggagggctttggacgattttcaccagtatctcctcgcgggtattaaaggagccgcttggaagcccataaacttgtctgagacaactgaagttgtccgggggcctgatgagtcaccaggggtgtttttagaacctctccaggaggcttatcgaattcacacaccttttgacctggcgactcccgagaatagccgtgctcttaatttggcatttgtggctcaggcagccccagatattaggagaaaactccaaaaactggaaggatttactgggatgaatatcagtcagcttttagaaatagcccagaaggtttttgaaaaccgagaatttgaaaaacaaaaacaagcgacacaggcagctgaaaaagctgccgataaagcatataaaagacaagcaaaaatcttggtaacagctatccaagagggcagaaaggaaaggcctgcattccagaaaaatggccaaggaacctcgggttcccaccagaaaagtgaaagaggtgaacaggcccctctaggaaaacaccaatgtgcctattgcaaacagactgggcattggaaaaaggagtgcccgttactgccaaaagaaaaatctgaaaacaaaaaggttctcaccctggccgcaacagaggagcctgatgattgatggggacagggctcccttgctctcggcccccaggagcccatggtaactgctacagtggggggccagcctgtatgtttcctaggagacaccgggggagagcactccgcactggagactcccctggggagtgtctcaaataaaaaaattgctgtacaaggggtaactggagctatacaagaatatcctgtcacacacacctgagaagtaatcttgggacagaaaagagtgacacactctttcctagtagttccagagtgtcctattcctctccttggacgggacctactccataagttacaggcctcaatctccttttcagctcagcaggctcatctcacactaggaaatgcaacttcccccactgcccaactcttgctaactacccctctgtcagaagaataccttctggtttcaccgtcgtaatcaccggaggagaatactaatactcttttgttagatctacagacacttttcccccgagtttcggccgagtcaaaccctcccggactggctaaacaccatccgccagtagtcatagaactcttggccactgccataccggtccaggcaaagcaataccccacaagtcagcaggctagagaggggattaatccccacattcaacgactgttacaagctggcatacttaccccatgccagtcggcctggaacacgccatttttgccggtccagaaacctggaacaaatgattactggccagtacaagacttaagggacgttaataaatggactgttgctgtccacccaaccattcctaatccctatactctactcagcctgctcccaccagaacatacagtatacactgtccttgacctgaaagatgctttctttgctatccctctggcccccaaaatccagccgatttttgctttcaaatggacagatccaagatcaggagacactacccaactgacttggactcagttacctcagggttttaaaaattcccctaccctttttggagaggctcttcagcaagatcttataccttccgagccagtcaccttaactgtactcttctccaatatgtagatgacattttaataacaactgaaactatggatggttgtctacaacacacaagagacctgctctacctccttcaggagctcgggtatggagtctcagccaaaaaggcccagctttgtcttcccagagtgtcctacctggggtacaagataaacaaaggaaaaagggcactcactagtgcccggaaagaagccatcctgcgaatccccactcccgccaccaagagacaggtacatgaattcctaggagccctgggatattgtcgtctttggatatcggggtttgcagagattacaaagcctttgtatactgctacaaaaggtaatggcccactgatttggacagacaccgaggaacaggcttttcagaatctgaaaaaggctttaactgcagcccaggctttagccctcccaaatatctcaaagccttttcatctgtttgtccatgagagccagggagttgctaagagagtgcttactcagactttaggaacttggagaggcccagtggcttatttatctaagaaggtggatcctgtggcctcaggatggccaagttgtttggcagccatagtggctacagcaagcctagtccaagaaactgataaattaactctaggccagaatttaacccttacagttcctcatgctgtagagacttgactacgaagtgcttcaggtaaatggatgtcaaatgctcgtattttacaatatcagagtttactgttggatcagccttgtttgactttctctcccacaaggtgtttaaatcctgctactttactcccagatccagattctaatactcctgtccatgactgtcaggagctgttagaagctaccgaaactggcaggccagatcttcaagatgtgctcctgagaaaggcggacgccaccgtgttcaccgacggcagcagttttctcgaacaggggatacgcaaagctggtgcagctgttaccacagagacagatgtgttgtgggttcaggctttaccggcaagcacctcagcacaaaaagctgaattgattgcccttactcaagctctccgatgggttaaagataaacgtattaacatttatactgacagcaggtatgctttcgctactgtgcatgtacatggagccatctactaagaacgcgggttgctcaggtcagaaggaaaaataattaagaacaaagaggaaattttagccctgcttgaagctgtgtggctccctcaacaagtggctgtaatccattgtaaaggacatcaaaaagaaaacacggctgttgcccgcggtaacccaaaagcggtttcagcagctcgggaagtggcgctgtcttcagctccgtccataaacctgctaccggcagtttcttttccacagccagatctgcctgacaaccccgcgtactcaacagaagaagaaaaactggctgcaaaccttagagcaaataaaaatcaaaaaggttggtggattcttcctgactctagaatcttcgtacccccagctcttggagaaactttagtcagtcacctacattctaccacccatttggtgggacaaaattagctcagctcctccggagctgttttaagatccctcatctacaaagcctaacagatcaagcagttctctggtgcacagcctgcgcccaggtaaatgccaagcaaggtcctaaacccagcccaggtcaccgtctccgaagaaactcgccaggagaaaagtgggaaattgactttacagaggtaaagccacaccgggctgtgtacaagtaccttttagtatcagtagacaccttctccggatggactgaggcatttgctaccaagaacgagacagctaacacagtagttaagttcttactcaatgaaatcatcccctggtacgggttgcctgctgccatagggtctgataatggacctgccttcacctcgtccatagctcaatcagtcagtaaggcattaaacattcagtggaagctccattgtgcctatcaaccccagagctctggacaggtggaatgcatgaaccataccctaaaaaatactcttaccaaattaattctagacaccagtgaaaattgggtaaaactccttcctttagccctacttagagtaaggtgcaccccttatcaggctgggttctcaccttttgaaattatatatgggcgggcaccacctatcttgcctaagctaaaagatgcccattttgcagaaatatcacaagctaatttattacagtacctgcagtctctccaacaggtacaagagatcattctgccacttgtttgagaagcccatcccagtccagttcctgaccagatggggccctgccattcattccagctcagtgacctggtgtttgttaaaaagttccagagagagggcctaactcctgcttggaagggacctcacaccgtcatcctcacgacgccaacagctctgaaggtggacggaattcctgcttggattcatcactcccacatcaaaaaggccaacaaagcccaaacagaaacatgggtccccaagcctggatcaggacccttaaaactacacctaagtcgggtgaaactgttaaattaactctttttatttgcttcttttgtttatccttgcctgtaatgtcttctgtgccttcctactccttccccctcacctctctcacaacaggacgtgttttcgccaatactacttggaaggtggtactccagggcaagtcacctttgcagtcgacttgtgtatactgttcccggagccggctggtacccacgaagatcatcgcgacctgccagtcatgggagcaggaggtgtcgaccttgcagcaggatttggacactctgggagccaagccagatgtggaagctccaaaggtgctgaaaaaggactccaaaaggttgacttttacctctgtcctgaaaatcaccctgatgctagctgttgagatacctaccagttcgtccgcccggattgggcatgtgtaactttagccacttactctgggggatcaactagatctccaactctgtcaataagtcgtgcttctcgtcccaaatcgtgttctaaaaataattgtaaccctcttaacatcattgtccatgaacctaattcagctcaatggtactatggtatgtcatggggattaagactttatgtcccagggttcgatgttggaactatgttcaccatccaaaagaaaattttggtcccctggagcccacccaagccaatcggacctttaactgatctaggtgaccctatgttccaaaatcaccctgacaaagttaatttaactgtgcccccaccattctcagttcctaagacccagctacaaagacatcaactccaacccagtctgatgtctatacttggtggagtacatcattttcttaacctcagccagcctacactagcccaagattgttggctatgtttaaaagcaaaacccccatattatataggattaggagtagaagtcgcacttaaaggtagtcctttatcctgtcatgcacaacctcatgctttcacattaggagatgtgtctggaagtgcttcttgtctaattagtactggatatgacttatctatttctccttttcaggctatctgtaatcagtctctgcttactcccatgagcatctcagtctcttaccaagcacctaacaatacctggttggcctgcacctcaggtctcactcgctgccttaatggaactaaatcagaacccctcttgtgtgttctagttcatgtccttccccaggtatacgagtacagtggatcagaaggacaactcctcattgctcccccggaattacatcccaggctacgcagagctgccccactactggtttctcttttagccggtcttagcatagctgggtcagcagctattagtacagctgccctagttcgaggagaaactggactaatgtctttgtcccaacaggtagatgctgatttaaataatcttcagtctgccatagatatactacattcccaggtagagtctctagctgaagtagtacttcaaaactgccgaggcttagatctgctgttcctctctcaaggaggattatgcgcagctctaggagaaagctgttgcttttacgccaatcaatctggagtcataaaagatacactccaaaaagttcaaaaaaatctagataggagccaacaagaacgagaaaataacacagcctggtatcaaagcatgttcaattggaacccctggttaactactttaatcactggtttagctggacccatcatcatcatattattgagtttaatttttggcccttgtatattaaattggttccttgattttgtaaaacaacgtattgcgtctgtcaaacttatgtatctaagaactcaatataacccccttgttgtaactgaagaatcaacgacttgattcccctaaaacacaagtggggaaatgaaatgcctaacggtgtttttactttaactcgttactttgaattttgtcctgcttgtctctttaatcacctaaccttgcttctcatgtaaataagactctctctagctaggaaagccagacaaactccaattgaccccttagtttacaagacactaagggctcctcacccaaccccctttcgtgaggagttggcctgggtaaacagatcctcagcatttcaaaggagcccaattaactgataaggtacccacaccaacaatgtatgaagttcccaggaattttctccaagagataacaacatgaaaccttgagtttgtgtccggcatagaccctatatctaattataataaaagatttagaaccttgcacctggtaccgttgctcttcttgtaaccatttgtcttttaagttgtttatcactctgtaactattttgattattttgattcttgcatgtttttacttctgtaaaattattacatttgagtccctctccccttcctaaacctaggtataaaatttactcgagccccttcctcgtggccgagagaattttgagcatgagctgtctctttggcagccggcttaataaaggactcttaattcgtctcaaagtgtggcgttttcttaactcacctgggtacaacagtgcagctggtggagtctgggggaggcttggtagagcctggggggtccctgagactctcctgtgcagcctctggattcaccttcagtaacagtgacatgaactgggtccgccaggctccaggaaaggggctggagtgggtatcgggtgttagttggaatggcagtaggacgcactatgcagactctgtgaagggccgattcatcatctccagagacaattccaggaacttcctgtatcagcaaatgaacagcctgaggcccgaggacatggctgtgtattactgtgtgagaaacactgtgagaggacggaagtgtgagcccagacacaaacctcctgcaggaacgttgggggaaatcagctgcagggggcgctcaagacccactcatcagagtcaaccccagagcaggtgcacatggaggctggggtttgtttcctgtcaggatttgggacttcctctgcttctgacagtttctctagggaaactctttaattttagatttctgtgcccaccaatgtcatctctacatttttttaatcattgtaatatgataggaggacttattctcacatgcacaatatgtatattgccacctacgggaatgaaaactcctcaaccatggtcaccagcatcagagtcgtgaggaagctcaggggtgcctggtgagtcttctccagtcagactcaggacagtaacctcaaggggattcccttgtgagaactcacacactttcatgagaacagcaccaggagttggttctaaaccattcatgaaagacccactccatgacccagtcacctcccaccaggtcaccccttcacaattgaggattataatacaacatgagatttggggcaggacacaaatccaaaccatatcagatacacattgtgaaatgctcatgatggtcagggtaatttgtatttctatcacctcacagcgctaccattttattatttttttaaattaaatgcatgagtgagtgtctgatgagaacacctcagatataccctttcagcaacaatcatttttataatacagtattaactataggaccattgctgtacgttagatctccagaactcatccaacctgcacaactgaaactgtacaatttaacaaacatcacccgatttccctctcctcccaggtcctgagaccctctattctgctctctactttcaagagcttgaatattttagatcccacatgtaaatgagatcatgcagcatttgtctttctgcatctggcttattccactcagcatcatgtcctccaggcccatccgtgttgttgcaaatgtcagaatttccctcttttcaaagccaaataaaatacagatttatgtatacacattttctttatacattcatccatttacagtcattaaattattttgcaaatctacactattattaataatcttcaatgaacacgtctttggcaaagtaattttatttcctttgcatatataataagaaatgggatcaccagattatatgatagctttattttcaacttatcgagtaaccaatcctaccacagtgtattccctttccctcacattcttgccaatatttgtcatctattacatttctgataataaccatattaactagtgtgaggtgatatcgcattgtgcttttcatttgaattcctctgataattaggaatgttgagaaccttttcgttttctgtttgccatgcatgtatcttctgaaaaaagttatccaggtttttgcccttttttatcagttcatttgttatttgctattgaggtatatgggttatttatacatttagatagaccttcttgtcggatacataattacacatagtttttcctgtgctttgttgttaaattcaaagaaatcagttccgaattaatggcaggaattttttttgctccatgtgatttatgagtttatggcttcaggtattatgtccaatattagctgatttttttatatggagttagagaaggcctaattttatttcttttgaatatgaatgccagttttacaccattattgaaaagactgtcctttctctactgtgtgctcttggcacacaaaatcaggagagacataatgacaaaagaaaatatcagatgaatattcctgatgaacatagacctgaaagtcctcaacaaaatactatcaaatagaatccagaagcactttaaaatgtaatacatcatggtcaagtgggctttacccctgggatgcaaggctcgttcaatatccacagtaactgtgattcacaatgtaaacagaataaaagcaaaaaccatatgattatgtcaatagatactgagaaagcctctggtaggttctaacatccactcatgataaaaaccctcaacagactagacatcaaagaaacgtacctcagaataatagccatctacagcaaacccacagtcaacaccatactaaatgagccaattaaaacacttgtctttataaattacccagtctgaggagtttctttatagtgtgagaattgactaatacagcatccaaataggaaaggaagtcaatccgtccaccttcagcgatgatataattctatacctagaaaatcctaaaaagtctgccaaaataattctagaataaacaactttagtaaagtgtcaggatacaaaatcaatggacaaaaattaccagcatttctataagccaaccacatccaagctgagagtataatcaagaacaaaatcctatccaacttacagtatccacagagaaaatgaaatgcctgggaacacagataacaaacaaggtgaaagatcactacgaggagaactataaagcacagcagaaataaataataaatgatacaaataaatgggaaacatttcatgctcatggattggaagaatcaatattgtaaacattgtcataatgcccaaaggaattcacagattcaatgctatttacataaaactatcatcatcattcttcacagaatcagaaaaaaatctattctaaaatttatatggaaccaaaaaagaccctgaatagcagaagcaatcctaagcaaaaagaacaatgccagaggcatcatgatactgaccttaaactacaccataatgtcttgctaacaaaagcagcttggactggtacgatagcagacctgcagaaaaaaaaaaatagatcaaaattgaaaacagaaataaagttgcacacctgcaaccttttgatctttgacaaggctgacaaaagcaattggaaaaaaaaaatctctgtattcagtaaatggttctgggataactggattctggcaggtcttgcagaatgcaagagtgaaggagcctgtccagcttctacctagatttcagatgttagagagccctgcatgcccaggaagaagcctgctgcagcagtggatccaccacacaaagcctctactagagcattgccaaagatggggaaagatggagttggagcccccattcagagtccccactaggacgcttcatagtaaagctgtgggaatgtggccacaaccctcaagaccctagaatggtagagctacaggcaacttgcaccctcagcctagaaaagcttccagcacttgactctcacttgtgaaggcagccccgtggtctgtgcctagcaaacctatagggattggctgcctgaggttttggggacccaccccttgttccagtgtgccctggttgaagtacataaagtcaagagagattattttgtagtgttaggatttaatatctgcagtgctgggttttatatgtgtgtgaggcctgttggttgttccactggccaatttatccctttaggattggaattatttacccaatgcctgcaccatcattgcaccttggaagtaaacaactttcatttttaaacttgcaagctcacagctggagggacattgccttaagactcagatgagactttggacattttagttggaggttgatcaacttaacattttgggaactattgaaaaaaggtgattatattttgcagtgtaagaagaatatgagaactttgggtctgagagtgcaatgatatcatttaggggttttcccctccaaatgtcatggtgaaatgtgacccacaatgttggaggtggggccaactgggtggttttgggtcatgaggagatttttcaggactggcttggcatccaccccatggtaattagtgaattcttgctgtattagctactgtgagattttattgttcaaaaaagtctggcaaccctcctaccctctcatgtcccccctcctcaccatatgacacagcctcctccccctttgccttccaccatgactgtaagcttcctgaggccctcgcaagaagcagatgcttgtgccatgcttctcacacagcctgcagatctgtaagccaaataagcctcttgtctttgtaaatcacttggcctcaggtattaatctataccaatgtaaaatagactaatacactgcccaaagcaatatacagagtccatgcaatttatatcaagtaactaatataattgattacatatttttaaaaatcctaaaattcatatagaaccaaaaaagggtctgaaaagcaaaagcaatcttgagcaaaaagaacaaagctggaagtaccgcattccctgacttcaaattacacaacacaaagataacaagaaaggcagcgtggtaatggtagaaaaaaaatcaagagcccagacatacagccaaatatctacaaccaacggttctttgacaaaactgacaaaaatatacactggagaaacaaccctctattcaataagtagtgctgggagaattagatagccttatgcagaagaataaaatgagacttctgtatcatcatagacacaaattaactgtgaatatggattcaatgtttaaatttataaactcataaaaattcctgaagaaaatctaaaaaaaatcctctagacatttgcctaagcaaataaaatatgactaagactgacttcaaaagcaaatgcaatgaaaacaaaattagacaaacaggattaattgaaacacagattgtctgcatagcaaaagaaataaccaacatggtgaacagacaacctgtgaacagtaaaaaaaaatttgcaatctattcatcaaagggctaatacatagaatctacaaggaactcaaataagtcaacaagaaataacaaataacttcattaaagagtgagcaaaaaccagacatttctcaaaagaagacacagacgtggccaaaacaaataaaacatactcagcatcaccaatcatctgataaatgtaaattacaaacaacatgatatagcatcttccaccagtcacaatggctgttattacaaataaaaaacagcaggtgtttggagagaagcataggaaaaataatgctttttatatgcttggtgaaaatataaattagtacaacctctatgaaaaacaatacagaagtttctcaaagaactaatattagaattaccgtttgtcccagtaatccctcccagtgggtatattcctcccaaaaggaaatttttatatcagaaaaagtcacctgcattcctagtgtctttcacagcaacgtgaatagagttgtaggacattagcctaaataaaataactcaaaaagatcttctcttttataattggaaagtaaacaatgggtacacatgtacatacataaaaaacaaaagacactgggaactgcaaaagagggcaaggtgagaggaatgtgagggttaaaaaatcacctactggctccaatgttcactagtgggcgatagttacaccagaagcccaaacctcacctttatgaaatatattcatgttacaaaattgcacatgtacaccctgattctactgaaaaaaacagaaataaaacatgaacagaattgttagactgctagctagatttgtcaacaaagaaaaatgcaaaaggagcaattctctgttttggaaccctttctcattttctggtacaattagaaattgtagactaatccctatattctcttctgaagccctagcattagccatttctcaaagacatgctggttccttttttttttttttttttttttgagacagggtccagactcactgcaacttccacctcctgggttcaagcgattctcctgtctcagcctcccaagtagctgggattacaggcatgcgccactgtgcctggctaatttttgtatttttagtagagacagggtttcgctatgtgggccaggctggtccaaactcctgacctcaaaagatctgcccacctcagcctcctaaagtgctggaattacaggtgttagccactgcacctggtcactggtttcttttatagaagaatagtattaaaaactcaaatcttgattctgggtgtattttttattaatgtgcactcatttcttgtagaaattctcaggtaaaaaatctaggaagtatgtgttgtgtattaacccatatatacacagacatctaaactatttttatctaatatatgtacctatattatgctaaacttgcaaataaaatgacatgtccaccctaagttaataccacatggatgtttatcgcattccttctatgcctgacactaacctcccactccaaccacaaggaaccccatttccccatacgccgtccattctctttgtagtccaattccaagattcctgtggagtgtaacaagatgtgtaagttgtgctcttttgtggaacatcgtcaattggggtacaatgctgatgtgaagtttcttttttctttaatcttattgcctacaccatttctgaatctacttagtacctcttttgaattcatacatttgtaatggaattagacattttctatgttatctgcattccatcctggaattcctaatcacctatttttaaaaaaaattcttttgaagtaagattgtattagtcagggttccctagaggggcagaacaaacaggatatatatacgcacacaggatacacacacacacacacacacacacacacacacacacacacagagtttattaaggagtattaactcgtatgatcacaaggtcccacaataggccatttgcaagccgaggagcatggaagccagtccgagtcccaaagctgaagaacttggagtcccatgttcgagacaaggaagcatccagcacgggagaaagatgtaggctggaaggctaagccagtctaatcgtttcatgttcttctgttgttgttgtttttttttccctctggccacactggcagctaatgagattgtaccacccagattaagagtgtgtctccctttttgagcccactggctcaaaagttaatctcctttggcaacaccctcacagacccacccgggatcaatactttgcacccttcaatctaatcaagttgacactcagtatttagcattacaagtccaccccgtcaacttgaaaccatacacatctcctgagattatacataatcttcaaacaaagacaataataaagtcataattacacctaatataatacaactttattcgttcaactggaaatgcaccaatccccaatccaaatgctattacatatggtccactccctcaaggacacagccaggatcatcctatgacttggtgtctagaagactcatgcacttttaattttacctccaatattagactccactttatcacatgcagacactgcagaatattttaagacatcgatgtcttatgctgaaaaattcaacagtacataaaattgccttcccaccacagccagtggttactactgaataaggatctgccatcccctagggaggtgctatagtggatggtgtgcactgttagtagctatggaaattgatccattgtggcaaatggcagcatctttcttttataacattaaaccatattatattgtatacacataccacattgtctttattcatttgtctgtatgctgaccatcagatagtttccatatcttcgctgttattaacagtgtttcaataaacataggatgcagatatgtttacaaggtggtaatttcatctacttgggtatactcccagaaacaggatttctggtcatataatatctccagttttaattaatttaggacgctttatgttgctttccataattgtggaaatgtagaatggtatagccattatgaaaaacaattttggttttgagttatgatccataaacagcatttgcttatggctctcaatgagagtttctactaaatatgatggaaggccaggaaggattctcaccttaaagcttggatggattatgaatttacctcttatttcctaaaagcaaaagtttggaagcatacatgatggaggctgttggcaggtttcaggatgatctcataaaaggagaatctgctggataaaaatgttgggttttcagttatagacacacctacactcaatatgaaatgatgaagtcaactgaggatctagaacatgttcacttgaagcaacagcacattctcaaaggaacttattgctccatcacaagggcgatgaacttctgaaaccagtaaagtgtgagtgcacagtaagtgataacgttatcacgtttacatgaagtttgtttaatgtgccaaaggctggtacagattaatcttacacaaatatatgaaacatatttttccatacatagatatctagaggataatcctcttagcaaaacttcttcaggttacagaaatctgtgtaagttgtagatctcatggggaactgtctctttataaatactggtctgtttttcaagtcaggaaaaattatctctgttggagtaggcttccaattgtgtagacttctgaattgcttcttgagttgtaacaaatgaaccaaaaaatttgactaattggagttttgtggctgtcttaataaaaatttcttataagctttctttcaattatttgagaccagttttcctgattttatttttctccaatagataaattttcacaagatctcaggaaaccacctctctggctctttagtttaaaagactagcttcttaggaaaagaagcttctttctaacattgaagagctcatttattctgcaaaccatgaagtttgagtctcattgtcaagaatcatgaaaatttttactccaatatactgaaagtcatgactcttgaattcaatatttattggcattcacaaaagtgattcattctcagatgtgtcctatgttgctggcccaacatatcagtgaactgagtatcctcccttagctctctctgtctgtagcactgagtctacaatcttcagagtcatccatgaaggggagtcctgaggttcatgggattcttgtaaacattcaggtcaacagaagaaataagcaggattgagggctgccagccatttccacgccattaggaataattaccatctaagtataaaggtctacatcatacagaataccccacaggataggctgatgcaaaaaattccaaccccacagaggctccacagcaacccttacagttctttcagggaaggaataatctccaagttaaatgagtcagtaaagctgctctgagctacaggaaaaattggatttggccaggtttgtctgagttcaacgtgattattatactcagctcctgctccaatctggactgagtacggggaatttaaatgagcctggctgtgtggtttgttatatgaaaatctgaactatataaacataaatggcatgtctggactagcatgagggtgagagatcctgggaactccaccccccatactcttatcgccctttcctccaggaacctccaggttctcagggtgagaatccacatagatcccttcatggctctatttctaggaaaccaaatctctaataaatacacccagactttcttcagacacagaaaccatgggaaaggcatctctagatcctcatctatgtggggaaaggtaatccatccccattacaagcccatactagcaggcttcctttatcatgaaaatgggtaaaattagccaatagatgtaaatttaaagaaaatttcctgtgatgctccagccagaaaagagcaaaaatcagcttcacttctggagacttcccgtataggtcacagcccagagaaagaagatcaccacagcattaaaattcagctgtaagaacatgtaatgcttccgtgttccacacattatgtctcaccagtttagtcaatatggattaaatacgagagtgtggcaatgcacaaactctatctgaggaggaaataggagaaaaatgttaaggaaaatagaagaattcgacgcctctaataccaggaacttcagcacaaagaaaatgatttcacccttattggcctcaaatttatttttcctgtggcatctgcagggttccaaagtgagaaaaattaattcactgtgcatgcacttccgaagtgtccacttgcattctgatatctttacttctatttgcagaaagtagacacatattcagccttagtgccagtgtagggagtgctttccgtgacatggataccagaaaaatagggtaaacatagggcccattaatgtgaaaatcagacattgtgtgtgtgtgtttgtgtgtgtgtgcgtgtgagttgaatagtagagttggagtgggcttctatccacctacacctgcaggtattctcaggtgccataatcaactgcaggaccctaaaggaaataagagtccccccaaacccctgaagagtttttgggttcaccgtgtgtccaatgattcagtgcctcttgagctctaggaaagggctccccagtgatgcatgagatctttcttggggtctccctgcagagttcactgggattcctaaggccaattcagtatttcaaaagatggtgtgagaagcacaggctgtcactaaaggagaattctgagccagggcacagccactttatacttggctggggacactggtaggaatatactctgtgagatcagacaggaacctccttgcaggggcagggcagggctgcagggggcgctcaggacacacagagcacaggcttccgccccagagcaggtgaaggaggctggggaggggttcctctcagggcctgggacttcctttaaaaaatctaaaataagtatttcacaaggactgccgatgtttatataaatatcctattcaattgtgagcatttatgaaactcgatgttgtaatgagaaccacttttacaattggaatttcaaacttccctagacatcttaatagtaagcagctggaggtcaggaggagatcctttcttataaataagtgcaattttgggagaaacacactcattcccaaaatagcacattcacatattaaggtctagaaatgattcgagttgcccctgagacagtcaaatgtgggttctaagtgaggtgcgtgtcctgggggagcttgttctccagtgggggaagctctgtcaacacagagttcagggatgggtaggggatgcgtggcctctaacaggattacggcttgaaccctcagcttctacaattgtgtcgtccatgtgtcatgtatttgctctttctcatcctgggtcaggaattgggctattaaatagcatccttcatgaatatgcaaataactgaggtgaatatagatatctgtgtgccctgagagcatcacccaaaaaccacacccctccttgggagaatcccctagatcacagctcctcaccatggactggacctggagcatccttttcttggtggcagcagcaacaggtaacggactccccagtcccagggctgagagagaaaccaggccagtcatgtgagacttcacccactcctgtgtcctctccacaggtgcccactcccaggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagacacagtgtgaaaacccacatcctgagggtttcagaaaccccagggaggaggcagctgcactgaatttgaggagattacagggcttacaatgtttaaagttgtttagaaaatgagctgagcaattgaggaatgtgagtaatggaaacatggatgcactctatataggaaatgtttctttcaacagtcaccctatatgcaaaattcagaatggtaaaggcagcaatcagtgaggctgacgcaaatattcccatggaggccttgtgcagacataccgtttttaaaatcagatagataaataatttggaacaagattgctggtaacgtggctaagactaaatatgattcctaaaaactggccaaaatctattccaaattgtctctgccactccttttacataaatgtattaaaaagtagttttaagaccacagcaaaattggacagaaggtgcagagagttctcatgtgcccctgcttcaccatgcacaggctttcccactgtcaccatcctgccccagagtcatcaataagttacaatggatgaacttacatgggcggattggttctttcctcttctggtggtctcttggcataccaagcccaaattatcttgaagcaccataggttctactgtaatgcctaaccttgttttttactctagtttgctactttaaattttccctttttttgtctccttaattgccagccatgtttcccatatgaatagactctccctggctgggaaagctgggcaaactccatttgaccttttgatttataagacattaagggctccttacccaaccctcttcttcaaggaattaacctgtgtaagcagatcctcagcatttcaaaggagcccaattaactgataaggtactggaacaaacaatgtatgaagttcccaggatttttctcaaagagataacaacataaagccttgagttcatgcccagcatagcatcatatctaactataatgaaggatttagagccctgcacctggtaacgttgctttttgtaaccatttgtcttttaaattgtttatctctctgtaaccatttgcttcttttgattcttgcatgtttttacttctgtagaattattgtatttgagttcccctccccttcctaaaccaagatataaaagttaatcaagccccttcctcggggccgagagaattttgagcgttagccatctcttcggcagccggcttaaataaaggactcttaatttgtctcaaagtgtggcgttttctctaactcgtttgggtataacactacaagtgggttcctgggaatgatgccagttcagaggaaaagtgggtggggctattcatatttgggctcttttttagaagattcataaaacagatattttcctatacgttctgtgactcctgatttactatcccttcccagagggtaaggtccctaagtgttttgcggtatatccatgtctatggaaagaaagcaagttctggtgaatcccgtaaggaatgtcctttgatgagaagtggagaccttggtcatgaggcacatcatgtatgattttctataattccgttagattcactgtaattttggggggtgtcctgtggaatgggtcttctgtgtccctgcatgttcagctatatctgtgtggtgccacttacacttaatgagatgagattcctgctgcttgtatcaggtcactggtgatctctgaagctgcttctggtttctgctttaatatgtaaagagcatgtcaaacatcacccacattcttacaataataaaagcctggaaaattgattatcaataatttcttgaatctgttgaagaaatgaaattgcagggaaaaccaggacccccaaaactagaaagacattaaaatagagataatcagactgatggatcaaagttctgtggcaataagataccaaattataaacaaggcctaaagtcatggattaagtcactcacccctacacttaaaaaaatgactgtactgtaacttccacagggcttttttgttttctgtagcacctaaacaagcactggttctgaggtaagcatattaaaacatttgcagctcatggaactccaaacgtggtaactgaccctctcccacaagccataaatagagctttgtttggacaagagacagatttcagtaactgtcttctgagaagagactactgaccatgaacttgtcctggcaatttacagagactgtgcagtgtgtgtctttctgcctctgcacaaagcccttttgatgaacagggcccgattgtcattcatttagttcttaagtcctcatccccaaagcaaacactaaatgcatgtaacatgtgtgtttgcttattagacatgagagcctgcccactatgtgaacatcaacaagatccttctatagcctgctgagtgtgtacacttggccaatccatttgcatgaattcatttctcctctttccctctcttgaagtgcctgctcactgtctctgtgggaggctttgcttcccagcctgttaaggtggctgtcctgcagctttaaccatttctcagaagtaaagtctcctttctaaatttataaattatgtgactgttccgttgaaagtgcaagctggtgggaacagttacatggtaattcggtaaattgctggtggacaggtgtggacagggatagggtaagaactcctgggggctgcacaccccacacttcgatggaatttccctccagaaacttctgggttctcaggatgataatccaaacagattccttcatggctctgtcatcaggagagctactctcttgataaatatgctcagaacttcctccagacaagatcctacagagaaaaaatgcttttcaagatcctctattctatgtgaggggaaggtattcttttccatcccaggcagtttcatcttagccttcctgtgtcataaaaaggtcaggttcaagacaataatatgtggatgctgcagccaggaggggggagtagaagacggaggaaaatcagctgcaccactggagactccttgtaaagggcacagtctagagaaaaaacatcaagaaaacattgaaatcaatttccagtacatatactgctcccctgcccaccacatcacctcttcaccagtatgatcaatctggattaaagagaaaagtgtggcaatgcacagactctgtccaaggactagaccttagggaaaccaaaggcagagggagaggaaaagttaaggacagtgaagcggtttaaagcctctgagaccaacagcttcaggaccaaggccacggcccctctgtcaatggccttagatttacctctcacggggcatccacagggttcccaggtgagaacaggcaaaaacaaggtgaagacactttccaaatctccagcagtactgagcttgctttagctctgtttgaagaaacaaaacaacaacaacaaacaacaacaaccgcaaatataaccaggattaaggtcagtgttggaagcacttttattaatttttttaaattttttatttctcagatggggtcttgctctgtctcccaggctggagtgcagtggtgcggtctcggctctgcaacctccacctcctggggtcaagcaatcctccaccctagcctcccaagtagctgggattacaggtgcatgccacggcgcccagttaatttttgtattttttagtagagacagtgtttttccatgttggtcaggctggtctcgaactcctgacctcaggtgatccgcccaaattgccctcccagagtcctgggattacaagttaattgagttaataaagctgttctgaactatgaaaaacattagtttgctcccagattttcttgatttcagtttgattattatattcagctgctgccctaatatgtttgagcatgttactatttaaatgaccctggctgtttgatttgttatatataaatctaaactaaaacaacttaaaggacaggtttgtactattattaggatgagatattctgggtgcccctcatttgctccatgaacctccacatttttaatttagaattcacataaattccttgtgagttgtgtcagtcatcgagagacctaatctctaacacctttacccagaaccttctccagatagaccacccacaggaagaacatttatagtaatttatctacatggtggaaggtacttcactgccattgtagaaccctcttcccagccttcctttatgaggcaaatgattgccagtatggtaagattgaacaaaaggatgtgccagtagggtaagattgagcaaaaatagtcctgagatcctgcagacagggaaggacgtaatagacaaatatcagctttattagaggagactccttgtaaaggtcatagccaagaaaaagaagacaaaatcactgagattaaattctaagaatcttggtccagttcaatcaagccatcaacagccaggtggcttcagtggccactatgcatattaccccatgcctaaatgttctggcttgtacaaagagcttctctgtaaattgcacattgccatagtggaagatggcatgggagattttgtgacaaacacttaaggtgcaataatagctatttttcctttatcatgacaatatgtggcatgcttctagattcatttcatgccaaagaagttcctcagaagggtaaggaaatggagaatcttacacggtccaatgcagtccccaagaagggactttgaatggacagttacactggttactacgatgtgtctctgaccttctcaggatcgaagatagtcatgagtatcaaggtggagatggtctaggtgagagaaaggaagtagtgttcttagaagatggtatgccaagataagcctgactatctctcctcttccagttcctgcaacttcatattgcctgattgagtcacttgcctatggtggtaatgacatcagcaatgcaataaattctctggtggctttatatctggtttataacatgggagatgtttcctcaagagtggtgatgccagtgtggcttctgctctctggtggtgttggaatctgcattagtctgtgggtttggaggaaggagattcagccatggggaagaatctgacactctcacaccctctgtgccttcggtactggactgctcctgccctcactatggtgattgcatcagatattgcctccccaccagacaacacgttaacatggctccttgtacctggctttaaccaagaaagttgtcgacttgactcttcgtgacattgtatagcctggtttgtcacaatctttatttcgggaattatcagtgctgccatcttggctgtcttcaagtatgtcatcctcacagtgtgaagctgtttgacattaacatttttgtcaatgtttgggactaccttacatattccggctcagttcaaaatgagctatgtaatgtagccaggtttccactgagttccactttgcttcttggctgtctattcctgcgcaagtttctatgtattttgtatcaggcttcaattccattatgtttaaaatgttgtctctaaagataaacaaagatttttttaaaacaaccaaacatgcagccatttgaccgagtgtggtctgcattgttagtctcaccatcttctgccctaacaagcaccgaatctaacaacacaaatatcatggaagctttccttggagtagctcctgtaattagaatcattgtattctgccctcctgtcagtggtggaacgttctattggcacatgtggaaacctcttagagggacgagtttctttgaacacaataaaattttaagttaggaataacttatttgaaagcaattcattgaaggttattgctaagaagttagaaacagtcttttggcagtcatttcttcaagatgtatggcagtgtgggagggatatataaagtggaataggaacttgggctagttaaatggaatagcctccaatgttaatctgtttaccttttaactgaatgaaaaagcctatagttgtaagaaaagaaaaaaaacacaatcctcacacattcccttcccatcagcattgaagatgagtgtggcaatgcagagactctatatagggaggagaacatagggaaatgcaaagacaatgggagaaaaaagtcaaggacagtagagcaactggaagcttctgacaccaacagcttgatgaacagggtcactcaacccttggtggacacagagtcacttctcttagggaaactgcagtattctcaggtgacaatatgcaaacatgatgaatgtacacttgctacgtctccagttgtgtactgttttccttacttctgtttggagaaggaagtcatatactcaggtctagtatccgtgtagagggtgctcaccatttgcaagatactaggaaaaatggcaagttagaggcccactgttgtaaaaatcaaccagttctgtgtgtgtgtgtgtgtgtgtgtgtgtgtgtgtgtgttatagaaaaagaagacatggagtgggcattgatccacaagtatatatacctacaggtattcttagatgtaatattcaattgcaggagaccaaacaagataaagcatcccccaaaacccttgaaaatttttgtgctcactatgtgtccactgattaaatgtatcctgagctccagggaagggctccccgatggtttcttagagttcactgggtctcctaaggtcaatgttttcaaaagatggtgtcagtaacatatggtgtcactgaaggagcattttaaactagggcatgacctcttcctatagccctagagacactgagagagaaatcctctgtgagcccagatggaaacctccatgcagggcagaggcagtgctgcagggggcgcccaggacccacccagaacaggctccagccccagagctggtgcacaggaggctgcagaggggatttctcccagaattgagtgttgttttattgaaaaccaaaaaattataacatgttaaaattagaattttgcaaagactatttctattatctctatacatttagaaataaacaaatcaacaattcagtgagaaccacatttaaaaggcaaaattgttacttgtttgagatattttcctagtaaaaagatgaagaacagggatggttttattaaatcaaaaggtacacatttcagaagacgcagagatcccaagagtaagactgcagacagcaaagcctagaaagggcggaggctgtccatgtgccatgtcctgtgtgagtcaccttcttagtggagaagttctcccttcacaaagttttgggcatataaagggaaacacgacattaaataagaacgaggacttgtacctcagcatcccacagttgtgtggttcatgtgagatctattttctctttctcatgctggatcaagggtaaggctatgaagtagtagttctcgtgaatatgcaaatcacctgaggtgaacactacagatatgtctgtgccctgagagcatcacccaataaccacacaccacaaagacactcgctgagaagagcaaccctaagacacataattgtcagattcaccaaggttgaaatgaaggaaaaagttttaagggcaaccagagttgtgccatggcacagtgttgtgccatgtcctttctctgttttcttgcctgtttatttatgtcagatgtgccacctacatggaataaggtcagaattctgcctccagtaacacatcaaaggtgacctttgattgtacttttggtttatgctccaaaatattgattataaaattcatcaccgtcatattttatgtcaaaataaatctgcataatctgaatgtcagtacattttggaatctattaaataactgaaattgcaagaaatattacccactccaaaaactggagagatgggcatgtccagaatggcagttagcacttgcttacctggtgcagaaactgcagaagccacaagctgttgagggcacttacatggtaaccactacggacgtctgaaagacaaatgtggactcggtaaatgtgaccgttccagagggtcttatacttctaaggtttctggactttctctccagaaacctccagattctaaaatatacaatccaaataaatttccgatgggtcagaattgaagatgaaatgaagatgattaattacagagaaatataccaggagcccacttcaaaagcttctaaagggaatgacttttccagaaccttatcctatgtgaaggaagacaaatctcccattccagattctcccccattcttccattattatatgaatgagtaaagttagccaaaaggggtaagacgtacataaatagtccaaggaggccgaaacctcaaaagggagtaacagccaaaaatgagcttttcccctggagatgctttgtcaaggtcacagcccagaagaggaagcctattgaatctctaggtttccattggaagaacaggcagtgcttacctgcactgcacaatccattctaactaggatgatggctatggattaaagatgaaagtgtggcaatgcacagactccatctgaggagaacacagaaatactaagacaatggcagagggtgagacaaagacagtagagcaatgtgaagcctctgacatcgtgatttttaagaccaacatcttgtaaatgccatcatagttctcagcttcttttattatgggacctttgctggtttcctagctgagaaagtgaaaataacaacctgcatggacttcccaagtctccacctgtatcctgtttgctttagatctctaggagaagaaagtcagataactgggcctggtgtcagtgtaggaggcacttcctaaaagccacatattaggagaagggaaaatgtgtgttattggaatagtggatatggagtgggctttcatttgaatgtatctgcacctgctagtattctcagatgcaacattcaactgcaagagcccagtgaagaaacatggcactcgcaaatctcttgtaagtttttgtcttcattttggttccactaatgaagtgaatctggagcttcagggaaggggctccctcctgtgtcattgaatccttgctctgggtctccctgcagagttcaataggtttagtaaggctaatcaattgtttcaagagatggtgtcagcagcatatggtgtcactgaaggagtattctacactagcacacagccatttcatgctgggctagagaagcctgggggaaatgatttgaagtctcagcaaggaacctccttgcaaggcaggggctgggctgtcgggggcaccgagcaggtgagtcagaaatcaatatgtaaagatgaggacctatggatatgaattgaaaatatataaatacttcaaaaaattccagtaaattgagtccaaaattaaccccaaattattcaaaacacaaattccttgacaattattttgggagcagtgagttcataaagaattcaaaactactgtttcagcttctgattcttattgttcctgagatgagaaaatcatctctaatcacacatcacacagcaaatctgtaaacaagagtgtttctatggaagatcctgggggatctgaacaccaggcaggtgctggagaccctgtttcaggagcgcccagcagatctcagagggacctgctggtcactcacgtgggacatcagcagtaactttctcagtcaccagtcagctgtgctggtgactgatggacccaggacagaaccaaggcacctcctcagtgtcatggagagtgatggttccagaaatcatccaggtgctctctgtgcttataaaatgtaggttcactgtgaggagcatgttctgagggggattgttctgtgaaaggacctctgttcatgagtgttcataaatggagcagggcatgcatttcctcaaacaggaatagcgcttggaccatcagcatctcactcttgtaaatctgatgtgtcatttatcttccctttcttattattgaccaggctttgcgctatgaaatgctctgtctcatgaatatgcaaataacctgagatccactgaggtaaatttggatgtctgtgccctgagagcatcacccaacaaccacatccctcctctatagaagcccctgagagcacagctcctcaccatggactgtacctgggggatcctcttcttggtggcagctgccacaggtaaggggctcccaagtcctagtgatgaggaggggattgagtccagtcaagggggcttttatcatctcctcccttctcctcacagatgtccattcccaggttcagctgttgcagcctggggctgaggtgaagaagcctgcgtcctcagtgaaggtctcctgccaggcttccagatacaccttcaccaaatactttacacagtgggtgcgacagggccctggacaagggcatagtggttgggatgcatcaacccttacaatgataacacacactacgcacagaagttccggggcagagtcaccattaccagtgacaggtccgtgagcacagcctacatggagctgagcagcctgagatctgaagacatggtcgtgtattcctgtgtgagagacacagtgcgaaaacccacatcctgagagtgtcagaaaccccaggaaggaggcacctgtgctgacacagaggagatgacaaagattattagattaaagattttcttagaaaatgacactaagtcattaaagaaaaggaacaatattaatgtgtatttgagaaattttaattatttgagagatttttcatacagcatttattctgtaaacaaatttcaatgattacagaatgaatcaaattaatgaaactaatacagaacttcctctgaaggtatctttgtaaacattaatttcttaatcagtgctgtaagtattttggaacacagacacaaaatcacattttaagtctgcatttatgtctattaaaaatgccaaaaaaatctccttttgtgcatgtagcattttgaattcccaccatcaatgcatgatagttcttggttttccacattcatattgtcatgtatccttatgagaattgtgtgttttaaccaatctagtaggtgagtaatgggatctaatttttatttaaatgcacatgtccctccaaaagttcatatttaacaattttcctataacttctgttgagacgcctctcctgacattcggttcattttaactgcattgcttcatttcgattcattgcaagttgacttgcatattgtttataaaagtcatttcacaaattaaaagaattcatttcacaaatatgtgacttggaagtattttctccaagtctgtggctgtctttattcccttatcagtgtgtattgcagaaacatatgtgtgtgtatgtgtctgtgtgtgtatgtgtctgtttgtacgaatttagactcaaaaacatgtaaaattgcattcattcatagatgatgtatttggcaatatatatgaagtctcattataaaatacactaatagtgattattttttccatgtctctcaactcaggccacaatcaactcatgagtgtttaaacttcatctacttgattggaggactatccatttcagatatttggaatacttctgtaaggaaatgtgttcatcttcccaatatttatttatataatcatctattaatatgtgtattggtttatgaatatatatttcatactctgaagaagatccatgctatattattcattttatcgttcaaatcaccacagctttattaggtcctgggagctcatttaatttggatcctgtatccttacagcacacctcatccttttgtttttgaatacttccctgtttccttgtattacaataaattctaagctcattttctatattaccttttttgtacatagaattagccttttttctaaagattgcttgtttctaatgttaacgaatagcagtaaaataaaaaaaattgtgataccgtgtataattacttctaggacctctcaacctactggcctagtagacgtgcatgtttatatgaacccatgtttgtggacgcatcaaaactatttatgtaactaatcttctgtaactttattatattaaaaatgagaacacactggtctcctgacccaactatgctaccacatggacctttctagccttccttccttgactgtccataaccacccactgcaaagtgaggaatcctatcctaccaactgccttattattacctagttgcacaattttaggacacatgcatagcggtatcagaaatgtaaagctcattggaaatatatttatctactagaatagagtgttatgtgtagtttctttacattttaaacttatagaatttcctcatttccaaagttaattagattagcaacttcattttctactttctttagtgaagtcatttcaattacattatataatatcatttatttgaaattcggtataaaccaaaactatagtcaagtaaacagatagaggatattcaaggaacttagagagtgagtattaaataagtacaaatggcactgtttaagaatagtaaaattatttttagtgatataaaatggttgagacacgatgcagttaatttgtctaaactcataaatgtgtgatggaaaatataaacctaaatatatacaatttttgtaaaaagtatttagcagttcattaaccccaggattaaatgcagactgtatcaagttatctaataacttatttggtgagggtggggatgtcatgagatgcatgcaaaaaagaatgaagtaattttcctcatttgcgtttaagatgttaccattcactaaagacctttaatttaaaaaaaatcaattttctacgtgacccaggttttttcttcctgacgagcaaataacccagataattcttttctttccttggttgagaaagattttccccaaacttcagctcagttcaggcacacactgtccctgaatgggcatttaccctcagatgggtaacacacctgtcaacatggggactcttctgtcagacaaacacacctttactcacgtggattcttccctcagaccaacacacaagtccccacatggactctttcctcagaccaccacatatgtccttacatttactctttcctctagtaatgacatttcctcatgtggactcttgtctcagacaaacaaacatgtctgcatgtgaactcttcactctgataagtacaaatatttccacagtgactgtttcctgacacaagcacatatatccaatgttgaactgttttatggcaaaatgatctcaagataataattataaaatccctcctgacaaggtgtagatctgcatttttttattgtaccttaactttgccttattgtcaagaacaatagtttgcagctctatatgcaccgattagagattggtgtccattttctctggaaatgtatttttatattcttactggatgtatttttttgataatgtttgctactgtgaagatacctgaacagggtccacactagaaaataaaaaagactaatcggcagattaaccctgtgcatccagacccacgagtcctttgatcctgcccccctgaaatggagacacagaggacagatgagcaatgctgagcggtgcacccaagaccacaaaaagaaagacaaggaaatgtgtcccctcccctcctcatgaaaggcagctcatcccctgttccttcaggccctggtgaggagccaacccatgtctgttcccttcctcggtgtccacaccgtggggtctgccctgatttgggcttcccttctcatcaccctcaatattagtgtcccttgtgaatcaggtccagctgcggctgctccacatggggccgttcttccatttcctctgtgtttgcagaagtcctgtgtgaaatttactgatagagtcaggggggaaaattgtacagcccagtggttcactgagactctcatgcaaagcctctgatttcacctttactggctacagcatgagcttggtccagcaggcttcatgacagggattggtgtgggtggaaacagtgagtgatcaagtgggagttctcagagttactctccatgagtacaaataaattaacagtcccaagcgacaccttttcatgtgcagtctaccttaaagggaccaaactgaaagtcaaggacaaggccttgtaatactgtgagagacacaggagagggaatatctgcgtgagcccagacagaaaaatctctgcaggaagacaggagggagctgcatggtagatgctcctcagaaccaccagggcaccttggggacaacctgggggcactcagaaccaccagggtgtgcttaggaccacgggacactcaggatattagggggtgctcaggatcacgagggggcgctcatgacaccaggggacactcagaatcacaagggggcgctcaggacacgagggtttgcccgggaccaccagcaggcactcaggtcaccagggggtgctcaggaccaccagggggcgctcaggacaccagggggcgctcagaaccaccagggggcgctcaggacacctgggggcgctcagaagcatcaggggtgctcaggatatcagagtgccctcagtaccacgagggggcgctcatgacaccaggggcactcagaaccaccagggggcgctcagtacacgggggttctcttaggaggcagctccaaatcagaagcctgagaggctgtggttttcttttaaaccttggtgattcccgacctggtcaagcaaaagtcttccccaggatctctcaccatttcttccttgtaagtccatgattacttttacctacaaaacattaacttagaacaggaatttaattcaacttttaatgctgcatattttccaagtaatactagcaatgatctctcaggacaatttttacaataggttatttatatattttcttgattaaaaataatactattattaaaatagtaaagttataaaaatcacacctgtaatcccagcactttgggaggctaaggcaggcagatcacttgagctcaggacttttagaacagcctggcagcacagtgaggtcttttctatatatatatatgtaaaataataataataataataaatacctgggtatggttccacctgtggtagcagctacttgaaaggctgaggcaggaggatcccttaagcctgggaggttaatgctgcagtgagctgtgattgtgccactgcactccagcctcgttgacagagtgagaccctatttaaagaaaatgtataccctcaatacaaactgtttcaatgattagagttttgtatttttgtgctgtaatagtcaaacaattgtacatgttttttaacattaactcagcatatacatggtattttgtttatttttctttcatctgctgtttttggaaattaaacacgactttaaatgctcttgttctccattttggttggcttcaggtgtcctgtttttcagactatttctccatcttccctttctctttgaaagtattttactttcctcagtctccatgaaggaaaaagaaagtccctttactttctgacctccaagtctgttgaatcagttcccttctcttcataatcactgaagccaaccaagtttagaggataatggttctccttagaatatgctcgtctacctgcagactctctgccctaactcacccttttccagggtcctgcagaccatctcctcgtttccctaagtaccacagagtgggctctgcagctcctgctgccctctgtgtgctcagccctggggctcactagtgttttgatgatcaagtccaaatccccatgtgcttggaccctctgagaccaccctctaggaagatgccattgtgagtgagccctgaaaatcatggactgtgttcagtttcatattcctggatgttctctgttgtaaaggaatattgacaaataaatactagagtttgtattgaatattcatgccaaaaaagttttttaaaaatttttcaaatgaaacaattttatcttgcctagtttgaaaactacaatctaaatttaacaaataatgtaatacaacgtttgtcctattagttattcaatttattaaaaacagactgatatttaaagttaataccattgcacatttgagtgacatatttggcaagaacagcatttacattcagctttaacaaaacatgtatttatatatatttgtctttttagtattggaataggcagacatacacgtagaagagcattattttctactacaacctcaaactgcaaacacaatttaaattcaattaagtaataaaaaaaatatgaaacaaatgggtgtgctgttttggtgtttagatatacattcacttttgcatgggcacatgtatgtgtctttgctgggctgttgtgtatgtatgtgtgtttgtagaaccatgaagttttcaaatacatcattaaatgacatagttatattaatcttggccaggcatggtggctcaagcctgtaatcccagcactttgggaatcttaggcaggcagatcacctggggtcaagggtttgagaccagcctggtcaacagggtaaaaccccgtctctactaaaaatacaaaaattagccaggtattgtggcacaagcctttagtcccagtgtggcagggaaatgtggggtcggaaatcccacacagagtttctactggtataccacctagtggagctgtaagaagaaagccactgccctccagaacccagaatggtagatccactgacagcttgcaccatgtttctggaaaaaccacataccctcaatgccagctcgtgaaagcagccaggagggagactgtgccctgcaaaagttttttaaaacttttcatttgaaaagttttaaaaaagttctgtcacaggggcagaacttcccaagaccatgtgaacccacttgttacatcaggtaacctggatttgagacatggagtcaaagaagattattttggaacattaagatttgacttcccagctggatttcagacttgcatgggacctgtagtttggaccaatttctccatttggaatggctgtatttacacaatgcctgaactcccattctttctaggaagtaactgacttggtttttattttacaggctcatagatggaagagacttgcctcatctcaaatgagaccttggactgtggacttttgagttaaggctcaaatgagttaagactttggcagactcttgaacaggcatgattggttttgaaatgcgacagcaatcattactctagaggaccacacgtgaagtgcaacaagcaggcgcagaagacaagtgattcgtgatttcactgtagtttgtttaaatggtagactcacagaagtagaatagaatgttggttaccaggggctggaggggtggactggaaaaggagagattgtggtcaaagtgtaaaatgttccagttagacagaaggagtaagttacagtgttctaatgcacaagatggaaaatatggctgtgaatgcattatatatttcaaaatggctaaacatgcaaatgttaaaattttttcccactaagaaattatacaggtcgggagcgggggctcacacttgtaaacccagcactttcggaggccgaggtgggtggatcacaaggtcaggagttcaagaccagacttgccaagatggtgaaaccctgtctccactaaaaacacaaaaattagccaggcgtggtgttcaccacaggagaattgcttgaagcaaaggctgcagtgagccaagatcataccactgcactccaaccggggtgacagagtgagactcagtctcaaaaaaaaaaaagaaatacatttatgaggtgctggatatgttaaatagcttgattaacaattccataatgtatgcatgtatgatagcatgtgtgaatggacctgtatgaaggtgaggtgccctggtcacgtgacagtgaggtgacttgggggaggtgtaaggttacctgggggtatgtgtgcggtgaacttgggcacatgtgaggtgacccacggtgcatgtgtggtggcctgggtgcgtgtgaggttacctggacatgtatgaggtgacatggggaattcgtgaggtgacttggatatgtatgatgtgacctcaggcatgtgtgaggtgacctggccgacgtgtgaggtgacctgggggacgtgtgaggtgacatggggaatgtgtgaggtgacctgcgggaatgtgtgaggtgacctgcgagcattccaggtgacctggggggtgtgtgagcttagcaggagtgtgtgtgaggtgacatggggtatatgtgaggtgacccccctgacgtgtgaggtgacctgagcacatgtgaggtcacctaaggcacatctgagttgacctgggggatgtgtgaggtgacctagggaaatgtatgagctgacaaagggcatgtgtgcagtgacctgggtgcatgtgaggtgacctggtgcatgtgttagtttacctgggggatgtgtgaggtgaacaggggcaggtgtgaagtgcctgaggaatgcatgaggtgacctggtgcatgtgtgtggtgacctagcagatttacgaggtgacctgcgggatgtgtgaggtgaatagggacttgtgtgaggtggccacaggaatgtgtgaggtgacctgggggatgtgtaaggtgacattggggatgtgtgaggtgactcagggcacatgtgaggtgacctgggggatgtgcaaggtcaccttgggtgagtgtgaggtgaccttggggatgtgcaaggtcacactgtgtgagtgtgaggtcatctgggatatttcaaacttcgtaaggaaagcctgcaacagtatatggcactaaaagcttcacactccaacaccgttaatgcgcacatcctcaaggaactctaagtgtttccaggttagcttaaatgccatggagcgacacctgccccaggcacactcatatatgcatcctgggtctccctatcaacccctatcctcaaattttcagtttatgtttgctccatgatatcaactctgatatgttgaaggttttttttttcttttatttgtagttgttcaggtttgctatttcactctcattactctgggctcagtcctctcctcaggtgtcccacttcagagcttgctatataataggagacatgcaaataggaccctcccttttctgatgaaaagcagcgcagcctgaccctgcagccctgggagagaagccccagccctgggattctcaggtgtttctattgggtcaacagcaataaacaaattaccatggaatttgggctgagctgggtttttcttgctggtattttaaaaggtgattcatggagaactaaggatattgagtgagtggacatgagtgagagaaacagtggatatgtgtggcagtttctgaccagggtgtctctgtgtttgcaggtgtccagtgtgaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaatcctgtgaggggacacaagtgcgagcccagacacaaacctcctgcaggaacactgggcgaaatcagctgcagggggtgctcagggcccactcatcagagtcaaccccagagcaggtgcacatggaggctggggtttgtttcctgtcaggatttgggacttcctctgcttctgacagtttccctagggaaactctttaattttagatttctgtgcccaccaatgtcatctctacatatatttttttaaatcattataatacgaggactcattctcacatgcacaatatgtatattgccacctacgggaatgaaaactcctcaaccatggtcaccagcatcagagttgtgaggaagctcaggggtgcctggtgagtcttctccagtcagactcaggacagtaacctcaatgggattccctgactagaatggcttttagggatttcgattacagccaagagagaggctggaccaggttcagtgtcatgtaggacctcacagattttatgtatgacatttctcctgacaataaagtatgcaaatgagtatcagtcactgatctggtgcttcctgactttcatttttagtggttctcgcttttccatttgattttcctgctttctggataaaaggatgttgtccctgtggtctaaatccctggggctcaagccctttccctggagcttaggtggggctcaggctgtgactcctgcagccattgggagaggctgctgagactttcttctctctcattgttcaggatactccactctgttttctggagacgcgtctgagaacgcgtgtggccattagtaatgagggcacaagcttctttggtcaaaatggggtgaggatgtggaattgatcctgtgctgtgtaaactgtcacagagtcaccttcttcaccagtagtgttagaagagcttgtaaaatttgtcggaatccaactggagtcccctgtgttcaaaccctgacaaatggagctggggaaggccatggatggaagcttctcatgcacatacccctgagaacaagacctagctttataacactccaaaaaaccacaaattgaacaaaggcaaccacaacaataaaagaattacttatatccctgagaacaagagctagctttataacactcagaataaccacaacaacaaaataattacttatatacctaacaacaagagctagctttttaacactcggaaaggccacaatcttgcacaaggcaaccacaacaatgaaagaattacttctgtgaaaatatctgcacagcaactgcctatccaaccttacactgatgtcaaccttgttattgatgcttctagcccaggatcgtcctcatcaaaatgtcattcagatcctgcctatgaaaaaaattgtgtttttcagtgcactcatgttctagtaaagccctcagagaccctctccttcacctgtgctgtctctggatttccaatcataaccagtacttcctcctggagctgtatctgccagcccccagggaagaagctgaagtgggtcaggtgtgtaggtcacgaggaaacacacagtgcaacccgcttctcaagagtccagtcaccacctccagatccacattcagaaaacagtttttcctacagctgagctacccgcacaatgagtaaaccaccatggatttttatacaaaagacacagaaggggaggtcattgtgaggccagacacaaacctccctgcagggaagctcaggacaccagggggtgctcagacaccaagggctctcaggacacatcaaggcaggtgcaagaggggaaaaaaggtgctggaggtggggtttttcatcactgtcatattttactctccactatatttattctaatgtatattattttattattagacaatgatatttatataaatatatagccatacgtaggtgcaccaagttgtcctttccatcttatgtggaccttgtccattaggacgaagtccctgtatgtatttgagcacctcataagttatggttaattatgtaggatctctcactttttctgtgtcccttcctccctcctctctcacacacaaactgacacccacaaagagttctacaactttaattacctgatgcgttgaagaaaatttactgaagtgcagctttttcagtttaactgctgttcatgttgatgtaggaataagaacattgtctttctcaactgtgtagctctctaagctgagtagcacctttatttataatacccagatactgaaagcaatccaaatattgatcagcaggttaagcagtaaacactttgttctaaattcgttcacttgaataatacccactgttcaaacaagtacggctggaaatgctcaacaagggtaaattcacaagtacttatgaagagtaacataagccaaagaaatacaagtacatacatacagttccacttttataaattttataaaatgaaaactaatctaaagttacataatgaaaaccagtagttggccgtggacatggtatgagaagggaaggtgtaggaagtggcaattacaggacaacgagaggaaattttgaggataattttttctgtattgagaaaggttatggttatgtcattatttgtcaaattgtacacattaagtgaagattattactttctaatttcgacttcttaaaatactacaaatttaaacatatataatttggtagaaaaggagttagagatggataaaatatatgagaaataaaaaagaaaatctcagaacgatggcataaggattcaaccatcaaactaaataaattttaaatttctcaacacagaattatagattcataaaaccagctcctggattcattgattttgtggaattgatttacatgtctttatctccttcagttctgctctgatgttaggtatttcttctcttctgctagcttgtgaatttgctcttgcttctttagttcttcaaattgtgatgttagggtgtcagttttagatctttcctgctttctcttgtagacacctagtactataaatttccctctacacactgctttaaatgtgtcctgaagattctcatatgttgtgtctttgttctcattggtttcaaagatcatctttatttctgccttcatttctttatttacccagtagacattcaggaacaggttttccagtttccatgtagttgtgcagttttgagtgaatttcttcatcctgagttctaatttgattattgcacttgtggtctgacagactgtttgttatgatttctgttcttttgcatttggcgaggagtgtattacttccaattatgtggtcagttttagaatatgtgcgatgaggtgctgagaagaatgtatattctgttgacttggggtggagagttctgtagatatctattaggtctgcttcaagtcctgaatatccttgttaattttctgtctcgttgatctgtctaatattgacagcggggtgttaaagtctcccactcttgttgtgtgggagtctaagtctctttgtaggtctctaaggacttcctttatgaatcggggtgctcctgtatttggtgcatatatatttaagatatttagctcttcttgttgcattgatccctttaccattatgcaatgcctttctttgtctcttttgatcttttttggtttaaaatgttttatcagagattaggattgcaactcctgctttttttttttttttgctttccatttgcttagcaaatattcctccatccctttattttgagcctatgtgtgtctttgcatgtgagatgggtctcctgaatagagcacatcaacaaaataaatagacagctagccagattaataaagaagaaaagagagaagaatcaaataaatgcaataaaaagtaatgtaggggatatcactactgatcccaccgaaatacaaactaccatcagagaatactataaatgcctctatgcaaatatactagaaaatctagaagaaatgcataactgcctggacacatacaccgtccaaagtctaaatcaggaagaagtcaaatccctgaatagaacaataacaaattctgaaattgaggcagtaattaatagcgtacaaaccaaaaaaaaagtccgtgaccagatggattcacagctgaattctaccagaggtacaaagaggaactggtaccattccttctgaaactatttcaaacaatagaaaaagagggactcctccctaactctttttatgaagccagcatcatcctgataccaaaacctggcagagacacaacaaaaaaaagaaaagctcaggccaatatccctgatgaacatcaatgcaccaattctcaataaaatactggcaaaccaaatccagcagcacatcaaaaagcttatccaccacgatcaagtgggcttcatccctgggatgcaaggctggttcaacatatgcaaaacaataaatgtaatccatcacctaaacagaagcaatgacagaaaccacataatcatctcaaaagatgcagaaaaggacttcaacaaaattcaacaccccttcatgctaaaaactcaatgctctaggtattgatggaatgtatctcaaaataataaaagctatttatggcaaacccacagccaatatcatacagaatgggcaaaaactggaagcatttactttgaaaaccagcacaagacaacgatgcctctctcaccactccaattcaacgtagtattgagagatctggccagggtaatcaggcaagagaaagaaataaattgtataaaaataggaaaagaggaagtcagattgtctctgtgtgcagatgacatgattgtatatttagaaaaccccatcgtctcagcccaaaatctccttaagctgataagcaacttcaacaaagtctcaggatacaaaatcaatgtgcaaaaatcacaagcatttctataacccaataacagaaaaacagagagccaaatcatgagtgaactcccactcaaaattgctacaaagaaaataaaatacctaggaatagaacttacaagggatgtgaaggatctcttcaaggagaactgcaaaccaccgctcaaagaaataagagaggacccaaacaaatggaaaaacattccatgctcatgaataggaagaataaacatcatgaaaatggccatactgcccaaagcaacttatagattgaatgctatccccatcaaactaccaatgactttcttcacagaattggaaaaaactattttaaagttcatatggaaccaaaaatacatcctgcatagccatgacaatcctgagcaaaaaaaaaaacaaagctggaggcatcatgctacctgacttcaaactatactacaaggctacagtaaccgaaacagcatggtattggtaccaaaacagacatatagaccaatggaacagagcagaggcctcacaaataacaccacacatctacaaccatctgaactttgacaatcttgacactaacaaacaatggggaaagaattccggaactatttaataagtggtgttgggaaaactggcgagccatatacagaaaactgaaactggaccccttccttacaccttatacaaaaactaactcaagatggatgaaagacttatccagacctgaaaccataaaaatcctagaagaaaatctaggcaataccatccaggacataggcatgggcaaagacttcaagtctaaaacaccaaaagtaatggcaacaaaagctaatactgacaaatgagatataattaaaggaaagtgcttctgcacagcaaaagaaactatcatcagaatgaacaggcacctacagaatgggagatttttgcaatctatccatctgacaaagggctaatatccagaatctacaacaaatttacaagaaaaaaaaacccatcaaaaagtaggtgaaggatatgaacagacatttctcaaaagaagacatttatgcagccagcaaacatgaaaaaaccctcctcatcactggtcattagagaaatgcaaatcaaaaccacaatgagataccatctcacaccagttagaatggtgaccattaaaaagtcaggaaacaacagatgctggagaggatgtggagaaatagtaacatttttacactgttggtgggagtgtaattaagttcatccattgtggaggacagtgtggcgattcctcaaggatctagaactagaaataccatttgacccagcaatcccattacttggtatgtaccccaaggattataaatcattctactacaaagacacattgcggcaccattcccaatagcaaagacttgaaaccaacccaaatgtccatcaataatagactggataaagaaaatgtggcacatatacaccatggaatactatgcagccataaaaaaggattagttcatgtcctttgcagggacatggatgaagctggaaaccatcattctcagctaactaacagaagaacagaaaaccagacaccgctgttctcactcgtaagtgggagttgaaccatgagaccaggtggacacagggaggggaatatcacacactgaggcctgttgggaggtaaagggctaggggagggatagcattaggagaaatacctaaggtagacggcaggttgatgggtgcagcaaaccaccatggcgtgtgtatacctatgtaacaaaactgcacattctgcacacgtaccccagaacgtaaagtatcatttaaagaaaggattacatattccattaaatatatatgagaaatcagagactcctgaatatacacatgaatacacactgggtctacctatatttttagggaaacactagaatacagcaaaataatgtcatgattttattaaaaaggggggtttatcaaaccacaccaggcatgtccagctctgtcctggagctggttcagggaacaggtgggtcctgtgtttgggagccatgacaacaagctcacagcgtcagttctagttgaaacctcaaaaaggcaaagggatctcaactaaaatatcatgtggatgtcacatctgtgggtgctgcatactcccccgatgtgaatatggaaaggttaattacctcttgaactctctgccgagattagtgctggtctctcaggaacacccaaaatggctcgatagagccagaaagcagactggctcagggtttttgtgatggtttcgtcgtgggtcagagtgaggcttcccacgcacaggaaggggattgtacagtgcgaaacacccactggtgtcaaatgaggaagctcccgcaattcctaactagattcacattgtgtgataaaagacacacaatagacataacttcatggtcggatatcacaaaatgccgttaaaagatgtggtaaaaaggcaactttaaatttttagtcattggagtgcgtacaacacaaaaatcattttcaatatttgtaacacatgcatgcaataggacaaaggtatgtgatgagggtaaaatctcgaaagtgtgaatcttccagctaccaagtcgtagggtaataactgatgtgtgctgagggaggaaaccatcacgccatagtgctaatggtataacccttggtgaagagagttcaatattttattgaagttttcataatttttatttaaagatgccatttttcaacatactcagatgattgtgagtgccattgattctgtatcgtatgaacaatggcaataccttccatgtttacataatattaaaaaccacgttaagactgaatatttggtgtcatggtgcatcacgttattctagcttccatactagttgttttatttgtttgttttctcctttgttggcatttggtttcgaattcatatgtcaggtctctataatgtaggaatttatttaaaagtgtctttttttgtccattttgatggggcttccaggagacgtaagaacctcctctgcttgcaacacattttaaaattacacactaatgtagaacatctgtatttaatcctggtttttagttaattgacaagctctaataagtgaagtaacttctccattctgggctgattttacatcaggtataggaatatatcctaggtgaaagtttgtaccagtaatatgaattattaggtaataacctccacctttatgatttacatgttattcatcaagaaatagtgttaaatcaggagtctcaatgaaagtattacctaagggatatacaaaatatattgctaatctacataaaacagatgtgaacacactcttagtatccagccatgtttcctgtcaaccacacagtaactttgacttcacttgggacttgttctaattttcaaattagttacttattaatcttaatgcttctagatattatgtgtgactattttagcagagagtgaagaaagacagcctaggccgactaaacaatgaggaaaatcacaacctgatgaaacaggaagcctctggatgtgagtggctccaggattgaataatttgacaactcatgtacccaggaagtttcttttctcaattttccacactgatgcatccagaaagtcagcttcaccccccaggtgactcccataatgcagtgacatggtgacaatattcccatggtcacatacgtattttatatattggctggaaaaggggcagagacagttctgcaattctcctctgaaggaccaggaacacctcaacagaccacctcccctgcccccatgactagaactgcaccacgtgcccacatggacactcatccctgatggggataagaagactccattgatgaggccgactattttagcatataaattagtaaagactgatataaaggtttcaacaactaattgaagtctgttcttctatgtccaccagagactatagatgctccagcgatatcttgtttttctttgctgcgtgactgtgtctcttctccttgttccatcctccagagaatctctttcagctcccacaggtgcattcctctgttacatgtaactgacaattgataaattagtggaagcccttacactaaaggaagagtctctgacctcatcttggtccatattcctagaaaggcattgtgcccgtaagtctgggtgtgaccttctgagtgttcctgaccctcctccagaggagatgctcatctgtgtgttcttgtccctttcactggggtagaaccaccctgtttcccccaggtgttccctcccacagctccagtgttccgcatcagtgtcatcacctcccagatctgctgccctgccctgcagactaaagctctgattccataagaaggagagttatgtctcaacagaacttcgtggcagtgacctctgttcccatctcaattcctgaggggttgcaccagtgcccctagggtactggttttggtggttcccctgcaaagtaatttttggttctgtagtggatataagggagtcgagtctgaatgcctttcaaaaatgggggctcttgttctctcccagacagacactttgggaaaggaagattttgtgactgccccttttttggggaaagggattcaagaggatagaaaagctcttcagtatgtggtcccttagaatttcaaactacaacaagcttaccatattcagtttcaagcaatcccatatatatttgtatttttatctttaacagactatatttcatatgccagactctgccttaggtaatctcatatgctggctttgttactctctacaagaacttgcttcttgttaaatttaagattttttttaacttcagttatcctaagcattcagaaatttgcaaaatttcatcttgactgtttatctgttattgttgatgtagttgtaagaaataaagaatatatatccctcatttatgtacattttcaagtcgagtagtagatttttagtactaccagagtaataaaataatttgaacattgttaagctgcttaacagaaaatcaaattatggtaaatttgttcaatggaatactacacaacatttataataaataattgtctgatacatgcaacaagaaggtaaaatatctaagtatttttgctgagtaaaataaaccagacaaatgagaagatttaccatataatttcatttatataaattctggaaaataaaaactgaacttacttaagtaatataacaacaaggtaaaatatctaagtattgatgttcaggaaaataaagcaaatgaataagaatatgtactatgttattccattttaataaactctgataaattaaattgaatctacagcaatataaagaagaacagaatttaccatttggggaaatggtagaagaagggaagaggaaaggaggaggaatatagaagaatgagagggaaattttgtgaattttctggttcaccttggtaactaggatggttacatcaggtttatcaattgtacactttaaatatgtgaagtttattatcagtaaactgaaatttataaaatttattaccagcaaacaaatgaaaacttgcacaagaaataagtgacataaagatagaaaaaatattaaatttcagaaacacctaataatttatcttcgtgaaccctagttctcaccatatttttaggtgaatgctagaatgcagcaaaattacacatgctctcaatacagaaagtgggtttcacaaaccacactaggcatgctcagctctgtcctggagttgggttagggagtaatatagggccagtggatgaggagcacaggcctagatactggggctcactaacctcaggtatgagctcttagatacatacaaagcccctccacgcatgggtttacttccccatctgtaaattgagaaaccattgacccctaaaaatatgatttacacaaatatgtaaaaatgtaagagagtgattagtgcaaagtgtttatcacagcacaatttcataacaagacagcaagttttccaaacagcatcattgtcattagattcctgcagggcatcattaccttatctgggccctgccctctgttcaggcatcccaccccagagcttgctatatagtaggtgacatgcaaatagggccctccctctcctgatgaaaaccagcccagtcctgaccctgcagctctgggagaggagccccagccttgggattcccaagtgttttcattcagtgatcaggactgaacacagaggactcaccatggagtttgggctgagctggattttccttgctgctattttaaaaggtgatttatggagaactagagagattaagtgtgagtggacgtgagtgagagaaacagtggatatgtgtggcagtttctgatcttagtgtctctgtgtttgcaggtgtccagtgtgaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagacacagtgaggggaggtcagtgtgagcccggacacaaacctccctgcaggggcgcgcggggccaccagggggcgctcgtgacccactgagggcgggacaggtcccaggagcaggtgccgggagaggtttcctttctcctcagctggaaaagtcaggtttatcttcgcaggactctggagtcttctaggctgtgatattttgttacttatatttattatgaattttatcattaatacttaaattttagtaattattaacattctacatattattatatttttaagtatatactttcaagaaataaacattcctaattgcataataattattgtaacataattattgtaacatataattatatcctaaatgcataataattattgtaacaatcacattctcattttgtatttgaattttcatatttattttactaagattttaattttaatataaaatatttttctacaattgtctgttttccatttttgtgagataaaattagcatatacaaaaatgcacagattctccaggtacagttagagggtttcaggcaaatgtgcacatacttgtctacagcagctaagtgagggtgaggaacaggtgaggtccatctccccacaaagtgtcctcttagtgcttccagttagttctcacataaggatttttttttatttcaactttataatttagatacagagggttcatgtgtggatttgttacatgggattactgagtgatgctgaggtttggaatacagatttcttcaccccctccctccatggtctagcagtccacagtgtctgttgctcccatatttatgtctatgtgtgctcaatgctgaggtcccacttacaagaatatgtggtgttcagttttattttcctgaattaatttgtttaggattaagaactccagctccatttgttttgctgcaaaggacatgatttcattctttcttatggctgtgtagtattatatattttacatgtaacacattttatatatccactctaccattgatgtgcatctgggctgatctttgtctttgccactgtgaataacacagcaataaacatacacatgcatgtgtctctttggtagaattatttgtttaccttgtagtgtataccctgtaataggatagctggttcatataatatctccattttaagttttttgagaaatctccagtctgctttccaaagtgggtggactaatttatattcccattaacagtgtgtaagtgctttcttttcaccacagccccatcagtatccattggtttttgactttttagtgataaaaatttgagtggtgtgaggctgcacacctacaaccatatgatctttgataaggctgacaaaaaaacaagaaatgagaaaggaattccctgttccataaatggtgctgggacaactagctggccacacgacaaagattgaaactggatgtctgctttcaacatatataaaaattaactcaaaattgataaaagatttaaatgtaagacatcaaactataacaatccttgaagacaacgtgaaaatactcttctcgacaccagctttgacaaatactttttggctaagtatgcaaaagcaattgcaacaaaaacaaaaatagataaggagagactaatttgctaaagagttactacacagcaaaccaaccagctaatcaaccaaacaaacaaataaacaaacaaaactatcagcatagtaagcagacaacctacagaatgtgggaagttattcacaaatattgcatccaacaatgccctaatatccagaattgtattagctggttttcatgctgctaataaagacatacccgatattaggaaatttatcaaaaaagaagaagaagaggtttgatccacagttccacaaggctggagaggcctcacagtcatggtggaatgtgaaaggcacgtctcatatggcagcagacaagaaaagagaacttgtgcaggaaaatccccctttataaaactatcagattttatgagacattcactctcaagagaatagcatgggaaagacccacccccatgatttaattatctcacagggggtttattccacaacattaggaaattactgaagctccaattaagatgagaattgggtggggacacagtcaaatcatatcattctgcccctggctcctcctaaatctcatgtactcacatttcaaaatggatcctgccttcccaacagtcccaaattcttatttcagcattaactgaaatgtccgcattccaaggcctcatctgagacaaagcaagtcccttctgcctatgagcctgtaaaatcaaaagtaagttaattacttcctagacacaatgggagtacaggtattgggtaaatagagcaattccaaatgggagaagttggccaaaacacagaggctaaaggccccgtacaagtccaaaatccagtgggacagttaaatcttaaagctcaaaaaagatctattttgactccatgtctcacatccaggtcatgctgatgtaagtgttgggttcccatggtcttgggcagctatgtgcctctggctttgcagggtacagtctttcacccagctgttttcaccggcttgctctgagtgtccatggcttttctaggtgcatggtgcaagctgttggtggatctactattctggggtctgaataactgcggccttctaatcatagcttcactaggcaatgcaccagtggggactctgtgtgaaagcacccaccccacattttctttcctcgctgcccctaacagaggttcccatgtgggcccctccctgcagccaccttctgcctggacatccaggcatttacatacatcctccgaaatctgggcagaggttattaaacctcaattcttgacttctgtgcacttgcaggctcaacacaaaatggaagatgctaaggctcggggctttcaccccctgaagccacagcctgagttatatgtaccttggccccttttaatcatggctggagcagctctgatgcaaggaagcaagtccctagactgcacacagcagagggaccctgagcccagcccatgaaacaattttttcctcctaggtctctggcttatgatgggagaaccttccacaaaggtctctgacatgccctggaacattttctgcattgtcttggtgaccaacatttgggtcctcgttacttatgtaaatttacgcagctggtttgaatttatcctaaccaaatgggattttattttctattgcattgtcgggctgcaaattttctgaacttttatgttctacctcctttttaaaactgagtgtgtttaacagcacccaagtcacaccttgaatactttgttgcttagaattttttactgccagatacctggtatcatctctctcaagctcaaagttccacaaatctctaaggcagaggcaaaatgccaccagtctctttgctaaagcctaactagagtcacctttgctccagttcccaacaagttccttgtctccatctgaggccacctcagcctggattttattgttgacatcattatcggcattttggccaaagccattcaacaaatctctagagagtttcaaactttcacacattttttgtgtcttcctcttagccctccaaactgtttcatcctcagcgtgttttccaattccaaatttgcttttatgcttttgggtatcttatcagaagcacttcactcaactgataccaatttaccgtattagttgcttttcatgctgctgataaagacatacctgagactgggcatttacaagagaaagaggttgaatagactcacacttccacgttgctggggaggcctcgaaatcatggcagaacatgaaaggcacatatcacatggtggcatacaagagaagagaggacatgcagggaaactcccctttataaaatcatcagcaagacaggagaactcatgcagggaaactcccctttatcaaatcatcagatctcatgagactaattcactatcatgagaatagcatgggaaagacccccccccaccatgattcaattatctcccacggggtccctcccacaacacatggtaattatgggagcagcaattcatgataagatttgtgtggggacacaatcaaaccatatcaagaatgtataggaaacttaaacaaatcaagaatcaaaagacaaataaccccattaataaatgggcaaataacaagaacagacacttctgaaaagaagacttacaggtggccagcaatattttaaaagattctcatcatcactaaccatcagaaaaatgcaaatagaaaaatgttctaatttttgtcattatagattgattttttctgttttgaacttatttttgctattttttaggtttatttatgtaatttcatgtctcaaggttttgtcattgtatatatacatatgtatgtactaatacacatatgaatatttcatatctgaatcaatccataacatcagtaaatgacagtttattaagtaaataaatcagtttattatgtgaaataatgacgatatgtatatttgttttcctgttgatgaaatttaaatttgtttccaacataaatattataagcaaactgttataactatttttgtgcaagtttttctgtttatattctcacatattgataaaatatgtagaaatataagtatgcttttttattataagacttacattttcagctttatggagctaaagttgacaaataaaattgtatgtatttaaggtacaccacttgacgtattgatatacatgggaaaatgctggatggtagataagtaaacaatgctaaacagcactaattatcagggagatgcaaattaaaactgcagtgatatttcttaaaccagtcagaacagctactattaaagagccaaaaataacaggtattggtgaggattgaaggcaaaaggaacgcttggacacttgtggtgaggatgtagattagcacagcctcgatggaaaacagtatggagatttttcaaagaagtaaaagtagaactactttgattcgataaccacaaataactacctaaaggaaaaataaatcattatatcagaatgataagcagacttttgttttcctgcagaactattcataatagcacagtcatcaaacttaggaattaacctatgcctaacaacagatagttttataaagaaaatgttacatatatatacatttaaatactatccagccatattaagggatgcaatcatatcttttgcagctacatggatggaattcatcattattttaagtataataattgagaaacagaacatcatacaccacatgttctcacttataaatgagagtgaactcatatgtgcacaaggacatagagaaaggaatgatggacattggagactcagaaagatgggagagcaaaaggtgggagaatggtgagaaattacttaatgggtatgatgtacattatttggatcatggatatgttaaagccaagactactatgcaatatatatatgtaacaaaattgcagtcactccccataaatttatacatataaaataaaaacaaatacaattaaaatgattaacagttgataaacaatactgaaaattaaaatttgtgatcaataaatgaaaataatattagttgaacttcaaattttaaaacattttctactcaagtgactatcaagaaaattaaggacaagctgcaaaggaaaaaatatttgcaagtcatatatctaccaatgtaattataacaagaaccggcaaacctcaaagatgtacagatgacacatcagcataggaatgtgattttccaccagagaaatgcaaatcaagaccaaaaggagacactactatagactttctagaaagacaaaaaataaaaaagaaatactgacaatatcagagttggtgaggaagtcagtcaccctagagactaatatattgctagtgggaatgcaaaatgaaaccgtttctgggaaaatcatttacagtttcccataaaattaaacatgtccttaatccatgacctagaactctcactcctaagtatgtcctacaaaggattaaaatcatatgttcacacacgtattcagatgtttaacattgtgtgtgtgtgtgtgtgtgtgtgtgtggtgtgtgtgtgtgtgttagaaactaaaaacaacatggacgtctttgaaaatttgacacaaaccattacaggtgaactccagactttcttctgagtgacagaaggcctgcctgaaagatccccagagacacagtcgtggatttcactgtcaccctcgcatgtcactggcttgggctgggctctctctggctcttccctgaccaggaccagatgttgagctccactacctgcagttggaagtttatattttcaacaatgcactgaggtctaagttgctctgcagatggaaccaaacaaacatgggcgcctttgaacaaacagtgcctgacatttgtactgaccccaggagaactcttcccagctctcattcttcttggttctctcctgcaggccagcagccctgaagtttagcctggatctcccatgcatccacccatctccttccaagtgcattttaccacagcctccactgtttttgaagcactcttgggctttgtaattctccacactctgttgtaaaggaagtcaggtccttcaagaccagattcgggactctattttatgaccaaatttcagcctcacccctgctcctgagagagagctcctagataagattctgcaggtggagattaggagtgtttttcttcttcaatgtagttgctgagcgctcagtgcagggttggggagaaactttccactttgtcagcatgcagctcctgctggggtagaccttcttccatagaagcagggttgggaaccagggggccaatgtcctcagtgctgctgcacccagggcagagccttcatccatcagtggggctgtggaagaagtgagtctctggttctcagtagctcttgtccagaactgagcctctgcagcatgttctgtcggccccagtgtcctggcccctaaggagcagcatcctaaaatgggagctagcatatttgagaataacaacacctacacattcagaagctctttggctttctttccagctaatataatttccttttttttgtgtagcaacctgtacacacgcatattgatgcatacagacctatgacacttttttctcgataagtaaaaaattattgatcactgtgatcttttctccaagttcaccatttccctgaaggtgagcacaggtccttctgcatgtgttcaaacaaaaggcccagagactacctggtaagtgaggtgctcacctggttctggatgtttggtctgtctcctcccctctgttgccccacacaaggtcagcccactctttccaggtccgaagaagagagcacaggtttgtcctgattatatgactcacccagcttctgatgactctcctgttgccagcgtccatggcctcagtgaaggtctcctgcaaagctctggatacaccttcgccagctacgacattcactgtgtgtgacaggcccctggataagggtttgaatggatggtagggagctactctggcaatggtaacacaggctatgcacagaagtttcagggcagagtcaccatgaccagggacacgtccacgagcacagcctacatggagctgagcagtcagagatctgaggacatagatgtgtactactgtgcgagacacacagtgtgaaaacccacatcctgagagagtcagaaatcctgagggaggtggcagcagtgctaggcttgagagatgacagggattttatttgctttaaaggctttttttagaaagcgaggttaattcattacagaaaaaaggaaaatagaaatgtgtatggactctaattatgtgggaaattttccatacaacttttgttctctaagcaaaattcagggagtggaaaacaaatcaaattaataaacctgataaaagaattcctctgaaaatttagtgtgagcataagtttttgaatgggtgttgtaaatattttggaacacagctgctagatcacattttaactctacacttatctccattatataaaatatcaaaatgttttaatgttttccattttgtgcaattataattttgtgttataatcacattttaacactttaactctacacttatctccattatataaaatatcaaaatgttttaatgttttccatttcgtgcaattataattttgtgttcatgccagcaatgcatgatagatcttgttcttccgcatcctcattgccatttggcactaagagtattgtgtattttaatattctaatagattagtagtgatagctcattgctgtttaaatgcacatatttctaattaaaattttgtatttaattattttatataattgtgatgaagtgtctcgtatggtatttggattattttttattgcattgtttctttttgatcagttgtaagtttccttatatacccattatataagtcactcacaaagttaacaaaaaattgattaacaaatatgtgttttacaagtgtattctccaaattgttgttgtcgttttactcccatatcagtgtctgtgggagaaaaatatttatatacatatatatgtgtgtgtgcatatatatatatatatatatatagtgtgtgtgtgtgtaaacttagataaaataattatttcataaatcatacttttggcatcatatctaaaaactaattatgaattccactaacaggatttttctcttgtctccaatctcaggccacaatcacagcataagcatttaaatttctcctatttgatgagaagattattaacttaagatgtttagaattcttctgaatggaaggtgccttttttctaattttctgtattcaataatctgttaatatcagtattggctcatgaatgtttattttttactatggagaagatctagtgctacattatttattttatcgctcaaatcaccacagcttttttttaggttctgtgagctcatttagtttggattctgtatttttacagcatgccccatccttttgtttttgatcacttccctatttcctggtattacaagaaatactaagctcattatctctattatcttttccacacatagaatcagttatttctccaaggattactggtccctgatattaaagaattatattaaaacacaaaattatgatgttggatgtgtgtgttgttaatgtactgtcagtgtttctagaatctctaagctaacaggcctagaaaatgtgtatgtgtatattaacccatgttaactgacccatctaatctatttatgtatccaatcttctgtatgtttattgcatcaaactttagaacactggtatctacaatctactatgatgatacatgaatgtttcaagccttccttccttgcctgtccataccacctactgcaaagtgaggaacccctcccatcatttgccgttcattcaatttgttgtacaattttagaatatatgcgtcgtggtattagaattgttaacttgtacccctgttggaagtatgtttattgactagaataaagtgtttaagtgcagtttctttatactttagacttacagaacaccctgagttctaagttatataggtgagaaactttatgtgccaccttcttcagtgaggttatttgaaatatgttgtatacattttatttgacattctgtaaaagacaaaactgtagatgtcataaatatatgaggattttctagaaatttagagagagggtatgcattaggagaaacaggtactgtttgcaaacagtgaaattttttatgatctgcagtagtgaacacatgacacaatttgttaattctcacaattttatgatgtaaactgtgaatctaaatatatacaacttacaaaattatgtagcacatcatgaacatgcaaagtgtacaaaaataaaatatcaaatacatttacaccgcgtgggcagggaattgcatgagatgcaggcaacaaagaatgaagtaaccttccccatttgcacataagatgtttccattcacaagagacctttcttttatcaggttcatgtgcaaccaagtttccctgctgacaagcatttaagccagatgattcgcaacttcctttgactgagaaagatttccctcaaacttcagctcagtgcaggcacacaccatctctgaatgggcatttaccatcagacaatgcccacacctgtccccacatggacctttccctcagacaaacaaacacatcctcaggttgactcttccctcagacaagcacccctgtcttcatgtgaactcttccctcagataagcacacatgtccccacattgactttttcctcagacaagcacatatagctgacaacgaacagttatgtggcaaaatgagctcaggatagtggtaattatggactccagctctgatagtttgtagaaattgtcatttttaaaattctgactgaagactttcctttattgtagaagacagtcctttacagctctaattgcacagcctacagacaggagtccatttcctctgggcaaggtttatttttatttgtttactgtacttatttgttgataaatattgatactacaaagatagcctatagggtccacatacgagaaaaaaagagtaatgggcagatcaaccctgcaaatccagtcccaggagtctttgaccctgccctccctggaatccagagacagagatgggaagaggcctgctgagcagtgcactcatgtccccagggagaaagacatggaaatgaggcccctcctctgcaaatgaaaagtagctcatcccctgttcctgtagatcctggtgaggagccatcccacatctgtgcccttcctcagtgtccacaccatggggtctgtgcagatctgggctgctcttgtcatcactctcaatgttcaggttccccgtggatcaggccctgctgtggctgttgcctctgtgttttcagaagtcccctgtgaagttaactaatggagttagacagagaaatactacagaccaggaattctgccttttctgcaaagcctctggattcactttcactgaaaacagcataagcttgatccagcaggcttcatgacaggggtgggtgtgggtaataacaataattcaaatagaagttctcagtgggactctccttgagtaaaaagatgattaacaatcctcaaatacactcagttcaggagattctcttttaagatgattaacctgagagctcaggaaaagtccgtgtattactttgagggacacagtgaggggacatctgtgtgaactcagacaccaacctccctgcagggagacaggaggggactgcctggtagatgcttctcagaaccaccagggggtgctcaggacatcagggggcactcagaaccatcaggggatgctcaggacaccagagggcactcaggacactggggggggggtgtcactcagaaccaccagggggcactcaggacactggggggggggggtcactcagaaccaccagggggcgctcaggacactgcggggggggggggggggtcactcaaaaccaccagggggcgctcaggacactatgagggggggtggtcactcaaaaccaccagggggcgctccggacacggtggtgaggggtagctcaggatagcaggggtgctcagaaccaccagggggcgctcaggacactggggggggggggtcactcagaaccaccaggggacactcaggacactggtggcggggggggggggggtggtcactcagaaccaccagggggcactcgagacaccagggagccctcaggacactagggggagctcagaaacaccaaagggcaatcaagacaccagggggatctcagaaccaccaggaggtgctcaggacaccaggggtctctgaaccactagggggagattaggaccccagggggctcagaaccactagggggttttcaggagaccagggggcgctcaggacaccagggggcgatagggacaccaggtggttcagaaccactagagtgtgctgagaaccaccaggggtgctcagaaccccagggggctgctaaggacaatagggagtgctgagaaccaccagtgggcgctcaggacaccagggggatctcagaatcaccaggctgtgctcaggacaccggggggtgctcaggacctccaggagcgcacacgacacaaaggatagctcaggacctacagggggcgatcagaacgccagggtgcgttgaggacaacaaggggctcacaggacacaacgacgtgcttagtaaaccgggggacactcacaaccaccgggggtactcaggacaccagggggtgcccaggaaaccagggagcactgaggacaccactgctcccttaggaggcagctccacatcaggtccctgagtgggagcagggaggagggttcctcttgtatcttgccactaacatgttgggagtttttctgcttcctttgtggtttcaattattggctgattcttcggtacaaagcagagcaagtataaagctctgctttcttggattatgtaatgtttttggctttggatgctaccagaattacattgtactttgagaggattcattcatggtgtgtgcaatagtgaatgaaacctgtaattttaggggtggctttgaaagctatgttaggtgtggctgagggcagtttacaggaaatggtcatcactatagaaggctactcatttctttgcacatttgcgtaagcaattgtagtttatgaattaaaaactgcctgttttcttggtcctttttcttaaatggtcccactctaagggcagtaatgtaatcaagctgtgtttcaaagatctgcaatcaagttaagtctgtttaatgaaatgctttgtaaagaaaatgtacatctattttttagagtcacctttacattttacattgctttacaaatattaatttggtaaatttagtctcataattatcttcagtaattaaaaatcttaaagtcatgtcatgttaaattaagtaatcctaggcttctcactgtgaattagggttactaaaaattagaatagtaagagagtataatcaatttatggtgaagtttattaagaaagatgaagatatgttttttgcttaaaaatattttgttttccagtttacagggcctttctactggttttaagatgacaaccactgtttacatctgacccttttttgttgaacatctgttgagtttctattgatattccacagctagagttttaaagtaaaagctctagtatctttgtattagtgtgaatgtgtgcttgtatgtattatgtacatatatatatattttttgttatgtgttatggctacaaggtacaaaattgactttaaaataaataactattttaaattaagtcaatgagccctaatgcatctgaagtacatgtaacttaaataaatatgtaataaataagctggcttcaaaattattggtaaaataaaattggaaatattttaacaattattagaatacctcatagtttatatcaattgatcaagtgattttatatttaaaatcacagctagatattatatggtgtgaaacatttctatgaagattataaaattattaacctagttaaaaccagaatgatctttgtaatttgacaaataagatgtttaatactgttgttttaataaaaaacaggtaaatagttattggaaatacaatcatttatttaataagaattttacttaggtaaacacctgaaattcatgggttataatatgggtaacagggaaaaaactttaaaggatgagtattactgttttcataaatgatctaggtaagctatttaaaaaataaattaggttaatgtaacaaaataaaccttttaaataaacttgttctacaatttaaaaatctaaagtttaattaaataatagatattaactaaatgtttaggtcattactaattgttttaaaaaatgtatactataagaaaatatttttgtaaaaaatttgttcttacagaaagattttatttaattcagaggttacttataaaacatcctaaacataaccagtaaataagagagatgccactgcactccagcctgggtgacagagcaagattctgtctcaaaaaaaaaaaaagaaaagaaatttttagacatagaggagtacttttggtatgaaaggttaaaataaaaaaaaataattttatatgagaaagaatcttgtaactttttatcctaaaataaaaatgactttatttaagaaacagtgatgtttagaataaaactatatgctcaagtatgccataagcgttttgtgtaagtcaaactaaggtttgtaaaaagttaattaattaaaataacttcatattatgaagttgactataattaaaaaggaagtatttataatagtctttatagatttgtagagatctggctttcatataaaaatatataaatatactaaagattggttaggaatgaaaaattgtgcttaaagtattgatttactcaataaaattataagatattttaattttttaacccaaaagtttaactcttactgcatcttgccagttttattttattctcttttgagaaggcttgagaggatctcaaatttttcatgagctcctctaacattttttttcttacagcagttagcctctaacgatgttaacttctaactgttgttagcttctaactgctattattgcctgatgctaaaaatcttttatattaaagttcttaataaaatgttttatttcaatatagtattctgcactcttgggtttttttaaatgtctatatttgtctatggaaccaaaatcttcacttgtaatccaagacacattcttcctatgtctaattaatcaaatactttgtttcattagagttgacttgcaggttatctgcatggatttccccacagggaaacacagtcacactgctgaaggtgttttttcccatttggtaactggcataaaacaaattttatattttcttgaaatacttcctctgtagctgtttttaagtttttcaactacttaggaatactgagattttgagaaaatataaattattgttattacgttaatgtaactatctggcataacttttaaaggacttgtcctgctacattactgatctttgattcctaggtctaaaaaggatacacaacactttgggaggcttcagagggtggatctcctgagggcaggagttagagacgaacctggccaaaaaggcacaatctcattttaataaaaaatacaaaaattagctgggcgtggtggcgggcgcaggtaatcccaactacttgggagcctgaggcagggagaattgcttgaacctgggaggcagaggttacagtaagccgagattacaccactgcactccagcctgggtgagactctgtctcaggaaaaacaaataaatacaataaaaataaaaaagacaccgagtcttgctaaattttaaactctgacagcaattgaagccccatctagagatgtggaagaaaatgacaataaaaattaatcacacacttaagacacaaggccggaaaattgaatctactcaaccactccaggcccagggactgttacagaagaagcggtttgtaagattgtaaaagctaattttgaaagatgaaattacttgagagtttctttatacagtaaacattaatattaaaggcacactaatgccaggctagtagctgggccatgtgtcagattgacaagggtttcttgaagaattaatccactttttaatttgaaaaacttataaaagtttataagagatcatttgaaattaaattttatggtaaaagtaattataatgtaatagatttatttttcagaattgagagacagttttaacttctctcatgctgttcttataaggggctattgtttagaaaattaattcttctctttgaaaaataaaagtttttgctttctttcaaaatcactgagttctcactgggctaaataaataacttacattacagcaatctgtaatcctattttgtaatatcaagcattgtaaacttttgatatttgacaaacttcacaaaataaaattctaaattcagtcatttgacctcattattcttttatgatattaggtccccaaagccaaaattaaacatattcagcttatttggtataattaaaatatgcaggaagcaatgtcaaatttgcaaaagtgtttaactttggactatatttaaataaatgtggactatataattggactatatttatataaattaaagagtatattttccaaaattgtatgagattcaagtgatttgatatgtcttagtatattttatcagtagtatttatgattattatgtaaaatttctgtttattgccagaaataagcaaatcttctcctcaattctgtctttaaccatggctattctaaaacttcagtcatccacagttggtgttttactttgattctttatcaggtggcttatagtaatctatagaattttgaggagtactcaaatatacgattgtgacaattttataaattgtgccattggtatagagattaaaacttccatgactctcattgatacctgattcatttatgatgattgttaatctaatattaagcaggacaggacttaattgcatgaactgaattgacagaagactgaaattgtttttatggcttattctttaatgcatttgctaattacttatgttctgttttttcagaatcaggaaaagtttgtcttttaagctcttcacagttgttaacaattgagtatggtatactttactgataaaaaaataaaaacataatatcttcttatttacataatttctccaaaatttggaaactgtgagtattcttatatcaaaatagttatttgcataggttcaataaaaacctgctttcttccataacagggcacaattggagacaatggtcattttactaaggctttaacttgaattatatattttcagatttactttataaaatgaatctaacctggagagctgataaagccccttgggaaaactggcatgcacatttttttttttttacagggccccgaactgtagtaagtaaacaatttaatttctgacagacccaggactcccaggttttcttggaaacttgaaaaaagagaaagtaacccaattcacatagctatctggtggcacagataaaatattggctgggcttgaagattttaaagattctaccctttgattccttataaaaaatttccagcaaagtcaatttatggaataaaattggcctatgtacaaacaaaaaatagaaaacaaaaagagagctaatatgttaaagggttactttggctggcatcttatacaaaaaaaccagggccaagtctcataagcctaaaactgattttacaaatagattagtcctactatgattttgtgtctaataaaattggggaattatagagagaaatattatttcaaaataaactatagtgcatcagttaatagattttaaccttgtccacttgcttttcaatttatattattttctacaatttggactgaattttaaagcgtatctttgcacgagtctccaaaataatgttttcagttatttccctttttaaatatttttcctggcttgaaatcagcagaagttaaactgtgctttcttacagctagacaatgtaaattctaaaagaaaacaaaatcaatgatatggtttggctccgtgtccctacccaaatctcaccttgtattgtaataattcacacattgcaagggtggaatgaggtggagataattgaatcataggggctgttttcttcatgcttttctcctgttagtgagtgagttctcacaagatttgataattttatgaggggcttccctcttcacttaacacttctctctcctgcagtcatgtgaaatagcatgtgtttgctacccctttcatcatgattgtaagttttttgtggcctccccagccatgcagaactgtgagtcaattaaacctatttttctttaaaaattacccagcctcgtgtatgtccttatagcaacctgaaaatggactgatacaagcaacttaactacatacgaagtctccttttgtacctgcctattgtgaagagaaaataaatcttgagaccccaaaatcactaagctaaagagaagagtccagctggtgtaataggagatagaaagaaattatttaggtagatagttaggatgaaagagtctctggcaaaacttttcttctcacaagaattagctcagaaataacttcttttctaatcagacacagttcaaagagatcacttctaacaaagagcagcctgaaagatcgggctgtaaaacatagataaacaactctggcagagagggtatttctgtgtgtaatcaccaaagttcacatacataggatgggtcccaataaaaacattgggtcttaatgagcacattcctttccttttctggggtcacactgagataggaaagctgttagcttgcacggggtttgggatgcctccagctgcaaggaggtaccagggacctggcatggaaactcctcccccctttttcagcacatgcatggtggaaggagataaggaacgtggagcagaccaagctaagtccccacctgcataataaaagcatgagatggggctgccagagacttcgctctctgcagatggcacacctggtcctgcttttgcaccttatgttgataagaagccatctccccacgagcacatttataaaaatccttacgttgataagatactgtctccccacgagcacatttataaaaatccttacattttactgcggcacagcaacccatctgggaccctttctgtgacagagagattttttttccttttacacattaaatttctgctctaacctcactctttgtgtgtctgtgtccttgattttcatagccacgacacaaagaacctttggtgatattccagataacaaaggtgctttactggagagggctttgggcaacctgcctcccattctattcaaagtgattcctctgaggcccacacgagacagatacatatctgattgcttcctcttcagtatcatttatgaaaaaatgaagattcactaagtctgactaaattgtggattcagtggtaggctgataaaggacttaaaataatgcaacctactgtgtcttatctacttctaaactgcaaaaccccctttcaatttgtcctgtcttgaaggaaaaaaaatgtacattttacatatattgattgatgtctcatgtctctctaaaatgtataaaatcaagctgtacttcaatcgccttgggcacatgtctcaggacttcctgaggctggtcatgggtgggttcttaactttggcaaaataaatgtattagtctgttctcctgctactaataaaaacataaccaagcctgggtaatttataaagcaatgaggtttaatggacttatagttccacatggctgggaatgcttcaaaatcatgtcaggaaagcaagggacatcttacatggtggcagacaagagagagcttgcacaggggaactccccttgataaaaccatcagatctaatgggacttattcactatcatgagaacagcatgggaaagtgctgacttactgcaggagaactacataattttatattttcctatatgcttctttttcattacacatgtaaattttcataccatccaaatttccccttacccagcttttcctctttatatattgaaagccctaaaaattgtctttggggaatggcactaaccacacacagtttctgtgattacttttatttttcttccaggcatgtcctggaaagacataatttcctttgggaaaattaattttaatttgattaagatctgtctcagaaaccttcggtttacactaggaaagatcccaaattaggagccaattactgtaaaaatcagccataccactctgtgagtgtgtgtgtgtgtggcggggggtgtatatgtgtgtgtacatgcatgttttcatttctgtgggctttaagccatgtagttctctctgcgaagatactatttggcatgacctttgaatagagaattgtaagagaaataagaggctcctatgaattatccgaaagtttctggactcaccatgtatcttgactgtgtcattgcatctgacagtcccagggaagtgactctctggtggtttcatgaatctgtgcttgggctctctctgcagtttactgggtatagtaatgacaaatcactgtttcaagagacaatttcgaaagcattagatgctgctgagagaggattatgaaccaggggacagccccttcattctgggggagcgacattgggagaatatgctctgtgagcccaaacagcttcctcccctgcagggtgagggcagagctgcaggacaggcccagaacccactcaacacagatgtcagccctggagctgctgcagaggagtctgaggagaaaattttaccagcacctgaattacacttatttcaaacaaaaatgcatgtcctgtgagtgtttgtttccctattggaggagttctgtactcatgaagttctggacatgccagcggacaaatatcagtaaacaaacatcagaacttgaacctcagcttcccactgttgcattctccatgtgtcatctctattatttctcatgctagatcaggtatttagctatgaaatattccagctaattaacgtgtaaatagcttgaagtctactgagttaaatacatatattttctcttgtttttgccaggtgttccctcccacacctccaatagtctccactattatcatcatcttctagatcttctgcgatgccctggagattaaggatttgattccatgacagagaggaggtgcatttcgatggaactttggtgaaaaccttggtctttatcccatttcctctggggctccaccagtgcctctggaatcatggtttcagtggcttgcccctgcatggtaggtcattcctttattctgtagtgctgatgagggaggtgggtctgaacgcatttcagtagtatgggctctccttctgtctcagacactttgggaaaggaaaatttttctgagcgtcctcattctagaacaaagggattcaattgtataggaatgctgaaaatagaaaaccttcagccaaattaaggttaataagattaattgagcaatggatgattcatgaattgggcagcccccagaatcacagcagattcaaagagacttcagtgcagtcacggggtggaagaagatttatagattagaaaaatgatgtacagaaatcagaagtgaggtacagaaacagctggattggttacaggttgcttttgtcttatttaaacaaggtgtgcaccctcaagagtgtacgagtggttgaggtatggctgctggaattggccaagactccgctgttgttacaggcgcatgctccgaagttggcttttcaatctcgtccacctattcaggtaggttacagtttgtccacaaggactcaaacacagaagtacggagtccttttcaggccatatttaattcactttatcagtgcccttcagtatgtggttcctgagaatttcacatgacaacacgtttaccacactggaatttaagcaatccaacacgtttgtagctttgtcttgtaatgggctatatttcatgtggcagcctcggcctcagtttagctaacactatggcttcatttctctctacaagaactcatttcttccaagatttccatgttcctgaaaggaaaataaacctttgggacccccatatcactaagccaaagggaagtcaagctgaaaattgtttggggcaaacccacctccattctttccctaaaatgagagctactaaggtttttaaaagctacagacctccttcaaaatttgaccacaagtaaaatccttgtggacccaggacagagagagtcatttctctgctcatgtaagtcaaacgcatacctgattgctccctgtgctctactgtttcactaaatcagactaaggcctacgtgactattcctgtaaattgtgcattcagttaaaggctaatcagaaactcaaataatgcaaccatttctctcaaacctacctatgatctagaagccctctccccacttcaagttgtcctgcctttctgaactaaatcaatgtacatctgatatatatatattgattaatgtctcatgtctccctaaattgtataaaaccaagctgtgcccacaagcttgggcacatgtcgtcagcactccctgaggctgtgtcacaggcatgtccttaatcttggaaattgaacttcctaaatctattgagattagtctcagatactctttggtttacaggtttgtttttatttcataacttcaattatttgacatgctaaagaaaatttgccaaatagcgcattctcttgtttatgtgttattgttgttgcaaaaataatatattttatatataatttatcatctatgtacattaccaaattgagtagcagatttattagtaagacccaaagtaatgaaaagttcagataccaattagcaacttagaaaaacaaattatgctacatttgtttgctgaaatgctacctattatttataaaaaataaacaatacaacataaaaggtttaattctcagtatttctattgagaaaaataagccaaatagatgagtacatactatattatttcattcttataaattctagagaataaaaactagtctaaagaaatatgaaaacatcagtacttttataaagaaatggtagaagaaaaggagaaaaacaaaaatatatctataaaagagcaagaggaattctgaggtgagttgacttgtcaccttcttgaaaatagagactttctttatcaaaatttactattgtacaggttaaatatgtgaattttatcatctgtcaattaaaactcataaaatttattacaagtaaacaagtgaaattttagacaaaaaagggatgataagaaggaacaaataaatacattaaatgtcagatacaccaaaaatgtatctgcctgacgcctagttgtctctgtatttttaggtaaatgcagcaaaatcacacaggttgtcgtggcaggaagtggattctgcaaaccacactaggccgtttatctctgtcctgtagttggttcagagcaactgaggccagctgtgaggcgcataggcccaggtactaggactcactcatgccagatataagccctgagacacgtacatagcccctccatgtgtgggttcacttttacatctgtacatgaagaaaccactgactcctaaataacatcatctatacacataggtaaaaaaattaaaaatatgatagttgttaaatgtttatcgcagaacaatttcaaaataaggcagcattttcccaaatacaatcattgtcatcaaaatcccccaggacgctctcatctactctgcgccctgccttcacctcagatgtcccaccccagagcttgctatatagtaacagacatgcaaatagttgactccctctcctgatgaaaaccagcccagccctgaccctgcagctctgggagtggagccccagccttgggattcccaagtgtttgtattcagtgatcaggactgaacacacaggactcaccatggagttggggctgagctgggttttccttgttgctatattagaaggtgattcatggagaactagagatattgagtgtgaatgggcatgaatgagagaaacagtgggtatgtgtggcaatttctgacttttgtgtctctgtgtttgcaggtgtccagtgtgaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagacacagtgaggggaagtcagtatgagcccagacacaaacctccctgcagaatgcctgggggaaatcagctgcagggggcgcacaggacccactgatcagagtcatccccagaggcaggtgcagatggaggctggtttcctgtcaggatgtgggacttcatctttttagagtttctctagggaacctctctaagttcagaattctgtgcttaccaatgccatccctacatatttttaaaatgattattttaatatgaaaacctattctcttatgcacgaaacacagactgatgcttacagagatgaaaagccctcaaccattgtcaccaggatcagagtattgaggaaactcaggggtacctggtgggtcttctccactcagactcaggacagaaacctcagtgagattccctgactaggacggtctttaggaattgtgatcgcagccaatagagagtctgggcaaggatcagtgtcatgtagaacttcacaggtttcacttctgacccttctcctgacactaaagtatacaacttagtatcagcactgatctggggccccttttgctcttagcccattctatttctttttatttgttgttgttgttcttgcttttccttgtagtgttcctgctccctgtaaagtggggatgtggctcttgctgccaaagctccaggtctcaagcccattccctgcagctcaggtggggctcaggctgtggctcctgcagccacgtggaagaggctgatgggactttcctctctcccattgctcagcaccctccagtgtgtcacgtggagactcacctgcgaatggaagtggccaacagtagtgaaggggatgagcttgtgtggacaaaatgggatgtggatgtgaaatttatcctgtgctgtgcaaagtagcacagagtgagtcaccttcctcaccagtagtgttagaaagagggtgtgaaagttgtcagaatcaaaatagatccacttgtgttaaaaccctgacaaatggaactaggaatgaccatgaaggaggtttcccatgcacatactcctgataacaagatcgaccataaatggattctgcttaaccacaacctttgatagaagccaccatgaccttataaaaatcacttctacaaggacatcttcccagcaaatcacggtttaaccctatactgatgccaaccttggtattgactctacaagcaaggaaaatcctctcaaaacaatttatgcaacccacctcattttcactcataaacctatggattgacatcctggagccactgctgcatttgttgttactggtaattagccccttttacaatatttgtgactgtttttctccgatgtctcttggaaaataaataatttacaagctgatggcagtaaagaaactatttaggacatttttaacatcctgttgaatatttctgcatagcacatcggtcccctaaaatacttcgctgtattggcatgtgatgaatcagagtataatgctgaaggtaaaatgggaaatacatgggcttttgatgaatcaagtcatagggtgagaatgtctgtgtccttgaggaaggagaccttgggctgtaagttctagtgggagtacctttggcaaagggatttcatgagtttctgaacgttatgctacttttaatttaagaatgcaacttatcatttatttttacttaaatctttccagaagatatttggcagtaaggacagggtagcattcgtgtgatactgatgacttagagagttattttgtaatttctcctgtaaggtatgcacattgctcacttgatacagaagttcaaatgtcacaggcgggaaaataggaataaagcaaattttattaaatgtcacgactgtagtttttggcaaggaagtgcttcatgtcaacctgaaaatagacagacaacaataaaacatattcaaatccaaagggagtcagacctatgtccctctctcttataagtacaaggctttgccacatccaaaatatcctttaggctccagggtataaaatgcttttggactgtgaagctaacagctctcccctcagacagggataaggcatctggggaatgcagagttgtgttcatgaagaagatggcattactgtgtcttctcctgtgcctggtgatggctcccccagggtgagtgactcggatgtcagatgtgggtctatggggtgagtgtaggtacatgtgactgacggggactgattccccatgtattcacatgccctgtcccaggagcagctgcaggagtcagccctggacctgaagagcacacacttaccctctgcttcacctacaccatttctggccactccatcacaaccagtccttactactggacctggatctgccagctctcagggaggggctgcaatggatacaatgcattgctagtggtggtgggaatccatttgtcttgtggaaaatggcagcatctctttattttataaggcagaataatgttatattgtgtacacataccacattgtctttatccatttgtccatcgacagacacttagtttccatatcttggctgttgtgaatagcgctgcagtaagcacaggagagcaggtatcttcacagggtggtaatttcatcccatttaggtgtatttccataagctggatcgctggtcatatggtatttctgttttaatttatttagaagccaccacactgttttgcataatggtaatgatgggaatgtagaatgtcatagccgctacgaagaacagttttagatttgaggtataatccaaaagcaaataatgtttgatcatggttctcatatgaggctctaataaatctagtggaagtccagaaagttttcccaccttgggcaaggatgagtttgcccctaattgtctttgaggcagaatatttgcagaatgtgagatggagtatgtcggcaggattcaggatgattcagccataaatagtaatggcacagaaaaacagggagttagagacatgcagagaaagaaagagatagagagaatatgaatctcataagaggaaaatctgctggatatcagtgttgggttttcattcatagagacatcagtgtcagcaagaaaccatgaagtcaagtgaggagtggagaacatgttcagtctgaaaatcagcatattctcagaggcacccattgtcccatgacacaggcagagaatttcggaaaccagtgaagtgggagttcacaataagtgatgaagttatcatttttccaaactttcattaatatgcaaagtatttctatagatcactcatgcacatacacacaaaatgtgtttttgcatttatgggtgtctagagaaaaataagtgagaaaatttttccaggttgcagagatctgtttaagttatagattccacaggagagtgtctttgaatgaatactattctattaattaaataggacaaaattccctctgttggagcagccttccaattatgtagatttctttattgcttcttgagttgtgaaacataaacccaaggattgacttactggaattcgagtgctgtgttgataaaatttctgataagttttcttccaatgatttgagaatagctttcctgtttttttactcaaggaaatgaattttcacaaggtttcaggacatcacgtttcaggtgttttacttaaagagactcttcctgggtgcagtcagctttcttctaaccatgagctcacttcttcagcaaaccattcagtttgtgcctctattaagaattatgaagcttttaaacttcaatgcactgaaaatcatgccccttgaattaaatgttgattggcactgacatgaattgtccactcttggatatgtgtcctatgttatgggctcaacatatcagtggactgagaatcctccattagctgcctctgactgtggcactgaccagattgagaatcctcagagtcatccatgaaaaagagagtctttaggttcatggggtttttggagacattcaggtgagtggaggggagaaacaggactgggggtggccagccatttcaacaagactgggaaagattagcatctaagtttaaaggtctacatcattccaaacaccctgcatgacaggctgacaggaagaaatccaaccccacagcggctccatagcatctctttagtatacttggtagtgaagctgtttcagggaagaaacgtccactcaagggagtcagtgatgcttctctgagctacaataaacagtgtattggacccaggtttctctgagttcaatgtgatgattacactcagctgctgctccagtgagtttaaatgagcatgtggcaattcagatgagcctggctgtgtggtatgttatatgtaaatcggaactatgtaaacataaagggcatgtcggaactagtgtgagggtgagagatcttagaggccccacacctcacactcttgtgcttatttgctccaggaacctccaggttctttgagtgaaaatcaacatagatcctttcctggataaatcatccaaatatctaatctctgagaaatacacatgcacatttctccggatagaccatccaggggaaagacatatctagaaccttatctgtgttgggtaaggtagtccatctccattacagaccctcccagcagccttcctttatcatgaaagtggataaaattagccaatagagaaataatcctataatgttatagccagaaaagggaaagcaacagtttcatttctggagactctgcgtataggtcacagcccagagaaagaaaggatgactgaattattaagaatcaattgtaagaacatataatacttccaggatgcacactttgttttctcaccagtataatctgggttaaagatgaaagtgtggaaatgcacagactctatgtgaggaggagaacatagggaaactgaaagacaatggcagagaataagacaaggacagtaggaaaatctgaagcctctgacataaattttttgaagacaaggtcttggcaaatccattgacctcagattcttttatcatggggcatttgcagggttcctagctgagaaaaaaaatgcatgcacttcccaagtctccacttgtattctgtttgcctcagatcgctaagtgaaaaaaagccataaacctaggcctagtgtgtgtgtaggaggcactttttataggctagaaaatagtaagaaaggagaatatgtgttattggaatagcatatacaaaggtgtctttattctgaatttatctgtacctgcagatattctcaggtgcaacattcaactgcaagagcccagcgaagaaactaggcactccccaaatccttcaagtttttgtgttcattgtgtgtccactgactcaggaaatgtgaagcttcagaaaagggggtcccttctgtgtcacagaatcttgtctgtgggtctccctctgtaggtttagtaaggctaatcaattgttaaaagacatggtgtcagcagcctgtggtgtcactgatggagaattctaaaccaggacacagccacttcatgctgggctagagactctgaaggaaaatatttgtgagccccgacagaaacctcattgcaaggcaagagcttctgtggaagggggcacttgggagccaccaagcgcaggttccagccctggagcaggtgcacagctggggaggaggtttcctctcagtgcctgtgttttcgtttgtcaggaaaaaacaatctaaaataactgttcaaaaagtcgctgatgtgctttaaatattctatcacatcaaaaccattcatataacttaaggcactggggaactattttttaaagtgggtttctagaactataatatcttaatagtgagaatatgaaggataggcatgtttttactaattctatgggtacagattagttgaagaaactacattcctatgaataagaaattcagatttcagtgttaagtaatgttgcttacattgtgtgagtgacagggcagtggtggatctgagagtgtggcaggtgcacagaccaagtgagtcagaaatcaatatggaaaggtgagggtctgtggatatgaactgaaagtatgtaaatacttgacgaaatactaataaatggagttcaaaataacccaaaattgttctaaacacaaattccttgacaattactttgggagtagagagttcataatggactccaaactcctgctttatcttctgattcccattgtctgtgagatgagaaaatcagctctaattatgcatcacagggcaaatctgtaaatcaagagtgttcaatagaattgaagaccctgggggatcaggacatgaggcaggtgctggagacagtgtctcaggagcacccagtagatctcagaggtccctcctggacactcatgtgggacgtaagcatcactttctcagagtcaccaatgagctgtgctggtggctgatgggtccaggaaaagaccaaggcacctgctcagtgtgatggagagtgatggttccaaaaatgatccaggtggtctctatgctaatcaaatgtaggctcacagtgaggagcctgttctatatgggcttattcttcagtgaaaggacgtctgtccacaaatgtttgtaaatggagcagggcatgcatttcctcaagcaggattagggcttcgaccgtctgcatctcactcttgttaggctgatgtgtcatttatcttccctttcttatcatggattgggctttgagctaagaaaggctttgtcttatgaatatgcaaatatactgatatccactgaggtaaatatgttctgtgccctgagagaatcacctgagagaatcccctgagagcacatctcctcatgggctggacctgcaagatcctcttcttggtggcagcagccacaggtaagcagttcccaggtccaagtaatgaggaggggattgagtccagtcaagggggctttcatccactcctgtgtcctccccacaggtgcccactcccaggtgcagctggtgcaatctggggctgaggtgaagaagcctggggcctcagtgaaggtctcctgcaaggcttctggatacaccttcacctactgctacttgcactgggtatgacaggcccctggacaagggcttgaatggacaggattttagttatttgagagatttttcatacaacatttattctgtaagcaaatttcagggattgttgaatgaatcatattaacaaatctgacacagaacttcctctgaatcaatctttgtaaacatcaatttctgaatcaatgttgtaaatatttcagaacacaagcacaaattcacattttaactctacttttatctctatttaaaaaatatcaaaaaatctcattttgtgcatgtaacgttttgaatgcccaccatcaatgcatgacatttcttgtttttccacattcatgttaccatttatcatcatgagaattgtgagttttagccatgctgataggtgagtaatggcatctaatttttatttaaatgcacatgtcccaaataaaaaattcgtattaagcaatttttatataatttttgctgggatgcctttcctgatatgtggttcattattatctgcattgttttcttttcattagttgtaagtttacttgcatattgattataaaagtcacttaacaaatccaaagaattgatttaacaaatagatgacttggaagtattttctcccagtctgtggttgtctttttctctcttatcagtgggtatttcaaaaaatatatgtgtgtctgtgtgtctgtgtgtgtgtgtgtgcacagatttagacaaaaaacataaaaaattattcattcatagatcatgtatttggcattatatctgaagtctcattataaaatacactaatagtgattatttattccatgttgctaatctcaggccacaatcaactcatgagtgcttagccttcacctattgattggaggactatccacctgagatatttggaatacttccatgaggagatgtgttcttcttcccatcatttctttatttaatcatctattaacatccgtattggtttatggacatctatttcatactctgaagaagatccatgctacattattcattttcttgttcaaatctccacagctttattaggtgctgggactcatttagtttggatcgtgcatcctaacagcaaagctcatcttttgtttttgaacacttccctgtttcctgatattaggatagattctaagcttgtttctttatcacctttttcatacatagaattagccatttatataaagattgcttgtttctgattttaaagagtagtgttaaaataaaatattgtgataatgggtatgtgtgttgttaatgtggtataagtacttctgggacctctcaaccttctgttctagcaaatgtgcatgtttatatgaatcatgtcatgtccatatatccaatgttgaactatgttgcgaaaagtgatctcaagataatggtaattatcaaccccctccctaacaaggtgtagatctgcatttttttttcattgtaactcaactttgcctcatggtcaggaacagtggtttccagctctaaatgtactgattacagcgagatgtccgttttccctggaaatgtatttttaagttcttactggatgtatatgatgataatgttttctactatgaagatacctgaacagtgtccacactagagagtaagaaagagtaatgggcagattaaccctgtgcatccagacccaggaatcctctgatcctgccctccctgaaacggagacacagaggatggatgagcaatgctgagcggtgcacccaagaccacaaaaagaaagacatggaaatatgtcccctcccctcctcaagaaaggcagctcatcccctgttccctcaggcccgggcgaggagccaccccatgtctcttcccttcctcagtgtccacactgtggggtctgcactgatctgggcttcccttctcatcaccctcgtattagtggcccttgtgaatcaggtccagctgtggctgctgctcatggggctgctctcagtctgatctctctgtgtttgcagaagtcctgtgtgaagtttactgatggagtcagagggagaaagattgtacagcccagcggttcactcagccactcctgcaaagactctggatcaccttcactgattgcagcataagcttggtccagcaggctccaggaccagagttggcgtgggcagcaacagggagaaattcaagaggaagttcttacatgcacccttacgtgcacggtctcactgagatctttacttcctttatcacgtttgttctgtaaatcacaacgaatggtgcattcttcatctattatacacttgttaagtcttttttggcatcttttaaaaaactggtaactttatcctgtgtaatatccctgttaagtcctaaaagtcttttttgatgtctattttttcttaactttacacagctactatagatttattttggttcatatttttgtaatccatgttttctcatctttagtttttacatttgtgaatacgtacagtaattttctaatacatagcttctagttggggcttgctttttaaaatcaactataataagctctatttttaaactaatattatttttctgttacattgtttaaattagcatttcacaatgatgtttatttctctactaacatataatctaattcacttttataaatattatattggttaccataagttttacaataagaattgtatataattagattctataagaattgtatataattggattctaatgcagatactgtgatggccttgatatgaagaacagagacagtgtaactgtgtgctttgaattcctccttctcactgctctttcttgtttattcccagtttgcacttacatatactataaaacataatatataaattttttattcctttcatagttatataatatagcaattacaaagataaaaactgcacttcatcttgattttcccattttgtacagtcttaatttcttcgtatagatttatgttttgaatgtatatcacacggctactagcagagaaagtttgttaaaatgtgcactgaagcatgaatgtgctgacaataaattgtctcaagatctttttgtaatgacagaattttatttgcctttcacttttaatgaaaatgtaatgcacatagaattccagtttgcatttcacttgtaatttattttcttgtgtttattattttgttcatggagatgatcacacattacattctgctgggcctttattaaccacatttctatgaacctagtcagggttggatttcaagtgtatggttgccacggctatcagagttgaagtcagcttctcctgttcacaaaaagttcaggttcctccagtgatacccacttttgtgtcccggtttggctcttcccatttctttctccccagagagagcctgtctctttcatctgtggcaggtgcatcctgctgacacttttacttggtgattgtttgtggggtgaaagggcttggacacagggggatgttctccaaccttctgaccaagcatccttcttagctatgggtggtgagaatggctctgaagcatggtcttccaagcgttcctgttccttcccttccccaagtcagagtgtctctttctagccacagtggtcttccatcagtgtcctcagcttctgacccactgtccttactccacagactcaggatttcattcctcaggaaagagacgggaggtgtttctgggtagagtctccttagtgtcctctgtttccttctgttctagttgattctaccagtgcctgaaggacacaagatttaataaatgtctcccacatatcgtgaagagggattcagcattgaacggagctactgttcttcctccccagtcaacatcacaggacagcaggtggctgagttgtctggggatttctccaattctgtaggaaaagcccgcaagtgccaggagtttcacactctcacagcattagcacacacatcctcaacaactcatgaaacatttccaggttagctttttcctatcttcaataccatacaatgagtggcacctgccccaggtactctaataaatggacctagttttctctgcaggctccccattttctcagatttcaggggtttttttctctgcaacatcaactcagatatgttgaagggttcattttttgtagttcttcaagtttcttgttaatgaggtcagaagaagatcattttctcatttttttttttacattcccgtgcttagtatctgctttctaaataaaattcggaaactaagacaaaatatcaaatatccactatttggtgcattgttaaactatttgagaaatattcatgtactgaaatacaatgaacaattgaaatcaaggcatgcctcagtcacataagaatgtgaggacattatcaaataattgtgctgagtgaaggaagctaaagaattcacagtaaatctcctgtgatttcttttgtataaattgtagaaaatgcaactattctaaattaacatggagaagatctgaatttttctgagaaaagtgtggtgaggtaacaagatggtgaaataaaattacagagaagtgagagaaaaaaatttggaggttaatttaattgctaatagcacgattgaagtgctgattcaaaggctgcacacatataccaacattttccatatcgtacactataaatttgaattcactattgattgaatttttgaataaagcagtaacaaaaatgagtatattggctgaggaagagcaagaaagagatgaatattgacacttgaataatcacggactcctgaaaatacacacatgtgaacactgattgcatatttcaggtaaatactagaaaaagcaaagtcacataaagtcgttatgacaggtgggataccctgcaaatcacactaggcatgtcccacactgccctggagctgtctcaggggagcagtctcctccagtgtttagaggcacaggcacggataatagggctgacgctgtccagatgtgtgatattggacacattgcacaactgctctgttatgtatgtaattcatcttctctaaaaatgtaacattgacacttgcactgaatatattctgcaaatatgtaaacattaaataagatgatgactgctaattgatcatcaagtcacaatcacataatctgaagttatattttcctgagagataggattacctccagtgttttccgggaccctctcatctgctctgggcactgccctctcctccagcgtcccactagagcttgctatatagtaggagacatgcaaatagggccctccctctgctgataaaaaccagccgagcccagaccctgcagctctgggagaagagccccagccccagaattcccaggagtttccattcggtgatcagcactgaacacagaggactcaccatggagtttgggctgagctgggttttccttgttgctattataaaaggtgatttatggagaactagagacattgagtggacgtgagtgagataagcagtgaatatatgtggcagtttctgactaggttgtctctgtgtttgcaggtgtccagtgtcaggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagacacagtgaggggaagtcagtgtgagcccagacacaaacctccctgcaggggtcccttgggaccaccagggggcgcccgggacactgagcacggggctgtctccagggcaggtgcaggtgctgctgagggctggcttcctgtcgcggtctggggcggcctcgtcgtcaaatttccccaggaacttctccagatttacaattctgtactaacatttgatgtctctaagtggaaaacgtttttgtcctttttgtttctttgtttttgtaacaagaggaaacatcctcagctccacagaagccagggtgtcactttggggacagaaataatcctttcatggtcaccaggataagagtcctgaggaatcccagggaaacctggagagtgttttccagttagactcagggcagagacctccatgggaatctctgattagaacaggccttgagctctgacgggagccaagagagaggctcgcccagggtcagagtccttaaaacctgatggttttcacagctatcccccctcgtcttgtaaactcagactgattcagttgaccctctttctgctaatccatttccttctctgtaggtttgattctcacagttcgctttcttcttctcttccctgaaaacagacgatgtgttttctgtagtcaaaatcccagggctcaggtctgcaggacctgggtaggctacggggactttctcactcaccattgtctggacactcttgtcttctgtgcatggaggcatttggaaaatgaagtggacattagccatgaagggaataatactagttttctccaataggatattgatgtagagctgatcttgtgcttctcacactgtctcagagtttggactttcacctgtgactttgagaagagctggggatgggcactccattgtgctgtgagctctgggtaacgataattgtagaatctgcctaggcagtctaaggtcaatactactggtcatcaggaaagacagctggaattcctgggaagatctgcatctgccgtccaccatggagtcccatcgtcttctgttatgctctctttgaatcagtcccacctagattatctagaacactcttcctgacttaggaaaaataatggcaggctccactaacacctgtgttatgccatgggagcaacacctaagctagtgtgtgaatgagtagatgagactgtggtctagtcaaggtgacaggtaaaattgattgttgccattatgatattttattttatatttggcaatatagtcatgctcctattataaatattttttgagacggagtcttgctctgttgccagcctggagagtgcagcagcacgatctcggctcactgcaacctcttccacctcccaggttcaagcagttctcctgcctcagcctcccgagaaactgggattacaggtgcacgccaccatgcctggctaatttttgtatttttagtatcgacagggtttcaccatgtgggccagtgtggtctcgatttcctgacctcgtgatctgcacacctcggcctcccaaagtgctgggattacaggcatgagccaccacacctggcctagttttattaatgtctgtccataccagcaactacatacctatggggacattaatttacatctgcagacagatgtgtaaatacacaagcctatacatacatgtgtagccatttatatttaacattataataaaataattctaaaatattttctaaagaattaaacttaatgatgagctaaatataaattagagtaatctataattgatttcgatcattctctatagtttgcataaatggatgtctatttctaagccttaacatagtgtattcgtcattttaaaacagtcaagaaaaaattacaaatgttcttgtcacaaaaaaagataaggatttgatgatttgaggtaatatatatgtcaattaacttgattcaattattctgtattgcattcacaaaccataacatacctttgtgccccataaatatatacaaccaaaatttctcaattttcaatgaaattttaattatatatttttaaatctgatgcctctccttggattaagccacctcctcaggcttacagggctcttccattttctcaacatgctgttataccagatgagcacaaacacattaatttcattatgcttagctttaatttttcaaaacaacatgaaggtgataattttaccaatagacgtattgcaacctactatgcatgagaccctttctgtgcttcaaggtttcttctcaggactttatatgtattgcaaattttcatttttttctgatatggaatgctgatttctctttattacagattatcagtttatttttcaaatttatctcttaaaattaattttttcaaagtcccactcaaaccagggtattattagaactttgaagtgtaatagttggaccaactttgagaatacattcaatttagttcacgtgctctcaagtatcttttcttctttaaaagttgttgtcagttgtaatatcacacaaaatattagtaatttatactaatgacacaggttaaaatattgtataaataatttaattacatttgattggaaaaaaggaatatatgttcctcatatcttgacttttttttcttctctatgagatgcatgtttattaattattaagtttaagatgttacccttgtctttttgatttctgggatttaattttagtacatatacttgaatgcattgtattaattcatataataatgttcatattttggatagggttttaatattaattttgttattactgaattttaaactattctacactttttcattttttgtttttatgcgataaaatttacatataagaaaatatgcatagatctggaatgtatcactagagagtttctggcaaatgtgaatacccttgtccccagcacctaaggtagctgaagagcaagtccatccccacatcgcgggtctttccctgtgcctgcggtcaactcctgcatggggaaatgttttgatttctcacactacagatccatttttttccgttttgaactttatataaatggaatcaaacattatagaccttttttttgaaaggggcttcgatatttttgagattaattcatgctatttaatgtataaaattagatcaacatattgtcatttattcaattcatggactgactctgatatgaaacctcaaagttttcatgtatatatggagacagggagaggaaggagaaagattttatatctgagtcagtccattaagtaaataaatgagaatattttgatttattttcctgttgatgtactttaaatttgtttccattttatgaatattataggcaaagccgttacaaatatattagtgtaggttttcctatattgtctcatttttgttgagaaaatatgaagtatatatttctttttttatttttgattactatttatttatattttatattttactttaagttctgggatacatgtgctgaacatgcaggcttcttacgtaagtatgcatgtgccgtggcggtttgctgcacctatcaacctgtcatctaggtttgaagcacctcatgcattaggtatttgtcctaatgctctccctcccctttcctaatgcttttcctcccctgacacatcccagtgtgtgatgttcccctccttgtgtccatgtgttctcattgttcaactcccacttatgagtgagaacatgtggtgtttggttttctgttcctgtgttagtttgccgaggatgatgatttccagcttcatccatgtccctgcaaaggacatggaaatcattcttttttatggctgcatagtagttcatggtgtacatatgccacattttttcatacagtctatcattgatggacatttgagttggttccatgtctttgctattgtaaatagtgctgcaataaacatacatgtgcatatgtctttatagtagaatgatttataatcctttgggtatatagccggtaacaggactgctgggtcaaatggtgtttctcgttctagatccttgaggaatttccacactgtcttccacaatggttgaactgatttacactccccctcaacagtgtaaaagtgttcctatttctccacattctcaccagcatctgttgtttccagactttttaatgatcaacactctaactggcatgagatggtgtctcattgtgattttcatttgcatttctctaatgaccagtgataatgagctttttttcatatgtttgttagctgcataaatgtctttttttgagaagtgtctgttcatgtccttcgctcactttttgatggggttgttttttttttgtaaatttgtttaagttccttgtagattctggatattagacctttgtcagatggatagattgcaaaaattttctcccattctgtaggttgcctgttcattctgatgatagtttcttttgctgagcagaagctctttggtttaattagatcccatttgtcagttttggcttttgtcgtaattgctttggtgttttagtcatgaagcctttgcccatgcctatgtcctgaatgatactgcctatgttttcttctagggtttttgtggttttagattttacatttaagtctttaatgcatctagagttaatttttgtataaggtataaggaagggatccagtttcagttttctccatatggctacccagttttcccagcaccatttattaaatagggatcatttccccatcgcttgtttttgtcaggtttgttgaagatcagatggttgtagatgtgtggtgttatttctgaggcctctgctctgttccattggtctatataactgttttggcaccactaccatgctgtttttgttactgtagccttatagtataatttgaagtcaggtagcatgatgccttcagctttgttctttttgcttaggactatcttggctatacaggctgtttttagttccatatgaagtttaaggtagttttttctggctctgtgaagaaagtcaatggtagcttgatgggaatagcattgattgtataaattactttgggcactatggtcattttcacaatattgattcttcctatccatgagcatggtatttatttattataaaagtaactttaattttttcagttttaatgaggaacaattgaaatatttttaaatgtatatgtttaaggtgcaccacttcatgttttgatattgtgttagtccattctcacactgctataaagaaatgcctgagactgagtaatgtgaaacaaaaaaatagatgtttaattggctcatttttctgcagactgtacaggaagtgtagtggcttctccttctggtgagactcaggaaagttagaatcatagcagaagacaaatagtagtagacacatcacatggccagagcaggggccacaggaagagagggaggtctacacagttagacaaccagatcttatgataactcacacaatattatgagaacagcgccaagagtcagtgctaaaccattcatgaaagacccaccccatgacccaagcatctcccactgggtcccagcttcaggattgaggattataatacaacacgagattcaggccaggacgagttgcaaactgtatcagatacacattgtaaaatgctcatcatgatcaaggtaatttgtgtgcctatcatcccacatacattttttttttaaatggagtgtgtgtgtgtgtgtgtgtgtgtgtgtgtgtgtgatgagaatatctaagatctaccctttcagcaaaaatcacttttacaacacagtattaaatacaggaacattgctgtagattagatctccagaactcattcaacctgcacacctgaaattctgtaccctttaaacatcacccaatttccctctcctcccacatcctgggacccattattttactttctgctttcaagagcttgggtgttttagataccacatgtaaatgagataatgcagcatttgtctttctgcatctggcttattccacttagcatcatgtcctccaggcccatccgtgttgttgcaaatgtcagaatttccttcttttcaaagcctaataaaattcagttttatgtgtacacattttctttatacattcatcagtctgtggtcattaaattattttacaaatctacactattataaataaccttgcaatcagcatgtgtttaacataataattttacttatttgaatacataacaagaagtgggatcaccagatgatatgatagctttatttttcaatttattgagtaaccaatcctaccacaccctaaaaggattctcttttcaccacattcttgccaatatgtgttatatgtcttgctgatgatagccattttaagcagagtgaggtgataactcatcatgattttgatttgaattcctctgataattagtaatgttgagaaccctttgaggctctgtttttcatgtgtgtgttttctgaagaaaaacctatccagtttttgccctttttatcagatcatttgttatttgctattgagttgcatgagttatttatacttttggatagaacttatgtcaggtatataattgcacatagtttttttcctgtgcttttttctattaaattcaaagaaatcatttctgaatcaatgacaggaagtttttttccatgtgttctatgagtttgtggcttcaggttatgttcatttttagtttatttttgaatacggtgttagagaaggtctaattttatttcttttgcatatggatgttaagcttttacatcatatattgaggagactgtccatccttcactgtgtgttcttgggatacaaaatcaggaagatgcataatttaaaaagaaaacatcagatgaatattcctggtgaatatagaccgaaaagttctcaacaaaatactagcaaatagaatccagaagcactttaaaatgtaatacctcatgatcaagtaggctttacccctggaaggcaaggttcattcaacatccacaattcagtaactgtgattcaccatgtaagcagaataaaagcaaaaaccatatgattatctcaatagatgctgagaaagcttttgataggatccaacatccgctcataataaaagccctcaacagactaggcatcaaaaaaacttacctcgaaataataagagccatctatgaccaatccacagtcaacattatactgagtgagcaaaagctcaaaaccctttagaagtgaaagaagaccaagatgccctctcaccactgctattgaacatagtactagaaaccctagtcagagcaaccaagcaatatcaaaataaaaggcagctgatatggtttgtacttgtgtccccactcaaattaaatgtcaaattgtaatacgcagtgttgagggtggggcctgatgaaaggtggttagatcatggggatgagtctctctctcgtgctgatcccatgatagagccctcaggagatctggtttcaaagtacgtggcacctccctcgtctttcttcctcctgctccagccaggtaggacatgatgcttccctttctgtactgattgtcaggatcctgaggcctccccagccatgcttcctgtatagcctgaagaaccatgaaacaattaaaaatctttataaattacacagtctcaggtgtttctttatagtttgcgaatggactaatacagaatccaaataggaaaagaagaactcaatgtatctctccaaactgatgatataattctatacctagaaaattctaaagaccctgccaaaataattctagaatagataaacaattttggtaaagtgttgggatacaaaatcaatgtacaaaaatcactagcatttctataccccaactatgtccaagctgagactgaaatcaagaacacaatcctatcccacttacaatattcacacacacaaaatatgaaatgcctggaaatacaggtaacaaacaaggtgaaggatctctgcaaggagaactacaaaatacagcagaaataaataaataaatcgtacatgacacatgactcatctgacaaagggctaatatccagaatctacaatgaacttaaacaaatttacaagaaaaacaaacaaccccatcaaaaagcgggcaaaggatatgaatagacacttctcaaaagaagacatttatggagccaacagacacatgaaaaaatgctcatcatcactggccatcagaggaatgcaaatcaaaaccacaatgagataccatctcacaccagctagaatggcgatcattaaaaagtcagggaacaacaggcgctggaggggatgtggagaaataggaacacttttacactgctggtgggactgtaaactagttcaaccattgtggaagacagtgtggcgatcctcaaggatctagaactagaaataccatttgacccagcagtcccattacttgctatatacccaaaggattataaatcatgctgctataaagacacatgcacacttatgtttattgtgtcactattgacaatagcaaagacttggagccagcccaaatgtccaccagtgatagactggattaagaaaatgtggcacatatacaccatggaatactatgcagccataaaaaaggatgagttcatgtcctttgtagggacatggatgaaaatggaaaccatcattctgtgcaaactatcacaaggacagaaaaccaaacactgcatgttctcattcataggtgggaactgaacagtgagaacatttggactcaaggtggggaacatcacacaccggggcccgtcatggggtcgtgggagtggggagggatagcattaggagatatacctaatgtaatgttaatgggtgcagcacaccaacatagcacatgtatacatatgtagcaaacctgcacattgtgcacatggaccctagaacttaaagtattatttaaaaagaaagaaaaaaactattaatttttctgaaccatgaacatggaatatttcagatatattttcaatttgtgtgtgttcactttattttttattatcaatcatttctggttttcttttagaaatctttcacttatttggtaatatgaaatataatttttagctattataaacaaaatgctttattgattttttgctgtttgcatttagcaatgccaccaatttttgtatgtaggtgttgtattctgcaaatttacagaattttttatcaattataacagtttttccagcaccatttattaaatagggaatcgtttccccatttcttgtttttgtcaggtttgtcaaagatcagatggtcgtagatatgcagcattatttctgagggctctgttctgttccattggtctatatctctgttttggtaccagtaccatgctgttttggttactgtagccttgtagcatagcttgaagtcaggtagcgtgatgcctccatctttgttgttttggcttaggattgagttggcaatgcaggctcttttttgttccatatgaactttaaagtagttttttccaattctgtgaagaaagtcattgatggggatggcatcgaatctataaattaccttgggcagtatggccattttcacgatattgattcttgctacccatgagcatggaatgttcttccatttctttgtgtcctcttttatttcattgagcagtggtttgtagttctccttgaagaggtccttcacatcccttgtaagttggattcctaggtgttttattctctttgaagcaattgtgaatgggagttcactcatgatttggctctctgtttgtctgttattggtgtataagaatgctagtgatttttgcacactgattttgtaccctgagacttcactgatgttgcctattagcttagggagatttggggctgagacaatggggttttctagatatacaatcatgtcatctgcaaacagggacaatttgacttcctcttttcctaatcgaataccctttatttccttctcctgcctgattgccctggccagaatatgtagaaagctgaaactggatcccttccttgcaccttatacaaaaattaattcaagatggattaaagacttaaatgttagatctaaaaccataaaaaccctagaagaaaacctaagcaataccattcaggacataggcatgggcaaggacttcatgtctaaaacagcaaaagcaatggcaacaaaagccaaaattgacaaatgggatctaattaagctaaagagcttctgcacagcaaaagaaactatcatcagagtgaacaggcaaccaacagaatgggagaaaacttttgcgatctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaacagacacatgaaaaaatgctcatcatcactggccatcagagaaatgcaaatcaaaaccacaatgagataccatctcacaccagttgggatggcgatcattaaaaagtcagggaacaacaggcgctggagaggatatggagaaataggaacacttttacactgttggtgggactgtaaactagttcaaccattgtggaagacagtgtggcgatcctcaaggatctagaactagaaataccatttgacccagcagtcccattacttgctatatacccaaaggattataaatcatgctgctataaagacacatgcacacttatgtttattgtgtcactattgacaatagcaaagacttggagccaacccaaatgtccaccagtgatagactggattaagaaaatgtggcacatatacaccatggaatactatgcagccataaaaaaggatgagttcatgtcctttgtggggacatggatgaaaatggaaaccatcattctgtgcaaactatcacaaggacagaaaaccaaacactgcatgttctcattcataggtgggaactgaacaatgagaacatttggtctcaaggtggggaacatcacacaccggggcccgtcatggggtcgtgggagtggggagggatagcattaggagatatacctaatggtaaatgacaagttaataggtgcagcacaccaacgtggcacacgtatacatatgtaactaacctgcacattgtgcacatgtaccctaaaacttaaagtataataaaaaaaagaaaaaagagacccaattgttgacaaagttatgaaaaagatagtttttaaggagtctttaagtaatattgtattttctgcaaacagacaatttgatttcccctattccaaatttcaggacatttcttcttttttcttgtcaaattgttctggctagaattacagtaccatgtagaagtggtggaaaagagcatttttgtcttgttcaacatcttagagaaaaggctttcagtttttccagccttggtataatgcaagctgtgggtttcacatatctggactttattattttgagatatgtttcttgtataccaagtttgttgagaatttctataaggaatggaggttgaatttttttctatgactttcttaaagcaattaatcataaaataataataagcaggtcaatacaagatccataaattagtggaagctagttatttgcactgctgccatagagtaggatcactacacaactcatggtgttgatgggaaactataattctgcaataattaaagactagtgatttacactgggctctattgagagatttggttgtcaactacagaaatcgagatgaaggggcactgagaaacatttcgcttcatatcatctcaacttctaatatcaatttttagtactaatacagtcctattttctcagtatactgtctcacaggttatagtatatgtcttagaaaattaagggttgtttcattctaataattaactcagaaaaattcatttcctattatggatgacaagtgtaaattcatatcttaataattacccacactccaaaacactactacaggcaaaggcaagagaaaggcaggtatagatgagattctctgaggtcagttatgtaaatacccaaggactattgtctatgaccttgaatgtcactttcttcccttccatgagctacatccaggatattctgtgaatctgagagcgttgagcatgtttaattattttatctcactgccccttagtcttgctttctccagttgacaaccaaatctctcaacaataggcccagcgtaaatcaccagacttcaattattgtagaactatggtttcccaacaacattatgagttacaaaatgatactactttatggcagcagtgaaaatgatgaacttccactaacttatgaatctctgaatggctagcatggaggtgtgtatgtatcagcgcactgttctagaaatgttccgtttctgtccattattttatgtagtaatgaggacaacgtgaactaaagggagtatccatggccttataagcacagagaccacatccagtgcaggtgcagagcaaggctgcaacagtcagcaagttgctctctgaagagtcttccaattcccttgcccaaagcatctgctcattcatgggctgagaaaagggaagtcatgcatgcagtctactctctctacagagctgacaggggacacggacaacatcgattattcatggaattttcccataggaatgcagctgtgtgcacacacacataatacatttttaaatgttttttttatttatcctctccaattttaaaaaagtcatcaccttttctcctaatcaaagaggattttgaccagaatgcttggtgggagccccctgctctcccagatgcccacccttatttctcttgaagtgaagaacggcagctctcttgatttctactctcatcctctaggactaaaaccagaaggttccacgccccctgggtgaacatccaagaagaccctgtctgtagcagcaggagcctcaagccttgactgagagctatggtcctgaaatgagacagtgtcccccatggagagcacacgtggacgcccacaactgagggctcactgctcttcaccacagatgcgctcccttactgagtcctgagacctgagtgcaccccatagggtagggctcagaagaggggatgcaaatctccaccagctccacccttctctgtgttgaaaagccgagcatggggacctagttcagtgactcctgtgccccaccacatggagctttactccacgcttctcctgctgactgtcccttcctgtgagttcagtggtcagggaatccttcaggggtgaaacacctgttcttttctttgtgggcttcatcttcttatgctttctccacaggggtcttatcccaggtcaccttgaaggagtctggtcctgcactggtgaaacccacacagaccctcatgctgacctgcaccttctctgggttctcactcagcacttctggaatgggtgtgggttagatctgtcagccctcagcaaaggccctggagtggcttgcacacatttattagaatgataataaatactacagcccatctctgaagagtaggctcattatctccaaggacacctccaagaatgaagtggttctaacagtgatcaacatggacattgtggacacagccacacattactgtgcaaggagaccacagagacagagcccagggtgcctcttgtacaagaacccaggctgcttctcagtggcgctccctccccacctctgcagaacaggaaagtgtggctgagatgccatttcctgtcagggtctgggtgtcttatcctatctgactcagagccttgtcttcctccctcttctttagtaataaatggcatgacccctgttagtggttcatgcaagcagaggctgtatcctgtttgacaaagattcagcatgaaaggttcctgttacttgagccagatgcatcactgatatgtggccaccagtttcttagactcataccactttaagggaccaaatacaaatgtccatagcatatgccattcttaaactgcagaaatgatgtcaaagaagaatgtggagataagagagcaggaggaattatgaaaatctggatagcatcttctcttctagggtggaaggtatgctagtaaagtaatttaatgaaacaatcagacagatgcaatatgtcctcatcatggagtgtctcacatgggcagtgcacaaataaatttctaaaaattccataaggtagatgtgatggatgaggcttatttccacacagggagcccacaaatatccagagaagtaaaaaatctgacacttggaaagaaaattgcctcatcttgacatcagaaacccatttcaacatgtccgaggggcaatgtggaaaagaaatggaaacttcaaaaacacatttcttatgaaatgtctagctcatgtttgaacataaaaacagaattgtccatgattttagaaaaaccaacccatgacagcgagtcactacactcagaaacaccactgagtcaacagacttcagtctgtgagcaggtcagtactgaggccccaggtgaatcaaggctctcacgtacattgtacagaacccagaattgagccacacaatctataaccaagtcttctttgacaaactttacaaaaattaacaaaaaaatacaccagagaaattcaatatatgaaattcaatatacccattcaatatatggtgctggggaaattggttagccacgtgcagaagaacaaaactagacccccaccctcaacacatatatactcaacacaaaatgaattaaagacttacatataagacctcaaactataaatctactcaaacaaaacaccaggacaactcttctgggctttggcctaggtaaagaatttatgactaagaccccaaaagcaaatccaagaaaaaaatagacaaatgggacttaattaacctaaagcatttttcacagcaccggagtgaacagacaagttgcagagcgaaagaaaatttttccacaccacacctgtgacagggaactaatatgaagaatttgcaaggaactcaaactactctacaacaacaacagcaacaagaaccaaataactccgttaaaattagcagaggacatgagtagacattttcaaaagaacacataaaaatggataataaatatataaactacgctcaacatcactcatcatcagggaaatgcaaattaaaaccacaataagatatcatcttccaccagtcacaatgactattactaaaaactcaaaaatatcagatgttggtgaagatggaaaggaaagggaactcttagacactgttgatgaggatgtggatgaggacaacttctatggaaaatggtatggagatttcccaaaaaactagaaatagaactcccctttgatccagcaatcccactactgggtttactacccaaaggaaaataattttttatttccaaaagatatccacacttctatgtttatcacaaaactattatcaacagcacatatgtcaacctgagtgtccaccaacagatgattttataaaagaatatagcatatatgcacaattcaatactagtcagccacaataaggaatgaaactgtcttttgcagcaatatgcatagaactggaagacaacataattagtgacctaactcacaaacagagagtcacatgtcacatgttattatttataagtggaaggtaacaacgtgtccacaaggatatggagagagaaatgatggacaccagagacttagaaggatgggaggtggaaggtgggagcatgaggagacattacctagtgggtacaatgtacattatttgggtgatagtacactaaaagccaagaccactatggaatatagccatgtccaaaagtggcattcgtagtccttaagtttatacaagtaaatgtacacacaaataaaattaaaaatataaaataattaacagttgaccaatgatcttaaaagttgatttaaaatataatcaataaatgaaatgaatatcagttgaacctcattaaatttgaaaacgttttatactcaaatgactataagaaaatgaatgtcaagtttcagatgagaaactgtttgcaaatcattagccaccaacataagtataataagaaccctcagaactcaactgtgaaaaaaagaaacaacccatggatagaataggcaaaggtttgtgcagacatttcatcaaataagatgtacagatgacacataggcatataaatgggctcgcaacaggattttccattcgaaaaattcaaatcaagccgacagtgagacactactatacaatttttagaaattaagaagaaatacagataataccaatgctggtgagcatatcagggtccaagactctaaaacgttgcaaacaggaatgcaaaatgaaactgctactcaggaaaataatttatagttttttctaaaatcaaacattttcttaatatatgacctaaatatcccactcctgaatatttgtgtcagagaaatacaatcttagattcacaacaaacttccatttaaatgttcaatatattgtgctcacgtgtgtgtgtgcacgatagaaacaaaaagtaacatgaatgtctcaaaatttgaataggtaaaaagtaggaagtgtctattaattgaataccatcagcaataaaaaataacaaaatgactgatacacaaaccattacaggtgaactccagacatgatgctaagtgagagaagccagtctcaatgatcaaagggacacatctgtaagcaccacggtcatcctcaggtgtcagtggtttgggctgggctctctgtctctttcctgaccagacccagatgttgagctccgccacttgcagatggaaaattctactattttcaacaatgcactgaggtttgaactgcttcacagactgaacgaaacaaacacgggctcctttgaacagtgtgcagcatttgttccaaccacaagagaatgtctcccagctctgccccttctcagttttccctgcaagccagcagccctgcagtttagcctgcatctcccatgcatgcacccatctccttccaagggccttactccacaacctccacttattttgagtgcactgactggctttgaacttttccacattctgttgttattgaagttaggatgtttagagccatattaaggatcatattttatgactgaattccagtgccccctctctcctgggacagagcacgtaaccaacattctgcatgtggagacaaagatgagcttttttcttcctcagcctaggagatgagcgctcagtggagggttggatagaagcttcccaccttctcagcactccagttctggtggggagaacctctgccataggagcagagctagaaaccagggaccgaatgttcccagtgacactggacccagggtagagcctccatccacgagtggggctccatggaagaagcgagtctctggctctcagtagcttttgtccagaactgagccttaggatcgtgtactgtgggcagagtcagagggccaatgtcctggctcctggggaacagtttcctctgaagggagctgggtagaaggtgtcctgtcttcttggctacatctgtttgcagtggagtttacatcatgctgagttgggatgtggaaggaaggaggagcatcttagatcaattatgatggctagacttactgaattttgtagattttcttgaataaatgtttcttcacttgctgtatgctgtgagagcctttccaaaccctgtattttttcaaaataattttcactggtctcatgagggcatggattcattgagcccctcatgctatcaaagagaaatagaactttttttgttcactttttagagaacatccatgggttataaaacaatgggttgacttctcttccaaaactttacagataccgtcaattttcctcttgcttgtaaggttttatccagaagaatgctgtcatcattttttctgcttttttggaaggaatgccccttctactcacctcaaattgcctgcatgtatttctatttttctttggttttcagcagttttaataagatttagctaaatgtgtgtggggggagcagggagtgtcattctgctgttctgtgttctctgagatgcatggattcacggtttactctgtctccattttggggaacacaattagaaaaaatgtcagtgtgagcccagaaacaagcctccctgaagtgggcagaggaccacctgggggcgctcaggacccactgagcacaagagccagccccagggcaggtgcagacgggggttaagatctggtttcccgtcagccctgtggcttcctctccataaaacagttccctcgggggcacgtctctggattccttatcttgttcttactgtgaagtctctgaagaataaacatttgttgtaacaagagaaaaattttctcccatgcaccaaaggcagagtcacctacagtcaattagtcctgtttctcaatgttaataaactatcaatgtttctgaaggtacattgtacagaacccagaattcagccacacaatgtatagccaagtgatattgacaaacttaacaaaatatacaccagggaaaggacgtcccattcaataaatggtacttgggaaaatggatagaaacatgcagaagaacaaaactagatccccaccctcaacacattagtcaggtctctaaaatgcaggagtacatatctaaaatttattattttattgtgcatttttacgtgttccagaaggtgggagaaatttctttctgtgaagagcatcccaaagtcaggcactcctctagaacacgtgtttaatccttgtctttggcttattgatgagctctgttggctgcaataacttctgccatccgggctgactttgcatcatgtagaggagcaaattctgaatgaaagtttgcactactcaattgagtgcataacctacagttttgttactgatgtatgattcatcagagatgatatcagatcaaggatttcaatgagaatctaatctaaaagatgtaaacaaattttcctaatttagataaaattactgtgagcacactgctagtattcagccatgtctcctatcacattgaatctacactaagtttgacctaaaagctagcacttgttctcatgttccaatatgttatttttattttaatgtattcagattactatgtgttgctattttacccaaagtgaaggaaagcaattttaactgactgaaaatgagaaaaagcacaacctaatgaaatggaagtcaggacatgagtgtctccagccttgtctatttcaaaaattcacgtacgcagggggatttctttcctcaattttacacagagaaacttccaaaatgtttgtttcctctcccatggactctatcatcagtttctatgtcagtttgcttagaattttggcctccagctccaaccaatttggtgcaaaaacatgatttcattcttttttatagctgcagagtattgcactgtgtataagtaccatgttttctttatgcagtctataactgatgggcgtctaggttgattccctgtattaggtaatgtgaattgcacagagataaacacatgagtggatgtgtctttgtgttacaatgattggttttctcttgggcatatacccagtaatgagattgctgaggggaatagtagctctgttttaagttctttgagaaatctctagactgactgaattgttttctctgtgaatggtgataattatgtcaatatttgtcaaattttgaatgtattgtttgaagattgttatttgtcaatattacctcattaaaactattaaaaatggaagtgtataatttggtagaaaaggattaaaagaaagataaaaataatacaagaaaagtcacagactcctgaatccacatgtgaattagcactcagtttttctatattatttataaaaacactaagatacagccaaataatatcatgatatccttataagaagagtgtttcgtaaacctcactgggaatttctagctctgtcctagagttaatttagggagcagtcggatccagtcctgagcaacacaggccagacactgagacttaccacatcttaccagatgtgagctcttagacacgtcacatggcctctccatgcttgggggtttaccttcacatctgtaaatgaaggaaacattgactgccacagaacatacttcatgtgcatctatacagtagaaatgctaataagaattaattgtttatgaagtgtaatcactctgggacacagcccactcagaggcatcccttccagaacccgctatatagtaggagacatgcaaatagggccctccctctgctgatgaaaaccagcccagccctgaccctgcagctctgggagaggagccccagccctgagattcccaggtgtttccattcagtgatcagcactgaacacagaggactcaccatggagttgggactgagctggattttccttttggctattttaaaaggtgattcatggagaaatagagagattgagtgtgagtggacatgagtggatttgtgtggcagtttctgaccttggtgtctctgtgtttgcaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatacacagtgaggggaagtcagcgagagcccagacaaaaacctcctgcaggaagacaggaggggcctgggctgcagagggcactcaagacacactgaaaacacggttaacactgggacaagttgctcaggaaggttaagggctggtttcctttcagagtctttgctgtttctgtatctaacagtttccccaggaaccctgtctagatttgcgatcttgatctgcttaaactgtctctgtgtcatttttcttacctgtgactttaggggagctgatcgtggacactccagtgtgtggagatttcctggtgacagcaattgtgtgttctgtctaagcatgtctagggccggtcatcaggaaggacaggaaggacaggctggaattcttggaaacagctgcacctgccatccaccagggaactttattgtcttctgttctgctaaaattaaatcaggcacaccaagtttaactagcactatcttcctagcttaagaaaattgatggcaggtttcaataacacctatattaaaccttcagagcaacacctacattagtgtctgatttgataattgagactatgttctagccaagcagacacataaaactggtgattgccatgcttagttcatatttcatatttatcaatagaatctggctggtgttataaacagatttgccaacacatgtgtgttagtgtttgtcttcggagaggcacattctatgactggattaagtttgtgtacaggttcctaaggaacctgttcatgcttttgagaggaaatgcagagggggtggaaggcggctggggaagctgaaggtatacgagggaagtcagtccctgagtgaaggagagagggaggagaactgggtagaactttcctaaacttctgtgctggtctaggaaggtccagcaagatcactgagtcagattcgtgtcaaagtttcccatcggggacccccgtgactcccagcagtggctctgctcagatcagcacagagctcgttcttctcctgagagtggagcagaggatgtggctccagcaccagccatggcatggacgtcagagagcagccccaggcacctgagtcgggtgcattgtgccccctgcaggtggacggagggaggtgctgactcagggcccacacgctgtgggttctatacagaacacacacttttacttcatttctgtggatgacatagaaacaaacatgcagtctattaacagcggtgattcctacatttgccccaattgctttattccttgattccgcagaatatcctgacgcagaattgtctttctctcgtggaattgcgacgtgtttaggacgtgtgttccccactttcagtgttctgctccatgaacagagatcctgagtagagtacagctgaccctccttccacactgttcctctcctccccacaggaagagcagataattacctgaggctgaatctgaggtgggatctgtcctctgaacctcagagcctgcagagacccccggctgcagattcatggagtcaggtgtttgtacatgtgggaaacttgagctgttcttttgtcagtgaacactccttagaactaattgtgggttcagaattaggacacccattgatctatcacacctcagctcattctgccactcagaatctccagaaattcaggaaatggttcaatttacatgtttgtgacacattgttctcatttcatttagttgtgagtttggtcagcaaaagtgctaccatttatgtgtcccaacctgatgaagctaacttgcttcaccagatgttgggagctcctgaattttatcctaagcccctctctctccacttcatgtgaaattcggtttgacctggaattctggtgtgttgatttagccagatttccccatactgagtgtctgattttcctggatatctgatcagtttccttgtccttcaccataacttgggtgacatctgatcaccctgggctaacttcaacaaaaatcctggcaggttgccttaagcaggatttacctcactcctgatgtttcttcttgattttccatcctttgccccaaccctgctgcatgcctataaatccccacgttctcactctgtatttggagttctgctgaatctctccctcattgcaaaatcccactgccctggtccctacacctatcatgagggccctggataaagtcttccttactgtgctgtagaaagtgtctttgtatatacattttttctttaacaaatctgcctttagtatttcctaattgatcaaggaacctcaaacattgaatgaaagtgaggttttccattttactaacatatgtgtatctgtgaatttcaatttcaatgtgtggtgtccagaagtcctgagcaccaacagttgtgcttctctgtccaattatttgattctgaaacctgggagtcatcccaacacaggtaaatatgtgattttttttttttttttggtttttactgtttagtgactgacttatttcacttacactgaagcttcatgaacacaatgatgaaaagtagagagaggacttgtttgaaaatgccagatttatggtagactttaccacccacgtgtgtctggaggtcttcttaaggttccaagaacaggacatttttcccacaacaagacaaggatgagaacctctgagctgtgaggatggaggacaggcagggccatgtgtggacaaggacgggctgctgctatgtccagggtgttctctactagcaaccactccatctccttcctcactctgtggtatttgtcagatgggaaacatgcctagaatttatctttgacatctggatggaagcccaggcaagaggcatttgacagcttattcgtgagcctacttctttaaggaatgccagatcccttgctctccttcctagttcttaacccctttaactcccttcccctcctgcacccatccactgcctatttacagccacgtccccacacccttcactgtagcaccattttcttgggctcctgggaaacacaacagctttggtttaactcacagctcaggcacactcacgggtcctttcagaggctctcaacttccctcctacagtccctcagctcctcctggggtcctaacttggccatctctatcctctctgctgagcctggccatacacaatccatcccatctggatatgtgtatagcagtgggttaactcagcaggcatgaatagttcaaaccctccacgttcctaaaaaggtaaataactaaaaaataaaaacaaaagtaaacctttgttcatttatggctgtctgttacctcctgggatgagatctccgagtccatgaaatcttacacctgataaaagtgtctgcagatgtctgcagccttgggacatgctgtacgagtttaatcacagtgatttatagtgaacgcctgcttttgttttgctggggagggctgtggtctgagtattgtggtcagttacccaggtgttccatagtctatgattcattccccaaacacagccctggacaagaaaactcaggggcactcccctgggtgttgacacttcacacatgtcatcttacctcatagctggagcattacacatgtgcagaaggctccacagtgggaggacccctgagagcttgtgcctggattctcctgagcttcactctttgtgccttttttttccatgtattttcaattgtatcattttgctgtaataaactgttcctgtgaatacgagttttcatgagtcctgtgtttttactgagttttgagcctgagggtggcagatgcaacttctcaatgcagttgtatcagaagaaggatttcctagagagatcctaagtgacacatggctgaagtattgttcagaaaacataagtattcaggtgtggaatggcaaaatctgatacttgggtggcaacagaattacccggtctgagacagcagctgaactgaagtagatgtctggagataaatgcaatttagaaacgataactcatactcccaaagagctggctcaatcgatacataaggaaaaataaaatgataaaaaataacctaaatatgcaattactatttgtgagaacatccgggagagtgattgcagggaaagtggcctgcgccgacctcagattttggccaatgtcatttctggctgatgggctccagggcactacctaagggagcaattatgctgcaatgacagacagaagcttcgcaagctctctccacccagaaggtggttcaggtggtgaagtgcggggactggtgagccacaaaacactgaaatgagggaggaaagtgagaaagtgaaaggcttttgagctttttctttagcttaataatttttgttaattattaacaaaataattggacaatgactaatgtaaaagtggaccgtgttttgagtcccttagaacggaggagaatgcagcggtcaatgttgtgcccagagattactatagaacaatagtaggtggttgaacatgctccaaacacaaagcctcttgttgctgatgggacagctgccctcgtctactgcacaacagcttctccaaagtgtgtttaccctgagcattgagattgcctttctcttgtaagtgaaaaaatcggaaaactccaaataaaggaggagttgtaacgctctatgtgtaagaaattctaatgtggatttatgataactgggatatgcatccacttatctttttatctgtaaaaattcatgggtgaaagtgcaattttgttacatggatatattgttcagtgatgaagtctgggctttgaggagagtcatcatctggatggtgtatattgtacccagcaagtaatttctcatcccacacaccactcccaccatccaaaccttccaagtttccaatatttattatgccacactctatattcatgtgtgcacattatttagttcttacttatatatgacatgtggtattcaactttattcttctgagttatttaacttaagatagcagcctacagtttcatccatgatactgtaaaatacataatttcattttttattattgagtagtaattaaatgtgtgtatatatattcacaaatatatataatgtatttgtgagggtgtgtatgtgtgtatatatgtgcatatatacatatacaacatgttttctttatccaatcattcattaaaaacacttagtttggtaccgcatatgtgctattgtgaataaggcaacagcaaacataaatgcagcatctatcgaatataaaattcatttttctttgagtcgataccaagtagtggatttgccgaattaaatattagttccatttaataagagaacttaccaacatctgtttcttgtttagtttagtttttatttttgactttttaataatagttattctgactggtttaatatggcttctcgttttgacttcaaattgcatttctgtgatgattaatgacattgattgttttttcatatcctggttgatgatttttatggcctcttttgaaaaataaatgtctgatatttgctcactttttaatgtggctatttgtgctttttgtgttgctttagtttcttgtagattccaaatattagctctttgtcagatgtagtgtttaaaaatatttttcgtcattctgtaggttttctgttaactttgttgattatttattttgctgatcagatgttttgcttcttatttgtattaagtccaaataacctattttggtttagttgtgtttacttttaaggtcatagtcatgaattctttgcctagcacaatgttcagaaaaacacttcctaggatttcatttatgactttcagactctcaggcctcccagtcaagtcttttatccatattggtgtaatgtttgtatgtagtgagacatatgggtccagttttattcttctgcaaatagctgttcagtttttcctgcacaatttattgaacaaggtgacattttcccagggtatgctttttgtctggttggtcacagtcagttggctgcaggcacatgactgtatttctggaatgtctattctgttccaagtatctatggttctctggttgattgttacttgtgtataaaaatcctactggcttttgtatgcttttttatcctttattctaaaacttcactgaattaattcatcaattctaggagtacttctaaagaatattagtttttaagtacaaaatcatattgtcagcaaacacacacaaaaaactgacttcttcttttccaatttgggtgcctttatttctttctggtgtcttatttctctggctaggatttcaagttctatattgattaagagtggtgaaagtgggcatccttgacgtgttctgagtcttaggaggaatactttcaacatattgctactcagtataatgttgtatgtgagtttgtcatatatgatttttattaatttgaggtatgttttccttctattctaattttgttgagggttttttatcataaagaaatcctaaatgttatcaaatttttttttctggacctattgacatgattatatgttttttgtttatgtggtggatcacagttattgagacatgaacgttgaactatccttgcatccctgaaatgaaacttagcagattgtagcatattatctttttgatatgtagttggacttgattttcttgtgtcttgttgaggatttttccatctatagtcatcagtgatattgatctgtagtattcatttttgggtccttgcatggatgtggtatcaggctattagtggctttgtagaatgagttagggagaaaaaccctctcctcgtttttttggaaaaagtttcagtagaattactagcagatctttttgtatattggacagaattcaccttttaaaataatatgctttacggctttgatgttgagatttttttaaattactgcttcgatgtcactaatttttgttggtcctttcaggatttttatttcttcctatttcaatcttgggagattatatatttccagacatttatctattcaccctaaattttctagtttatgagcctggagatgttcatagtagactatgttgatcattatatttctatggcatcagttgtaatcttttcttttttgtttctcattctgcttatttaaattgtctgtctactttacttgcctaatctagctagtggtctgtaagttttgtttatcatctcaaaaacccaatgttttattgtattggttctttgtatttcttggttcttaactttatctagttctgctctggtctttgttatttgttttcttctgctgtgtgtttggtttgatgttgtttttctagttatttgatacgtaatgttaggttgttaatttgtgatctttctttttgatgtggtcatttaacattataatcttatcccttagcacagcttttgctgtaaaccagaggttttggtatgctgtttctctatttttattcatttcacaacatgttacaatctttttaaattttatcattgacccaaagttcattcagttgcaggttgttaaattttcattgtgtgtgtagtcttgaatattcttctagggtttgatttctggctttatattactgtggtctgagaagatatttcatttttaaaaagttattgagtcttttatttctggcatagtatataatccatgtttgaaaatattccttgctaatgggaataatgtatattctgcagtcattaggttaaatgttctgttaatgtctgttaggttcatttggtctagagtccaatttaagtctagtgtttctttgttgattttctgtcttaatgttttgcctagtattatcatttgggcattgaaatccatcacaattgtattgttacctgtgttcttccttaggtctaatagtatttgttttatgaacatgggttttctggtgcagagtgcatatatatttagaattgtcatttttaatcaatcattttatcattatataatgactttctttgtctttacttactggtgtttatttaaagtttttttatatgatatagatagtcttgcttgcttttggtttccaattgcatgaaatatattttttcaccctcttgatcttgaatctacgtatttttaccaattaagtgagtttcctgtcagcagcataaatttcaaaactcttttttattctttccactaatctatatattttaggtgaagaatttaactcatttatattcaaacttaatacagatatgtgaggtctggcttctgttgtcatgttaattattaactagtggctttgtagtcttaattgtgtaatagttttatgagtgaattttataattttgtgttgtttatgatggtgagtactgacctattgcttccatgtctaggtctcccttgagcatttcttgtaggtgcggtctggtgtaaataaatgtccttggcattttcttaccttagaaatactttatttctccttcatttatgaagcttagtttagaaggatacaaaattaatttctgacatagaattttttctttttttttctttaagtagtctgaaattgggagtccaatctcttctatcttataactttatgctgagaagtacactgtcagcatgatagaatttcagataaattattagacacttttctattgtgaattttaggatttttttcttcctatttactttagatagtctgaggactatagatcttggtaatgtctgtcttccagtgtcttctcatgtagttttctgaaccacttttatctgcatatgcaaatatctagcaagactagtgatgttttcctcaattacttcatcaaattggtcctctaaaactttttactaattttctccctcaggaatatccatgattattggctaagttgttttacataatcctatacttcccaatgattttgttcatttttttgttattttcatctgactgggttaatgcgaaatatctgtctcttaggtttgatgttctttcttctttttagtgtagcccattgtgaaagttttaaactattttttgtaattaaaattcaatgaagtctttactccctgaagctttatttttaaaatattaaagtcttaagtaaatcttgaattgttctgatttttttttttttttttttgacacggagtctcatactgtcacccaggctggagtgcagtggcgcgatcttggctcactgcaacctctgcctcccgggttcatgcaattctccttccttagcgtcccgagtagctgggactacaggcacacaccatcacacccagctaattttttgtatattgagtagagacagggtttcactatgttggccagactggtctccaactcctgacctcgtgatctccgctccttggcctcccgaagtgctgggattacaggcataagccaccacgcccggcctgagttattctgatttatttgtgttggttctcaaatttcttttggatttaattgagattccttgaggtcaacattttgaattatttatctgacatttcaaatatatcatgttgtgtaaattctatttctggagagttaaggtgatatccggcgtcttgtaattgtgttttttcatacttccacaattgcttacctgcttgcttttcattggctaaactatctcttactgtttttgaattcattttgattttcatgaaaatttcattccctttagaatgtgaatataacgtatattatgtgggtcttttgatttggttcttggtttactcattggcaaaggctctgtaagagtttcttgtatatagatagtcattatttagtggctttctgaaactatggttgtagtaataatctactgggcctgtgagcaggctcactgcctcctgcaggccctaaatagtggaggcctcagaaaccatttcttatttgcaatgcacttgtttcagcacattttatattgggatgttaagttcacctacacattagtatgtgtccttacagatttgagctgactgtggtagaagcagatgagtacatgcttgatatctgtacacagggagaagctctctgttgcctcaggcgatggactggtctatgaagtgcacagtgacttgagttctctgatcagcccctgagtgggggatgaagctggacagagatgagccaccgagcctggcaagcaaaagcgccagccttgatggaaatggcgagctgaggggcatctactcagtgtggtttcttttgttattaagagctttagtgtggtggctttttcaaattcccgttgtagtagtaacatactgagcatgtgagcaggcccgcggtcttttgcggggttggaatcacagaagtattgagaagctaatctcattttcaactgctgtacactggtggtattgagtttgtatgaggtcatgcagtttgaacgtcaggccagtaggtggtgctcgcaggtaagagccggctatggtggcagcagaagggtttatgctttaccggtggttaaagtgggaaatttgtcatgttccagatcttagagaaaagacttttagctatttctcattcattataatgctgcctgaaagtctctcgaacataactttttattatgtcgagatgtgttctttctatacccattttttacattttttttcctgaaaggatgttgagtttcatcaaatgatttttcagcatcaattgaaaaaaactatatgtcgattaaagatctaaatgtaaaatctaaaactataaaaactctggataataacctaggaaatacaatttaggacattagaactggcaaagacattatgaagaaaatgcaattttaacaaaatcaaaaaatggcaaatgagccctaagtaaactaaagagcttctgcatagcaaaagatactatcaacagagcaaacaggcaacctaaagaatggaaaataaaatatttgcaatctatacatctgacagggtctaatatttatagcatacatgcaattaaacaaacatacaagaaaaaaagtgcccaaaggacatgaaaagacacttataaaaagacctacatgtggccaacaagcataggaaaaaatgctgactatcactatcattagagaaatacatattaaaaccacaatgaggtaccatctcacatcagtcagaatggctaatcttaaaaaaataataacagatgctgctaaggttgcaggaaaaagggaacatttatacacttctagtgcaagtataaattagttcaaccattgtggaaagcagtgccatgatccctccaataacctaaaacagaagtttcatttgacccaacaatcctacaactggacatatacctaaaggagtataaacgtataggttcattccagcactattcacaatagcatagacatggaatttacctaaatgcctgtcactggcataatggatagagaaaaatgtgatacatataaccatggaatactatgcagctaagaaaagaatgaaatcatgttctttgtaggaatatgatggaactggtagtcattactcttagaaaactaattcaggaacagaaaaccagatactatatgttctcacttattttttggagataaataatgagaaatattctctcagggcctgagtcttccatattcaaaaaaaaattctaaaataagtgttcaacaagttgccgacatgcctttaaatatcctgtttcatctggaccccttatatcactcaataaagccatgagaactatatttaaaagtgggattctatgataataaataacttaacagtaagaataggaaggatatggatggttttactaatttaatgggtacataactgtggtatacactatattcctatgaataagatattctgatttcagagctaagtattgtttcctacgttgtgtgtgtgacttggttgtgttggatttgagagtgtagcacgtgcacagaccatgtggatcagaaatccacatgtaaagatgacaatctatggatgtgaactacaagtatgtaagtacttcaagtaattctatttaatggagtttgaaataaaactcaaacttattcaaaacactaattacttggtatttattttgagatctatgagtttatcaagaaattcaaattcctatttctatttaaactcccgattcctactctcagtgggagggaaaactcacagccaatcacacatcacaggacaaatctgtaaacgaagagtcattcctctgaaggtcctgggtgttcaggactctcaggcaggtgctgaggaccctgtcttgggagtgcccagcagatctcagaaccctacatggggcctgctggacactcatgtgggataactagtcgccacttattcagagttaccagtgagctttgactgttccgaatgggaccagcatggagtcaaggtgcctgctcaatgtcagagacagcgatggtctcagaaacaatccaggtaatctctaggccaataaaatgtggattcacagtgagaagtacatcctggaggtggagcttgttcttcagtgggaagagtgctgtgcacagaaagcttagaaatggggaagggggtgcgtttcctcaggcaggattagggcttcgtccctcagcgtcccactcttgtatggctgatgtggcatctgtgttttctttctcatactagataaggctttgagctgtgaaataccctgcctcatgaatatgcaaataacctgagctcttctgaggtaaatataggtatattggtgccctgagagcatcactcaacaaccacatctgtcctctagagaaaaccctgtgagcacagctcctcaccatggactggacctggaggatcctcttcttggtggcagcagctacaagtaaggggcttcctagtctcaaagctgaggaacggatcctggttcagtcaaagaggattttattctctcctgtgttctctccacaggtgcccactcccaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagaggcacagtgtgaaaaaccacatcctcagagagtcagaaaccctaggggagaaggcagctgtgctgggctgaggagatgacaggggttatcaggtttaaggcttttttgaaaatgggttatatatttgagaaaaaaataacaatagaaacaagtacacactctaattttaagagatatattcaattcaagaattgtagaagccgaattcacagtgggaaaggccacactcaataaagttgataaaaacattccaggaaggtgctactgtgaacaagttttcaaattagatgaataaataatttggagcaatgttatttgatcatgaggtgagacagtatgattcttaaaaagtggaaaaaattctttcaaatgtttctgccactctttatcataaaattaattttagagcagttttaggattacaatgaaattgcacagaaggcatgagaattcccatgactccctgccctacacaggcagagcctcctccactatgaccatccagcaccacagtcacaaatcagttacaatggaggaatctccaaggacatttgattctttcttttttggtgatgccctaatataacaagcctaatttatctcggaataccacaagttttgttcagtggatttctaggaatcatattagttagagggaaagttggtgaggctcttactatttgaactcattcttccaaaatccacaaaacatatattaatttaaagcttatcttacttctggtttacaggatccttcccagagagtaagatttttaagattttagaggcaggttcatgtctctaaaaggccagcaagttctggggaatcccataatgaacatcctttcatgggaattggagaccctggcaatgagagactccatgtataatgccctagagttggattagatgcactgtgagctcttgggtggtggttctgaaaaaggtggtctgtgcagtaaatgcaaacacatgcacgggacacaggaaggagcaaaagcttccctttacaaagtgtgtgggcacctggaagaaaccctcacaagggcacgtctcacccttaatgactgcacattagccaggggcatgatcatgattggtcttacaaggaaagagcaccactgaggtcataggttatgaaaatgtcatcctccagctgagaaattccatctgctggcatgtgcgtgtcaaccccgtggagggtgcactctgggagttgacgagatgcatagaaacctcctgtcatgaattatcgtctaccacacagtcagaatcaacctgtgctccagaaagagatacatgcctgtagaaataaacagagcttaaggattttcttacctgctgaatatagtgcccaaaaccacactttcaggaagattagctcagaaatgtttacaaagtgactgaagggcagtggcgggtgaggtgatgggacagcctcagggctgcacttgaggagggctccctctcccatgcaggcttttcctccaggagctgcatcaggaactcacagaggataagggagaattctgagaacatgctactgtggtactgcctagagaggaaggataaatgatgacaaatacatctctgagtaacatatgggcatttgttcatgaaaactgttttttctgaaagcttatgaaggtcttgaaatgcccctgattagctgaggacaaacatttaaaccctccttccacagggagttcaagcaggctggatgtgtcctgctatggatgatcttccccagccccttcctcttcccagctcatccctggctctctgtgtaaaaagttttcatcagtggaaggtggttgatgaagtgaggtcttcaatttcctcatcttctctgtggtcatgttattttcctcatctgaggtttaaaaactcacctgcatgcagcacatgacaggctaaaatctcttgtggacaaaacagtaacaaaggcacccaccatggttgagcacccgtgttgctgacagtgaccaccaagggtcaacgtcctcttcacaatcctgtgtcagagcagcacttgagtgatttcactagcaacttcccaggagaatcggcttaaaactacttgtcgcattttccatacagatataacacatctattttcctgaagaaatagaaagagctgaatgctgaatacactgtatgtctgctggttctgcaagtttgtgactatcactttctaatttctgatctgtgtggaccaccctccagatttttctcactggtgtgaccagccttctggatgtcaaatataattaactttttttcatataaaagtcaacacaagctcctcatggtttcggtgctcactgactactttaaacttacacaatatgtttctttattagttttgttttctggtatctctactcagcatcttcaacacacccatgttaagatgcttgtacaggtaattgttaattttaaatttactggtgtttagtttaattaaataggcaggcaatagcttagaatttagaaacaacaatgtaaaggaaaagtaaatgcaataaaatttaacataagaaaaccagcagctgaaaggaagggaaatctattctgccacctaagagggtatggtgacctcatagtacaacgaacttctgcagtttaatcgatactgctcacaagtgatagcattctctctctttatatcagagcattccctaacatgtacaataaagagtgagcagatacctccaaccagactgaccagtacctctccctgagtgcctcagctgatagagatagacatcacatttgtctaacaaaataattacaggctgtaaggatacccaccagtcatatggagataatttgaaaaacttagtcaaagcccaaaccttataggtagtcatttatacttagaagaattaactcttatcttcacatgtatttttcttaatcatagagaagctactagagtcactgtccaagttactgaatatcttattcctagaatgagacattgcacaatgtgttctgacatgagggaatgtagctatagttaaaggataggagatgtgatcacggaaacacgagtctgcgatccagcagttctttctccctcacatttgcccagaaacaaagaccccagcagaaaaatggaagggttgacttcagtctccaaagtatgatgtgagatatacgtcaggtatttcatgccattgttttatagtaggaaatttaatctctaaagaaggtcattttcaggataatactattctccaggatacttaaatgcccgaaaacagagagcgctacagtgcccagtgtccaggagctacctggcacgggtctggaaaccagtggacagaaatatcagtttctcttaccacatgtatgttggaaatttgaagaatgtttctttccttcttcgtaatcataggctgcaatggactggaggtcccagtacataagaggaaatgtgtctccagtaggaacacaattagtcccataaaataattgtgctcacactgtggtgcccacactgttggaccagctgactgagaaagtgttgtaagagctgcagtgtctactgattcctatcatatttggggctacattcgcagctaccaacggaaagagagagaagtaaaactggcttaggtagagtctatggatttgctttctttccttcaaactgaagtaaaaaaaaaaatcacatcaactaaaatggggacgatgatgaagtgatcaaggacaagagccactcagtgttttaggtgggttttaacctaaagtcccacaacatgtgagaacctgaactctggagtccggggcatctctggggagaatgtggaaggtgggcgggaggaaacagtgattcatgtctagggaaatttcagggctacctgctctgggggaaaggaaagcctgagcctctccgacagtgtcctctgttaaaattgttggctgacttattgtattcttcaacaccaatatttttttagtcctcttttaattttgtttttattattatactttaagttctagggtacatgtgcacaatgtgcaggttagttacatatgtatacatgtgccatgttggtgtgccgcacccattaactcgtcatttaacattaggtatatctcctaatgctatccctcccccctccccccacaccacaacagaccccagtgtgtgatgttccccttcctgtgtccatgtgttctcattgttcaattcccacctatgagtgagaacatgtggtgtttggttttttgtccttgcgatagtttgctgagaatgatggtttccagcttcatccatgtccctacaaaggacatgaactcatcattttttatggctgcataggattccatggtgcatatgtgccacattttcttaatccagtctatcattgttggacgtttggcttggttccaagtctttgctattgtgaatagtgacacaataaacatacatgtgcatgtgcctttatagcagcatgatttataatcctttgggtatatacccagtaatgggatggctgggtcaaatggtatttctagttctagatccctgaggaatcgccacactgtcttccacaatggttgaactaatttacagtcccaccaacagtgtaaaagtgttcctatttctccacatcctctccagcacctgttgtttcctgactttttaatgatcgccactgtaactggtgtgaggtggtatctcattgtggttttgatttgcatttctctgatggccagtgatgatgagcattttttcatgtgtctgttggctgcataaatgtcttcttttgagacgtgtctgttcatatccttcacccactttttgatggggttgtttgttttgttcttgtaaatttgtttgagttcattgtagattctggatattagccctttgtcagatgagtagattgcaaaaattttctcccattctgttggttgcctggtcactctgacgatagtttcttttgctgtgcaaaagctctttcgtttaattagatcccatttgtcaattctggcttttgttgccattgcttttgctgttttagacatgaagtccttgctcatgcctatgtcctgaatggtattgcctaggttttcttctagggtttttatggttttaggtctaacatttaagtctttaatccatcttgaattaattttcgtataaggtgtaaggaagagatccagtttcagctttcctcatatggctagccagtttttccagcaccatttattaaatagggaatcgtttccccatttcttgtttttgtcaggtttgtcaaagatcacatgcttgtagatatgcggcattatttctgagggctctgttctgttccattggtctatatctctgttttggtaccagtaccatgctgttttggttactgtaacctcgtagtatagtttgaagtcaggtagcgtgatgcctccagctttgttcttttggcttaggattgacttgacattgcaggctcttttttggttccatatgaactttaaagtagtttttcccaattctgtgaagaaagtcattggtagcttgatggggatgtcattgaatctataaattaccttgggcagtatggccattttcacaatgttgattcttcctacccatgagcatggaatgttcttccatttgtttgtatcatcttttatttcattgagcagtggtttgtagttctccttgaagaggtccttcacatcccttgtaagttggattcctaggtattttattctctttgaagcaattgtgaatgggagttcactcatgatttggctctctgtctgttattggtgtataagaatgcttgtgattttttcacattgattttgtatcccgagactttgctgaagttgcttatcagcttaaggagattttgggctgagacgatggggttttctagatacacaatcatgtcatctgcaaacagggacaatttgacttcctcttttcctagttgaataccctttatttccttctcctgcctgattgccctggccagaacttccaacactatgttgaataggagtggtgagagagggcatccctgtcttgtttcaattttcaaagggaattcttccagtttttgcccattcaatatgttattggctgtgggtttgtcatagatagctcttattattttgagatatgtcccatcaatacctaatttattgaagagtttttagtatgaagggttgctgaattttgtcaaaggccttttctgcatctatcgagataatcatatggtttttgtcgttggttctgtttatatgctggattatgtttattgatttgcatatgttgaaccagccttgcatcctagggatgaagcccacttgattatggtggataagctttttgatgtgctgctggatttggtttgccagtattctattgaggatttttgcatcgatgttcatcagggatattggtttaaaattctctttttttgttgtgtctctgccaggctttggtatcaggatgatgctggcctcataaaatgagttggggaggattccctctttttctattgattggaatagtttcagaaggaatgctaccagctcctccttgcacctctggtagaatttggctgtgaatccgtctggtcctggacttttttaggcaggaatttccttgtcctaataagcccaggagtgctacaggagaccagggcttatttcatccctcagcggcgaccgtaaaagacagccatcccgaaagcagccatttcagaggcctcccctcagggatgcattctctttctcagggatgttccttgctgagaaaaagaattcagtgatatttctcccatttgcttttgaaagaacagaaatatggctctgttccacctggctcaccagcagtcagagtttagggttatctcccttgttgcctgaacattgctgttattctgttcttttttcaaagtgcccagatttcatattgttcaaacctacatgctctacaaacaatttgtgcagttaacgcaatcatcacagggtcctgaggctacatacgtcctcctcagtttacaaagattatgggattaagagactaaagtaaagacaggcataggaaatcacaagggcattgattggggaagtgataagtgtccatgaaatcttcacaatttatgttcagagattgcagtaaagacaggcataagaaattataaaaggattaatttggggaactaataaatgtccatgaaatcttcacaatttatgttcttctgccatggcttcagccagtccctccgtttggggtccctgacttcccacaacagtttattaactttgtatgactaataatgtaaaatgttccccatatttttagcaatgttttacttatttgtgaaaggtgtgtttattaatttttcattttaaggtgtcacatttatctttcttgtttctgggatttcattctagtagatatagctgaatgcattttaacaattattgtaatcatctcacattttatatttggatttgcatatacattttattaagattttgattttgatataaaatattttcttacaattgtctcttttctatttttatgagataaaattaatgtatgcataattgcatacatcttcaatgtacagtttcagggtttctgacatatgtgcacacatttgtctccagcacctaagttaggatgaggagcaggtcagtctccacaacaagtgtcctcttcagtgcttccagtcagctctcacataaggatttttatttaatttcaagttttcattttcactaatcatcagagaaatgcaaatagaaaaacgttctggtttctgtcactacagttcaattttttcctgttttgggcatcacataaatggaatcaaatgttatagttcattttttgtaaggggctacttttgctatttgtgaggttcattcatgtatttgcatctaccaaggttttgtcatcatatatatacacacacacacttatatatgtactaatgcacatataggtatttcatatctcaatcagtccattacgttaataaatgacagtttattaagtaaatccattcattaagtgaataagtgacaaaaaatatatctattttcctgttgatggaatttagtttccaaaataaatatcgtaaacacatctgttataaatatctttgtacaagttcttctgcttatatctcccatttttattgataaaatatgtataaatataagtatgcattataacttttcagctttatggagctataactgacaaataaaattgtatgaatttaaggtacaccacttgaggtattgatatacatggggaaatattcatcgtgatcaaagtaattggcatgcctatcatctcagagaatatcattttatgcctttaatttattgtgagtctgtgatgaaaacacctaagatctactcttctggaaacagataagtttataatataatattcattagtatagttacattgctgtatgtttcatctccagaactccttcaacctgtgtatcagtccattctcaaactactttagagaactacctgagactgggaaatacatgaagagaagggagttagttcactcacagttctgcaggcttagcaggaacttatagggaggcatcaggaaaattacgatgattgtggaaagtgaaggggaagcaaggaccgtcttcacatgctggcaggggagagagagaaagagcaaggggagatgcgccacacttttaaacctcaagatcttgtgagaactctaacacaagaagagcaaaggggaaagccgcctccatgattcagtcactccccatcagacccctcctacaacacttgaggatgaaaatttgacatgagatttgggtggaaacgctgagccaaacagtatcattatacccggccactcacaaatctcatatccctctcacattgcaaaatataattatcccttctcaacagtctcccagtcttcactcaattcagcattaacacaaacttctacagtccaaagtctcctctgagacaaggtaagtttcttggatgtataaccctgtaaaataaaaaacaagttagttacttccaagctaatatgagatgaatgcactgggtaaatgttcccattctaaatgggagaaattggccactacaaatgggctacaggccccatggctagtccaaacactagcagggcagtcatcaaatcttaaagctccaaaaaaatttccttttactccatgtctcacatccaggacacgttgatataagaggtgatctcccaaggcctttggaagctccacccttgtggctctgcatgttagactccccatagctgctttcataggctggcattgagttgctatgtcttttccaggcacaccatacaagctgctggtggttctaccattctggggtctgaaggacagtggtcctcttctcacagatccactagacagtgcccaagtggggactctgtgtgtggaatccaacaccatattttccttctacactggcctagtagaggtactccattagagctcagcccctgcatgagacttctgcctggatatccaggcattatcatacatcatctgaaatctaggaggaggttcccaaacctcaactcttgcctcatgtgcaccagcaggctcaacaccacgtggaagcaaccaaagcttagggcttgcaccctctggagcaatggcctgagctggaccttgaccccttttagccatggctggcacaggacagacagggatgcaaggcgccatgtcccgaggctgcacagagcagtggcgtcctgggcttggacaaagaaaccatttttctctcctgggcttctggacctgtgatgggaggggctgccacaaagatctctgaaatgccctgcggacattttttcccaccggggtccttgttacttatgcaaatttctgcagccagtttgaatttctccccataaaatgaggttttttgtctaccacatggtcaggctacaatgttttatcaaacttttatgctccgcttcccttttaaacgtaagttccaatttcagaccatctctttatgaatgcacatggcttatgttttcagaaacagccaggtcaactcttcaatgctttggtgcttagaaatttcttctgccagatataccttaaattatgtctctgtagctcaacatttcacagatctctagggtagggggaaaatgccactagtctttttgctaaagcatagcaagtgtgaccttcactccagttcgcaataagttcttcaccttcatctgacaccacctcagactggacttcattgcccatatcactatcagcattttggtaaaacccattcaacgagcctctaggcagtttcaaacttttccacatcttcctgtcttcttgtgagcactccaagcttttccaacctctgcccattacccagttacaaagtcacttccacattttcaggtatcttaatagcagtatcccactcctggtgcaagttttctgtattagtccattttcacattgctataaagactacctcagactgggtaatttatgaagagaagagttttagttaactctcagctctgcccgctaaacgggaagcattattgggaggcatcaggacgaacaatgatggtggaaggtgaacgggaagcaagaaccttcttcacatggtggcaggagagagagagcaagtgagcggggaggtgccacacttttaaaccatcagatctcttgagaactttatcacgagaacagcgaagaggaagacaatcccatgaccaaatcactttatcttaggcccttccttcaacatgcagggtctacaatctggcatgagatttgagtcggaacacggagccaaaccatatcaaccttcataacgggaagtttttaccctttgaccaacaatacccaattttttcctcctcccagcccctgcgacctactattctactctgcttccaagagcttgaatattttatactttagattctatatataaatgagatcatgcagcttttgtctttctgtgtctggcttattccacttagcataatgttttctatttgttgcaaatataagaatttctttgtttttaaaggctgaataatactcagttttatgtaggtataagccacattttatctgttcattcgtagatggacattgactcgttttccttatctagactattatgaataatctcacaatggacatagatttgtcacactcagtttattttctctagatgtatgctcagaagtggggatgctctatgtccagttcactgagtaatcttcatgttgtttttcatactggctgtaataattcacattttgttccaaaccatacatggatacctttgtaccacatattcaggtctttgtgtaactcttgaatccatttttagctgatttctgtgtattgtgtgaggtgagttctatctatttcttctgcatatggatgcccgtttttcacaccactcgttgaagagactgtcctttctctactgtgtgtcttgggaacttgacaaagatcagtttattaggaagaaatgggttggtttccaggttgtgtttaatgttccattggattatatgtctgtttaaatgccagcattataccattttgatttatatagatttgattttgaaattatagattatgatatattcagctttgttatttatgcccaaaattactttggctatttgaagtcttttatatttttatataaattggagctttttaaaaacattttgtaaaatcatgccatggagattatttatttattttattggcatatagtagatatacctattttatgggaacatgtaatatattgatacatttataaatgtgtaaagattagtgtaagatttacatatctgtcacattaaaaatgtaccctttccttgtgctgagcacatttgaatgactcctttcgctattttaatgttgtgcattagattattattaactatagtgaccttactgatctatcaaacatttaggtcttatttctcctctataaatgtatatttgtatacagtaatcaacctctccttatctccttctctcttctatccatccaggattctggtaagcaacagtctattctatcttcaggcgatccagtattttagttttgatgtaaaataagaagatgcaatatttgtctctcttttattggcttatttatcttaacataatgacttccagttccattcatattatagcaaatgacagaatattgggtttcatggctgaataatatcctatcgcatacatagattacatttactctatccatttgtccacctacagacactgaggtgctttcacatctgggctattgtgaaagagctgcaaagaacatgggaggggacatgccttcatgaggtggtggtggttttatcttctttagaacatacccagaagaggatttgccaagtcataaggtatttctgtttttaatttattttggaatcttcatactactttgcacatagtggaaacacaaatggagtaaacattaaaaaagcagtttcggttttgatgtataatccagaaacaaataatgtttgaccatgattctcattaggagtctctaatggatctggtggaaatgcaggaagttttctaaccttgttcaggaaattatgagtttgcacctttttctttttgaggcttgaaattggcatgattcatgatgcatactgttgggaggtttcagaatgatatggcaaaaatcataatgaaaaggcaagacagagagagagggagagagagagagtcaggcctagaaagagaaaaaataattttctcaacaggagaaagtgctggatatctgtatcagtgttgagttttgctcatagacacatctgtaccgagtgaggaaccatgaagtcaagggaggggtctagaacttgttcaagtgaagcatcagcatatttctcacaggcaccaatttccaccacatcacaagggtgatgcatttttgaatgccattaaatatgagttcacagtcagtaatcatgtttccatgaaattcagttaaaataccaagggtgtgtccagatcactcatgcacaaatacacaaaatttgctttttcatgtgtggctatctagagacaaagtgcactgaggagacttcagcaggttacagagatttgcttaagtttggaaaaccatagaagagtgcctttaagtgaaggttggtatataaattaaataggtcaaaatcccctctatggagtagcgttccaattgtgtggaatttttaattccttattcagttgtaaaacataatccctaggactgactccgtggagttttactgctgtgttgacaaaaatatctaacaagcttccttccagtgtttcaagggaagtttttctctaaattttttccaatgtataaattttcctggctaaagatagtaaaaggctgttaaaaacacaactggaatggcagctttaatcttttgctgattgataggagtgagcataatacatgaatctctttgagtgttctgcctcatccaaatacaataggtcaaaggctagtactggaggtaagatttccaaatgtgtttttttccagctaccaagtcataggaaaataacagatacatccttgagacagaggaccataatgccacaatgctggtaggagtacatgtagacaagggagttcaagggtttcttaaaactgataattttaatgtaagaataccattcttttaaacttatgtggaagactgtgggaggttataacaatgccatattttagtatcagccctgcctcacagaatcattttataacagttcctttcatgagtgtgcttcactcggttcatgcaaaaacctggcagatcacaggctaaaaacagaaaatatagaagcttttaatcaactgaaagagctgtagcctttgtcaaggaattattggaagacacagagaacacagatagatgataaataaaatacattcatatcccgttaagtgtggaaattgaggaaagtttacataaatgtgtccaagtggcaaactgtttatttaatctggtaaccaatttttctataaattgtagagttgaaatgcaacaaatacatatttgaaatgatctggcacaaattaagcaaatatggtaactatgtattttcactcatttttatttaagatcagcggctcagcattgatatttttgataatatctgtgactcagcagctttaccttttgaggatatgatctggtatggcagttttcttagcttcaatgttacctctttttgcattgacttccacctttatatctgccaggaatctggggaaaaggagtgcctgtaaacgttccctaacttgcccattttggtgggttttccagaatgtgtgagatgctttttttttttttttcaaagcatcctgaacccatgcactgccctgaaacatgtttatttcctagtttaacaaattggcacttctaataaatgcaatctcttctgccatctgtgctgattttacatcagatagaggactgtgttctaaaggaaatcttatattagtaagagcaattttgtcattaacctagagttttattattgaggtgtgattcataacatataatattaggtagaggttctcagtggcagtgtctaaatctcttgggtgtacagtgtcttccccgttaacatgaagcatttacgagcacagtcatagtttccagccatgcttctccctgtctcacaatcaccacaaactaactatgaccacaactggaacttggtgagttattctttaataagttttaagtttgtctttaatctttatgcctctagattattatgtgagacataatctttatgcctctagattattgtgtaaagctatttcagaagaaagttaaaaagaacattttaactgactaaacaacacaggaaatcattaataaaatgcaaagtgtagatgtgagaggctccaggcctggataatgcaagagttcatgtatgcaggcagtttctttgcccaattatactgatacaaccagcatgtcagcttcatgccccatttgactcctattatgcaagcgcatggaaatgacatgctcaagggtcacacacagatatgaaaactggtgggagcaggagaggagacgactctgcacttctcctctgaaggaccaggaaagcctggacagaccatctccccagcctccatgactgcgcgacgtgcccacatggacactcatctctgacaagataagaagactccattgatgaggctgaacattttatgatttaaattactagagacttacattgaggtttcaataactaatttttataacccaaatttacttacccccatgttgttacctctttcttcagtgaaaaattgcttttgctgtaattgagttttaggaagattcccagtgttcacaactgagcttccaagagagtgttgagaacaaaaactgaatgagggcagagaaacccatctttactgtgttcaccactaaactcaagtggactcggcactgcctttgatcactgttgcttctctgcagagttcaggtttgtatttctcacaattctaacacagactctccctctcctcaaaggtttggcctccactggctgtaaggtcacactgttctgaatttcttgtctgaaccgttttatgagggtggtgatgagccatttaatggaaattttatatcatctcagcatgaatcctatgggcggtcacgaattattattctgattatggtaattgatttttctcagcatattcattactagtgatattcaaaaaccctttttatttaaatctttgatgcttcatttttgttgctatgacactttttcttctactgagtcttcccactagcattataacatgacctaatatccagggctcagttgttatataacaaccacatatgtcaaaagctatgcattcttttcacagcagacataattttctcttttctggagatgaacacacactggctgagctacccccactcacaagaacatatggaaaatcatgacatttttatttacttgactaataaattatgtcattctctcttcaaattctttatcccccagaatgccatgacaaactcttctgcatctgttcaaaccataaactcagaaaccacatggtgagtaaaagctcacttgattcgggatattgggtcaagctcttcccctccaatgtcccacagcattgggacctcagcccacctgtccaggttctatcaagagagtttagctccttcacagtgaaggaaacaattgagttaagagggaacctgcagaagatagacaatattgaaaaccattcatatgacaagggattactatcaagcatataaaataaactcaacccaactgcaaataataatgtggctaataatggaggaataacattaatacatatttctcaaaagaagaaaagaaaaagggcagatagatgatagatagataaatagatatattagtatgtatacatacatatatcgctagaaaacactaatattcaggaaaatgcacattcacaatgagatgtcttttcatcctttatctttgcttgagagtcagaaaatctaaataaataaataaataaaacaggagctggccaggattcatagaaagggaaactcttatagaccattggtggaaatggaaattagtgaagccatcatgggaaaaaatagaactaccatataattcacaatccaactgctgagtatgtatctatttaaatcattaaagtaaaaaactaatattgaagagatacatgtacacccatgtttattgcagcactatccaccatagctaacatatgaaatcaacatatgtgtccatcaacagatgaatggataaataaaatgtgttatatttacacaatggaatattgttcagtcttaaaaatgaaattctgctgttagaagcaacatggatggaactggacaccatcatgttgagtgaaacaagacagacacagaaaaataaatacagcattttctcagtgttatgtggaaattttaaaaagttgatcttctagaagtaaataatagagtagtggttatgagatgccgggaatgggaggagactgagagacaataagaggtttgttaacaaacgtataatttacaggcagataggagggatgtgctccagtgatctacagtgcagtagggtgactgctgttaacaatatagtgcacattttatgtttacaagtagccagaagacagaaatttgtatgttaccaacaaaaagaaatgttagtgtctaagctgatgaatttgttcattgttctgatttaatcataccacatggcacacatgcatagaaatatcacactgtaccccatacagttattatgtgctaactttaaaaaatcctttaattaaaacagattttatttgcatacattacaaatgcttcaacacagagccaggaataaataccatttttctttgaaatgtgaatttcctaacaacgtagttacattcatttgaaccaaaccgtgtatttgatcatggtaagaatagacaggcttatgcatagaatgatatattttaattttagacttctacttaataccataaattcaaataattttaaaacaactaagtaaaaactataaagttgaggaaatgtgtacgtggtgtgtgatgtgtgactttttccttgcgcaccactctgtccatggtggatgtgtggtgtgggtgtctgtgtctatttctgtttactctgcttgaggttctctgtgattctaggatctgtagttcagtgtctttcacaaaactgggaacgttcttagccattatttctttcaaatactgtctctgtatctacaatttctcctttcagatttaaaatgtacatatacaatactttttaatattaatgtttactttcttcactctcttttccttgcactttactctgtaaaatttctagtggtattttaagtgagtggtttcatttaaaaggtgagccagctctactgaagggtgtgcccaaagcttactcaatgtttatactgcattgcttttgatttcttatgcatttccatttgattttttcttagtattttcaactctcagttccctatctagtccttcattatgtatacagtttccttaatagatttttacatatgaattatagttactttatatatcttgtttaattagatagttctaagatccatatcatatagaagtctcattctgatcatttgtttattatgactttggtatttctcattaatatatgtaatctttgttgatagccagatattttaggttggacagttgatattggcttattacttcattttatgcattttctgcctgtatttgaccatactttatttttgccaggcctttaatgtggaaatgtttgaatcttctcagagctacatttgacgtttacttttgcagtagacgtcatagttgaagtctgttcttctgtgtccaccagagacttcagatcctccagtgataccttgtttttctttcctgcttggctttgtctcttcaccctgttccttcctccagagaatctctttcagctccttcaggtggattaagatattatattgaactgacaattgtgaaattggtggaaggcaatagaataaagggagattttctgacctttcatgggtctatatttctacgaaggcattgtgaccctgagtctgggtgtgacattgccggtgtttctgaacttctgccagatgagatgttggtctgtgtgttcttgctgttttccctgctgtggagtcctcttgttttccccagttgttccctcccacagctccaatgttctcttttggtgttatcagcttccagagttgatgacctgacctagagattaaggctctgattaaataagaaggaggggagatacttctcaatggaacttaggtgaagacctctttttccatctcagttcctaagggatggccccagtgcccctaagatcctggctttggtggcttgctcctgcagagtaatttcttagttctgcaatggggattaaggaggtgggtctgaatgcatttcagagtgtgggctctttttctctcccagacagacacattgggacaaaagatttttgtgactgtccccatttttgggaaaaaggtttcaaggtataggaaagctcttcagtatgtggtccctgagaaattcacgctacaacacatttaccacacttgacttcaccaattcagtatgtatgtatttttttctcttataatagcctacatttttatatgccagactctgcctcagttcaactcatacccatgcctttttactctctgcaagaacttgtctctccctaaatttcggatttgatgattatcttaaaacctccagtatttaaagtatattttaaaattggcaaaattccatctcctgtgtttatctgttatgttgatgctgtaaaacagtaagtaaaatatactcctcatctatgtacattttgaagctgagttgcaggttttttggtaagacccagagtcacagagaattcaaatattgttaagctgcttaatagaaaaacaaattatggtaaatgtgttcactggaatactacccatgatttataataaataaatgcctgacacacagaacagcagcaaaaccacacatgctcttattacagaaagtggcttctgaaaaccacaccgggcacgtacagctttgtcctggagttggtttagggggatgtcagagccagtgacgagaagcacagggccagatggcagcgttcactcatcccagacatgagctcctggatgcatacagagcccccccatgtgtgggtttacttccacttctgtaaaaggagaaaatactgactcctacagagcataatttacacattttttaaaaaatgtaatagggtgatcagggcaaagtgtttatcacagcacaatttcataagacagcatattttccaaataccatcattgtcagcaaacttctgcagagcaccgtcttcttatatgggtacagcctattcctccagcatcccactagagcttcttatatagtaggagacatgcaaatagggccctccctctactgatgaaaaccaacccaaccctgaccctgcaggtctcagagaggagccttagccctggactccaaggcctttccacttggtgatcagcactgagcacagaggactcaccatggaattggggctgagctgggttttccttgttgctattttagaaggtgattcatggaaaactaggaagattgagtgtgtgtggatatgagtgtgagaaacagtggatttgtgtggcagtttctgaccttggtgtctctttgtttgcaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagacacagtgaggggaagtcagtgtgagcccagacacaaacctccctgcaggggtcccttgggaccaccagggggcgacagggcattgagcactgggctgtctccagggcaggtgcaggtgctgctgagggctggcttcctgtcgcggtctggggctgcctcgtcgtcaaatttccccaggaacttctccagatttacaattctgtactgacatttcatgtctctaaatgcaatactttttttgtcctttttgtttctttgtttttttgcaacaggagtacatatcctcagctccacagaagccagggtgtcactttgggggcagaaataatcgtttcgtggtcaacaggatgagagtcctgaggaatcccagggaaacctggagagtgttttccaattagactcagggcagagacctccatgggaatttctgattagaacgggctttgagctctgatgggagccaagagacaggctcacccagggtcggggtccttaaagcctgatggttttcacagctatcccccctcgtcttgtaaactcagactgattcagttgaccctttttctgctaatccattttgcttctctgtaggtttgattctcacagttcgctttcttcttctcttccctgagaacaaacgatgtgttttctgttttcagggaaaatcccagggctcaggtctgcaggacctgggtaggctgaggagactttctcactcaccattgtctggacactcctgttgtcttctgtgcatggaggcatttgggaaatgaagtggacattagtcattaagggaataatactagttttctccaattggatattgatgtagagctgaacttgtgcttctcacactgtcacagagtttggaccctcacctataactttgaggagagttgatgatggatagtccattgtgggtgagctctgggtaacagtaattgtagggtctggctaggcagcctaaggtcaatacttctggacctcaggaaagacaggctggaattcctgggaagacctgcatctgccatccaccgtggagtcccatcatcttctgttatgctgtgattgaatcagccccacctagtttatctagaacactcttcatgacttaggaaaacataatggcaagctctcctaacacctgtatcatgccatgggagcaacacctaagctagtgtgtgattgagtagatgagactgtgatctagtcaagacgacaggtaaaattgattgttgtcattatgatattttatatttggcaatataatcatgctcatattataaatacttttgctacattttttgagtgtgtcagaggctttggaactggaacaacttcatcttgaataggggctaggaaaaataagaccgagacctgctgggctggattcctagtaagttgatgcagtaagttagtcacaggatgagataggaggtctgcacaagatccaggtcataaaggccttgcagataaatcttacagtaaagaagctgggcaaagccctccaaaaccgagacagtggctaaaatgacctcagtttgtcctcactgttcattatactctaattataatgcattaacatgctaaaaaacactcccttccagcccccaagacagtttacagttgtcaaggcaacatcatgaagtttccttgtgtggtttaaaaaggaggggaggaacactcaacttcaggaattgcctggaggactcatgaataatccatccattgtttaacatataatcaagaaataaccataaaatggacaaccagcagcccatactgctgctccacctctggtgtagccagtctcattattttacttgcataagaaacttgttttcattttaatctgtggattttccccaaattgggacccctttctcctaatatttgtgctattattcgtgttctgagcagaaaaccccaagatggaatgaagtttccctacatttttataagaagtacattcacccctttgagcgaaaatgcacagggagtggaatgaggctgggaagctaatggcgtatgatggaagcttgtccctgactggaggagagagggagggaggattgggaggaaggttcctatatttttgtgctatgcaaggaagctgcaaaagataactgagtctcgtgtaagtcagtgctacctctcaggggatccctgtgactccaagaaagggctcttcttaggaatcactgtggagtcagtcctttcattagagtagaccacaggacatgggcctcagcacacgccatgccacagatgtcagaaagcagctgctgggaacctgatccacctgcattttgctgcctgtaggaggagggagggaggtgcattctcagggtcagcacactgtttgtgaatttttatagagaacccctgcttttgctgtatttttattggaaaatatatgaacaagtgtgcacctgcaaacaactgtaattttcacatttccttcagttgcattatttcttaatcctgaatgacgtcctgacacagagttgagtttttcacaggcattgttcgaaggatcgagatgatggcattttccacattcactggtttttctccatgtggcagagaccttgagtagagcacatctggcccttatccacactatctcttgtgtcccctgggaaagagcagagatttgcctgactgcagaatctggggtaggagtctgcacacctctgagcctgcagagaagctcagcgaagttttgtggagtcagagagctttccgtgtggggaacctctagcttcctcactctcggagattaatggtcagctgtacttgaggggttaagaattagagcaccttgggagcctgtctcatcacagttccattatgtaacttaccaccattagactgcgggtaataactcaatcttgatttttctgacccgattttttcatcttattcattactaattttgtttatggaaaatgttatgtttagtttatgattaaaacctcagaactttctgaacttatcaggaataatacaaatgtgtccagtttgggggaaatgtaaatgaatgtccatgcagtttgggtgtgtgtgtgtgcgtgtgtgtgtgcatgtgtgtttgtttgtgtgtgtgtggatatgtcagtcacttacaccacaatgaacatgattgctgaattacatagtcaaactaaaattagatttgctgaaaattgcctgcagcgatgtctgtgaagctgaccctgtcactttgctgtgaagaaactcagtgtacaggcgaggttgcacgggagagctaaaagcttctgcacacaggacaggctgagctcctgaactggagccaggcacaggactgagcacctgagaaacagaacccccagccctcctttatctgggctggatgggcaccagaggacccgcaggagatgctcagaactcacacaagacagagcctcagtgaggagcagaggcagcgaggaaccagtccagggagccctgtgaccgccacctcgggttgtcttattttgcttaacagcatccaaacctcaggagaccatttattacgttatttagacttccatgccctttctgtcccgaagtaaaacaaacataaatatgactctgcagttagctctttgaacctgggttatttttctgagaatgtcatcttcgtcatcaacatcatggtcatcatgtcaaaatcaacaggcaaatccagtcaccgtgaagacagtttcatggcatgattcatacacaatcattccattccacagagaatctctttcagattcttaaggtggattaaagtgttatatttaattgccaattgtgaaattggtggaagacattatactaaaggaattgtctctgacctctcatggggtcatatttccagaaaatcattgtgatcctgagtgtgagctgactttccaagtgttcccaaccctcctccagatgagatgctggtctgtgtgttcttgctgcttcccctggggcagattcctcttgttttccccagttgttccctcccacagctctcataatctctgttggtgtccccaacttccagatctgctgccatgacctgcagattaaagctctgattccgtaagaaagtgaggggagctgcttctcaatagagctttgatgggaacctctgttcatacctcaattcttaaggggctgcaccagtgccctaggatgctgattttcatggcttgctcctgcagggtaatatcttagttttgtagtggggatcagagaactgggtctggatgcatttcagaagtgtgagctcattctctcccagacagatactatgggaaaggaagatgttttgcaggggtaaatgattcaagagattagggcaactctccagtatgaggtcccttagaatttctcactataacatgcctaacacactcgacttcaagcaatccagtgtatatttgttcttcatcttgtaatagcctacattttatatgacagcctctgcctcagggaatttcatactctggcttcattactctctacaggaacttgcctctccctagatttcaaatattttgtttgttttcaaccctcaattatctgaagcattaagtaaaatttgcaaacttccatcttttctgtttatctgttattgttgatactattgttgtaagaatgaatatatgggcccggcgcggtggctcatgcctgtaatcccagcactttgtgaggccgaggtgggtggatcacgaggtcaggagatcaagaccatcttggctaacacggtgaaaccccgtctctactaaaaatacaaaaaattagccaggtgtggtggtgcgcaccagtagtcccagctacttgggaggctgaggcaggagaatggcgtgaacccgggaggtggagcttgtagtgagctgagatcgcgccactgcactccagcctgggtgacagagtgagactctgtctctaaaaataaataaataaataaataaataaataaataaatatgtgtgtatatatatatatatttctcatctatgtacatttttaagcttagcagcatattttttagtgagatccagaataataaaagaatccaaacatttttcagctgcctaatagagaaacaaattctggtaaattttttcactggaatactactcaacatttataataaatatatttctggtacacagaacagcaaggaaaagtatctaagtatttatgctgagtaaaataagccagacaaataagaatatgtactatattactccatttatgtaatttatttcaaatgaaaaaaatctaaagtaatatacaaaagatgagtagttacctgggaaaagggtagaataaaggaaggggaaatgtggaaacatacagaagaacaagagaaaatgttgaggggaactcacttgtccacctcagtaatgatgacgcttacatcatgttttcaattctacactttaaatacgtgaagtgtattatctgccaattaacactcacaaaatttattgcaagcaaacaaatgaaaaattagaccaaaagcggtggtataaagatacaaaatatccattaaaagtcagaaatatatgagaatttgcctcctgaaccctagttctctccttatttttaggtgaatgctagagtgccacaaaaatcactcaagttctcaatacaggaagtgggttccacaaagcacactaggcatgtccaattcttacctggagttggttcagggagtaactggggccactgatgtggagcacaggccaagctaccagggctcattcatctcagacatgagacacacacagcccctcctccgtgtgtgggtttatttcacatctgtaaatggagaaaccattgacttctacagaacataatttacacaaatatgtaaaaatataatagtgcaaaatgtttatcacaacacattttcataataagacagtgtattttccaaataccataattgtcacccaattcctgcggggccctgtcattttatctggggtctgccatctcctcagggttcccaccccagagctctctgtgtagcaggagacacgcaaatagggccctccccatgctgatgaaaaccagctaaaccctgaccctgcagctctggcagaggagcctcagccccgggattcccaggtgtttctgcttggtcaacactgaacatacaggattcaccatggagttggggctgaggtgggttttccttgctgctattttaaaaggtgatttatggagaactagagctattgagtgtgaatggacataagtgagcgaaacagtggatatgtgtggcagtttcttaccaggatgtctctgtgtttgcaggtgtccagtgtgagatgcagctggtagagtctggagcaaacttgacaaagcctgggtgtccctgagactctcctgtgcagcctctggattcaccttcagtagccatagcacgcactgggtcccccaggctccagggaagggtctgcagtgggtcccagttattagtggtagtggtagtaccatgtactacgcagactctgtgaagggccgattcaccatttccagagacaataccaaaaactcactgtatctgcaaatgaacagactgagggcagaggatgcagctgcatatgactctgtgagagatacggtaaggagaagtcagtgtgagcccagacacaaacctcccttcagggtacctgggacaaccagggaaagcctgggacactgtgcactgtgctgaccccaggggcaagtgcaggtgctacaagggctgggtttcctgtcttgatctggggctgccttgttaccaaattacccgagggaacttctctagatttgcaattctgtactaacatttgatgtctgtgactgctaaacttccctcacatatttgttttttgtttgtttgttttgttttgttttttgtaacaggaagacccatcctcacccctacagaagcccgagtgtcaccttgggggcagaaatgaccctgccttggtcacattgatcagtgtcctgaggaagcccagtggaacctggggagtgttttccagtcaggctcagggcagagacctccgtggaaatctctgattagaataggtttgggattcagacttgggccaagagggagtctcacccatgggagggtccttaaatcctgacagtttttacagctgttctccctcctctggcaaaactgtgcacatctgactcagaactgatccagctggcccttacttgctaatcaatttttcttctctctacacttcattctcatagttcccttttcttcccttcccagaaaacagagagtgtgttttctgtggtctaaatctcagggctcaggcctgttacctggaactcaggtgtggcccaggctgtggctcctgtgagacctggggaggctgaggggactttcccactcaccattgcctggacccgcctgctgtcttctgtgcatggaggcatttgggaaatgaagtggacattagtcactgaggggataatggtagctttctcaaatgagatactgatgtagagctgatcttctgtttctcacactgtcacagaatttcctccttcatctgtgactttggggaaagctaaggatggacactctattgtgctgtgagctctgggtgacagcaattggagggtctggctaggcaaatcctacagggtttcaggtcaatggagttggaatttctgggaagacctacactgtcatcctccatggagtcccatcatcatctcttatgctctgatggaatcagccccacctaggttatctaggacaatcttcctgacttaggaaaaaaatgatggcaggctttactaacacttatattataggatcagtacaacacctaggttagtgtgtaactgaataaatgactctatgagtcaaggggacacataaaattgattgttgccatgacatttatttatttatttatttatttatttattggaaaccagagttttattgttactgaaatgagtctcgccaagcattcaagaatgggattttttaaggatagcttggtgggttgggggcagccagtgagtcatgagtactgattgatcaggtcagagataaaatcatagggagctgaaggtgtcttgtgctgagtcagttcctaggagggggccacaagatcggatgagccagtttattgatctgggtgatgccagctgatccatcaagtgcagagtctgtaaaatatctaaagcattgatcttaggctttataatagtcattttatccccaggagcaaactaggaagggttagaatttgtagccaccagctgcatgactcttaaaacataatttctaatattttggctaattcgttagtcccccaaaggcagtctagtccccaggacgaaggagatttgttttgggaaagggcagttattgtctctgttttaaactataaactaaactaagttcctcccaatgttaggtaagcctacacccaggaatgcacaaggacaacctggaggtttgaggcaagatggagcaggttaggtcacagctctttcactgtttcagttgcagctttgcagtggtggcttcaattcctccctttgagttttgaccttatcgacttgttttgtttctctttaagtgatggttttataaccatctatgaaactctaacaggtgctctcacatgcagatttctgattaaaaactctgaagatggttacaatagtatagagataaaactatcaaatagaagactatcttttttgacttttcacttaaaatgttgcccaagaaaacttttcttttgagctatttatagctttcaacaattgagtatagtcctgtacataaaatttggagaatatttgtttctctctgtccactttctccagaatttggaaactctttgtgaatatccttaacttatggcaatatgatttttcataagtgcagtaagattttttttttttttgcaacaggacacaattggagaaactggttattttaccaaggctttgactgtaatggcgtgcttcaccttaagcaatcgaacttgacttatacagccaataagagccccttgggaaaactggcctgtaccttgtccacacagtctttgtacaaggttcctgaccagtggtaagtaaagaatgtcactttctaacaggcccaagaaccccatgttttcctgggaccccagaggaaaaataatttaccagacttacaggtatttgatggtaaaaactcatggctgggcttggctttaaaaaagtcttatctgagattccttatggaacagagttccaccaaagccaattttaaaagcctgtgtaaacaataattatttgtattgtgctttatgcaaataataaggccatgaataataagactaaagtttattttgcaaataaatcagtcctatcttgatttgttttaaataaaaatggggacaagagagaaaaaaattatgctttaaaaatatagtacacctgttgtttgctgttcttgtttttttttcttcagcagtttggacgaaattctaaattatttgtaggctacaaagccataaactaatgcgttcaaatctttacttttaaaactgcgaattgcactccttaccccagttctcattatgtactttatagtatgttgttccctccaatgtggtgctggaattatagatgacagcactgacagctttgccatgcaagccttggaaccccacgcaggcctgcgtgagtacactcagacagttgcaatgaggttccagtcctcttatcttgaggtcagcacctacccctactacgccccaggtcatcaataaaaagttgtaacagtcttggcccttcttacatcttcattatccaacaccatgatttttgttttttgccaaaacaattgccaaatatagtcataatcataggataaataattttgctgaaatatatgtgttattattggtcttttgagatggaaagtccaagactggattatgctttcatgcatttttcataagaagtacttccactcttttgacaggaaacgcacagggggtgacatgtggctgcagaagctgatggcatatggtagaaatctgtccctgagtaaaggagagatggacggaggattgggtgaaacattcttaggtttctgtgctgtgcaaggaaggtgtaaaacatatttgagtctactacaagtcaacattacccaagggggaacccctgtgactccagcaatgactctgcctcagaatcactaaagagtccttcctttcattagagtggaccacaggatctgggccatagcatagacgtcagaaagcagcagcttgacacctgatccatgtgcattttcctgcctttaaagggagggagagaggtgtattctcagggtcaacacactctttgttgatttttacacagaacactggcatttactttatttcattgaaagatatatgaacagatgtgtgtctgcaaatgattgtaattttcacatttattccaattgcataatttttaaattctgcttgatgtcctggcacacagttgtgttttctataggtatttttcaataaatcaagaaaatacattttccactttcactggcttttctccatgtgcagaggccttgagtagatcatgtctgactattagtctgttttcatgctgctgataaagacataccagagacttggaagtttacaatagaaagagttttattggacttacacttccacatgactggaaaggcctcacaatcatggtggaaggtgaaaggcacatctgacatggtggcagacaagagaagagagcttgtgcagggatctccctttttacaatcatcagatctcgtgaaactcatgcagtattacatgaacagtgctggagaaacccgcagccataattcaatgacctaccactgggtccctaccatgacactgggaattatgggagttaaattcaagatgtgatttgagtggggacacagccaaaccatattattttgccccatggcccctcccaaatctcatgtcctcacattgcaaaaccaatcatgcctttcctacagtcccccagagtcaacttgtttcagcgttaactcaaaaatccacagtctaacatctcatctgagacaaggcaagtcccttccacctataaacctgtaaagtcaaaagcaagttacttcctagaaacaatgggggtactggcattggataaacacacccatccaaatgacagaaattgcccaaaacaaaggggccctctgcaagtccaaaatccagcagagcagtcaaatattaaagctccaaaatgatcccctatgactccatttcccaaatccaggtcatgctgatgcaacagatggtttcccttggtcttgggcagctccacccctgtggctttgcagggtacagcctccctcctggctgctttcacaggctggtgttgagtgaatgtgccttttccaggcacatggtgcaagctgtcagtggatctaccacactgggatctggaggatggcggccctcttctcacagctgcactatgcaataccccaatagggactctgtgttggagctctgaccccatatttacctttctcactggcctagcagcggttctccatgagggtcccactgctgcagcaaacttctgcctggacacccaggtgttttcatacatcttctgatacccaggcagaggttctcaaggaccagttcttgacttctgtgtactcactggctctacaccatgtggaagctgccaaggcttggggtttgcaccatctgaagccatggcctgagccctacattggcgtctttcagccatagctggagtggctggacacagggcaccaactccttaggctgcacacagcacgggcaccctgggcctggaccacaaaaccacttttgcctcttaggcctccaggcctgtgatgggaggggctgccgtgaagacttctgacattcacaggagacattttccccattgtcttgaggattaacatttggctcctcattacttatgcaaatttctgcagctggcttgaatttcacctcagaaaataagatttcttttctactgccttgccaggttgtaaattttctgaacttttatgctgtttcccctttaaaactgaatgcctttaatagcactcaagtgggctttttgaattctttgctgcttagaaatttcttctgccagacaccctaaatcatctctctcaagttcaaaattccacaatttgctccagttcccaatgagttcctcatctccatctgagaccacctcaagctagaccttattgttcatataactatcagcatttttggcaaagcaattcaacaagtctctaggaagttacaaactatcccatattttctggtctttttctgagccctgcaaactcttccaatctctgcccgttacccagttaaaaagtcacttccatatttttggttatcttttcagcaatgtctcactctactggtaccaatttactgtattagtctgttatcacgctggtcccaagactggacaattcataaaagaaaggtttattggacttacagttccacatggcttgggaggcctcacaattatggtggaaggtggaaatcaggtctcacatggtggcagactagagaagagtgcacatgaaggaaaactcccctttttaatccatcagatctcatgaaactcattcactatcacacgaatagctcaggagagacccatgcccataattcagtcacctcccatcaggttccttccatgacatgtgggaattgtggaagttacaattcaagatgaaatttgggtggggacacaaacaaaccatatcactgaccttctccgcatcatctctcatgaccccagagaaagagcagagatttgtctggggtaggagctgctcctgtggaacttagaggctgcagacgaccccagtgcagttttatggagtaagagagttttcccatgtctgggaacttctagcatacccactgccagagattgctggttggctgttattgaggggttcagaattagatcacctggtagcctatctcactgcagccccattgtgtaacttaccaccaatggccttcacgtgaggactcaatgttaactgttctgacctcattttcttacctcctttatttgtaagtttggttacagatttttttttactttaatttcagggatatgtgtgctgaatgcgcaggttttagtttcttattcaagccttataattgctcaactgatcaggaataatacaacatgtatgcagttttggggaaatataaatgaacatccatgcaaaattttttgtttggatatgtccgtcagttacacccctatgaacataatagccggtcctcaccagaaattgctggtcctcaccgatctcaaaagcatctagatcttcaacttcctagccttgagaattcagaaaacaatgtttatgatatttctgagccacccatttaatggagttctgttatagcagctgaaacagactaaaccatttaccaagtctcagtaagggcagtgaggatccaccatgcttgagagacaagcattactctctcatttgcagctcaggatgacagaagcatgatcatgagctgatctgaaaagaagatgtggctttctctccctcggatctcagttgaagccatggtgtcacatctctatggtggagactaaattccagtctgtgatgtaatggatgcctgcctcctcccaccctcacttacgagacagagtttccatgccatgcgttattgaccaagaaccaagaaggactccaattattctcacccctgctcacttgtatggcagaggttctggggatattcctgggagaggcataatgagactatttaagtccacgattcccaaacagttttatgctcttaaagcaggagtatcactttgagatatatgaataatttcatgtgcactaaggtggaggctgttatatttttataggtaaagatgcatggcataaagacagagatacagcactctggaaattgtgtgactatgtttgcagttgactgtgaataatttttaccatgaagttatcctaaaacacataatatatttttactgtaagtaattaatgaaaagctgacagctccacaagagcaatatccacttggtttagcagagagaatgagaaatagcataatttaagaataatcagttagacactgtgccatgtgcctgtattttcaactagtgaggatgctaatgtgggaagatcacccaagcccaggatttcaaggccagcctgcaagatattgctagacccattttcttaaaaaaaaaaaaataacattctgggtcatgacaaacctcaaaaactgaccctctaaataggaacaaatttaattgcattaaaatgtggatgaatttttgacacaaaacagtgacagcatgccagcaatgagtacagaataacatccagttgttatgttaagagatacagactccgaaaaagagacatcaggtagaggctgtcaaaggcctcactgcctaatgactgcttttccattgatactgtgtgtatatcccggaatgcacctgtgaatgaggacatcatgtctttcatagtgtgagagaaagagacattactacccatctgacaaaggattgatcagaatataccaggatctcagacaactctataggaaaaatatctagtaatccgaataaaaagcaggcgatatttatttcttaaaataagactttcaaattgcaaacaggcatataaaatgtgctgtgtaacactgatcatcagaacaatgcaaaacaaaactacagtgaaatatcatctcatctgattttaaaatgatttcatccgaaagccagacagaaacaaatgctgggaaggatatggagaaatgagaacactcataacctgttggtgggcacttaagtttataaaaccactatggagaacagtttagagtttcctccaaacctaatagtagtgttgtcatataatccagcaatcctgctgctggcatgtactccctcccacaaaaaaaaaatgttgtttgcactaccatgtttgttatagcactgttcgtaatagccaaaatttgaaagcatcctaactgcccattaacagatgatggataaataaaatgtggtacatatagcatatggattaatattatgccataaagagaatgagattttttcatttgcaacaacgtggatgaaactggagttcattatattaattgaaataatcccagaaccgaaagacaaacttcacatattctcatatatttgtggaagttaaaaattaagacaactgaactcgtggagatagagagtgaaaggatggtcaccagaggctgggaaggtctatggtagatggggattattggggatgctcaatggatgaaaaaagtggttagaaataacaaataatacatagtatttgataacacaacagactaagtataatccttaataacataattatagattgtaaaataactaaaagtgtataaatggaatgttggtaactcaaagaattaatacttgaaaggatgtaggaaccattcatcataatgtgagtattatgcagttcatgctatatcaaagtcaggtaccccataaatatacacatataccatttacccacaaaaattcaaaattaaagtatttatgtatctcatcttctgtatctatattacattaaacctaagaagatactggtttcttcacactaccaagatccacatagacatccgtagcttctttctttgcctgtccataatctgacattgaaaaatgaggaaacctttcctatcatatgacattaatttacttagtgcacaatttcaaaatacacaaattgtgttagaattattaaactgacccttgttgaaaatatgtttatcgactagaataccgtgcttatatgcagcttatttatattttacaatcacaacatcaaattatttccaaagatacttgtttctgatattcatgcccccctttctgcagtgaaattagtacaaacctgtttatcattgttagatatttttatacagctttcattttattctgtgtttcatgaccagctaaatacttttgaagttgtatgcatttaggttaacactttgtctcaaaaaattatgagttttcacaaattatttatgccatgtgtttatcattgaacaccatgaaaatagtttcattgtgattaaaaagtgtgtgtttcacctaatccacacaccttttccccagattcctggaaaaccacaaaggtttactggatctatatttttgtctttggcaaaatagcctggctattctcttagcttcttctgcaaagcatcaagattcaccttcactgactgcagcatttattgggccctgatggctggaggagaggggctggagtgggtggtagccatgagtgacccaagtggaagttctcagtggtgctctgctccagcacaaagaagattcacagttcctggggacaacacttaacatcacaatctcccttaaaattatctactggaaagctgaggagtaggcagtgtattactgtgagagacacagtgagggacatatgggtgagtctagacgcaaacttccctgcaggaagacaagaggggactttgtggtaaatggtgctcagaaccactaggggacactcagaaccactaggagacactcaggatagcagaaggtgctcaggatgccgcagggtgctcaaaacactaggggtgctcaagaccagcagggggcactcaggacaccaggagacacttaggacatcagggggcgctcaggacaccagggggcgctcagcacaagcaggggccacagaatgacaagggtgcattccagaccaccaggaaacactcaggaccaacaagagattctcagaaaccaccaggtgtaacaggaccacctaaaggcccacaagacaaccaggagacactcatggccactgaagaacattgaggacaccaggggttcagggccaacagggagtgctcggggccaccatggggctttcagtaaccacgagggaatcaatcactcaggacaccacggttttcttaggaggcagctccacatcaggtgcctggggaaggtgacgtttgcttttagacctagctgattcctgagctggtcaagcaaaagtcttcccacgatctctcactatttcttccttgtaacccatggtttctttcacatacaaatcattaacttaggataggaattcaattcaacttttaaccttgcatatttttagaataataatagcaatagtaattcaatgtgttttgataataagaaattgtgtatgcctaattcaaactctggttccacgcatgggtttttgtttcttgtgctgtgccagtcacactacagtcaatgcttttctaataataactcaacaatgtcacggtgttaagtttcctttcattttgtctgccatttgtggagatgaaacaccactttcacgggtcagttcctccactttggttgggttctggtcttctgctcttcacactgtttctccaccttcccttctgtcaaatccttttgtcttcctcagtctcctggcaaagaagcaacaaatctatttattttgtctcctccacgtctggtgaatctgttcacttctcttcatgatcattgaacccaaccatgtttagaaggataacagttcaccttacaatatgctcatgtaggtcaggtgcagtggctcactcctgtaatcccagcactttgggaggccaagacgggtggatcatctgaggtcgagtttgagatcagcgtggccaacatggcaaaaccctgtctctactaaaaatagaaaaattagccaggcatggtgtcgggcacctgtaatcccagctactcgggaggctgaggcaggagaatcacttgaacccagggtgagaggctgcagtgagctgagataatgccacttaactccagcctgggcgacagagagaaactccatctcaaaaaaaaaagcatatgttcatctatccgcagactctctgacatcgtcacccttttctagggtcctgcagacatcaccccacaacatccagtccttttcctaagtaccacagagtgggctctgcagctcctgctgctctctgtgtgctcagcgctgaggctcaccagtgctttgatgatgaagttcaaatccctaatgtgtttgcaattctcagacaaccctctagcaagctgccattgtgagtgcattctggggatcctgggctgatttcaggtccatattgctggatgttctctagcatccaggcgtgttggcaaataaacatctagaatttgtattgaaaatttgtggaaaatcaatggtagaaaacaatcctaatttctaaataagaacattttatcctgactttataaaaacacaatgttaatttaaccaataatgtaataaaatgtgtttaaagtgatgtttatcttgttattagatgtattaataattggtattttaaagtatactaacagcataaatgacaaacaaaccaacacagcgattatacataaataccattgtacattaattaatttggcaagaatggcatttattttcatttctaccaaaccttgcctttaaatatgtttgttaattggcattaggatagtgaaacaatcacacagagcaacaacattttggaatattacattatactataaaatagtacattcgattcaattatataattaaaataacattaaataaattcatgttttggtttgatatttggatatgtgttcatttttgtattttctttttttgtatcttttgtagagatggggtttcaccatgttggacaggctggtctcgacttcctgacctcaggtgatttatcgggggaacccacccccaatatttcaatgtagggtctttctattttctgtaagtgtcggctggtctgagaaataaagagaaagagtacaaagaaaggaatgttacagctgggccaccgggggtgacatcacatattgataggtccgtgatgccccctgagccgcaacaccagcaagtttttattagggattttaaaaggagagggggtgtacgaacagggagtaggtcacaaagatcacatgctttaaggggcaaaaagcagggcaaagatcacatattccttccccagggtattaattactaatattccttgctgggaaagaatttagtgatatcttccctacttgcacatcagtttataagctctctgcaagaagaaaaatatggctctattctgcccgaccccgcaggcagtcagaccttatggttatcttcccttgtttcctaaaatcgctgttgttctgttctttttcaaggtgcactgatttcatattgttcaaacacacatgttttacaatcagatttcatattgttcaaacacacatgttttacaatcaatttgtacagttaatgcaatcatcacagggtcctgaggtgacttacatcctcagcttacaaagataacaggattatgagattaaagaaattatgaaagtattgattttgggaactgataaatgtccatattaaaatgaaatcttcacaatttatgtttagagattccagtaaagacaggtgtaagaaattataaaagtattaattttgggaactgataaatgtccatattaaaatgcaatgcctagggccaacaaaggagtcatattaatatgaaaaataatagctgaatattttggaaatgacacatgcagtaacaaatgtctatatgaaattaagaagatattgacacaaaattgagaaaaaattaacataattatgctcactactggtttataaaatgcctataataacactttttaaatcatattatagaaaataaaataactatataaatagcactctctttgcttgattttagtatttggtgcttcaaatgttttttatacaaataaacattggtcattttttgatggtaatttcaatattttcttccagaatacatgttcataaatgtaattgaaattgtataattttcagaaacttattttatcagttgtgacttgtatttttatgatagactttttacatttatatacttttgattcagaataattatagataaaaaaattataaagttaatacagtgtgttcccatctccaagtatctcctaagatgaatatcctctatcatcataagacatggtgttaacacatttacattgataagtgtaaatatattcaataccagaccttattttatttatcatttttccaataatttctattgtaaatgaaaaataaaattctaagcttcctcaagcaactaaatgaactcaaccctcagccaagggaatttcaaagtaaattctaaaacttgttccagcaatgatgggaaagtgagaggtcagacatgcctcattacatgctcctctctttggaattaaggcaccagtggccagcattagtactacaacaaagatcttaagacgggcaaaactatatttttgctgtaaacactttctatagcaaaaagacatcaaattacaacttgattctagtatagcatcacatgacaaatagcaaaacctaatgatttattctgtatgaaatctgctacctggaggcttcatctacataataagaactatgatctccaggaccccttatcttaatccagacactcagttgtaatgattgtattaccttacatttcaaccaattgccaatcagaaaatctttgaattctcctatgtcctggaaccctgtgcataaactttcctgcctttctagactgcataaatggtatagctcacatgtgttgattaatatctgcctgtaacttctgacccactaaagtatataaaatcaagctgtaatcaagccattttggacatgtgttctcaggaattcctggggtcgtgtcatgggccttggtaactcatatatatctcagaatgagccattttaaatatttcatagtttgtcccttttagtggatatcttcttttcttttttttgggacagaatctctctttgctgttgctttcgtatatttgtttgtttccagattccatcaaggccatcagtttgaattcagttgtcttgttcctttattctcttctggtaaatgacagtttgtatttctgaagttttctagttgaatattttatagataaaaatttatcaagtaggttgatagtgccatttgggactcttatatctttacctatttaatcattgcttgttttctcaatcacaatgagtgttgatttctccatgttctatacatgttagtctattttctgttccaaatccatttattaggtcttttaaaatggattttggaaaagttgatcctattattttatgcaatatttcacttgagttgcaaaggtattctttttatgattattttgtctgaaattaacatagctattcaagttttctttggtttatattttcatggtctatatttttccatcttatttcttctctttgtgaatatgttaagaagttttcttggagaaagataattgctgggtcttttttttttttagtcaactatgaggaattattttttaatgatattacccttttgtccaataatggttgttttgtctttttacaataatatgtattgtttctattaatttattatttaattattattgatgaatatcttattggttaccataaggataacaataagacatttctataattgaattctaattcaaaaatgtagtacttctttctctttcttatttctttgagacggagtctcactctgtcgcccaggctggagtgcagtgggacaatctcagatcactgtaagctctgcctcctgggttctcgccattctcctgcctcagcctcccaagtagctgggactacaggcacctgccaccatgcccggataattttttgtatctttagtagagacaggctttcaccgtgttagccaggatggtctctatcttctgacttgtgatctgcctgacctggcctcccaaagtactgggattacaggcatgagccaccgtgcccagcctacccctttatatatagaacagagatattataactatatatgtctaattcctcttttctatcccttttttattttatcagtttgtaattacataagctataaaaatgtaatattgacatttttataattgctttacacatttatgtaataaagaaaacacaaatgcaaaaactaaatttaaacctcatttttttcattgttgacaatctttatcttttggatacattcaggtattggatgtatatcatatggctgctcatctagaaactctgctaaaacgtctatggcaagattaatatgctgggaatagattttctcaggatttgtttgtccgacagagtatttatttgtctttgatttatcatctcaagagacaatgtcaagaagatgctgtttctgcaaatgggcaatctgcaaaccaaggacacgtcactacattactgtgcaagagaagcacatgaggaaaggccggtgtgagacacaaacctccaggaacacctgggctaatgagctgcagggggcgctcaggacccactgatcagtcaaccacagaggggagtgcaaaggttaggactgctttcctgcaagcattgaaaaaagaagaaaaaaactccgtctgacagtttctccaaggaacttctgtaattttagaattctgtgcctaccaatgacatctccaaatatttttttaaaatattgtgtttggaggacatactctcacatggacaaaacacaaattgacacagagatgaaaagccctcaaccatagtcaccaaaattggagacatgtagaagctcactgggacctgttgagtcttctccaatcacactcagaacagagaccttagtgggtctcccttagagtagtcattaaggatggtgataacagcctaaagatggtagaccatggtcagtgtcatatagaatatggggaccctcacaagttttttgtctgacccttctcctgacactaaattatgcaaattaataacactgatctggtgcttcttttgattctaatttattttatttttagttgtcgttctcacttttcctttggattttcctgctccctggaaaaggtaaatgtggtctccgtgacctcaattcaagggctgaagccctttccctgtagctcagctggggctcaggctgtggctactgcagccatgtggaagaggctgaagggactttcttcactctccttgctcaggaccatccactgtattgtgtataggcttctctggaaatgcaagtggccatttgtagtgaaagaaatatgtttgtctggttaaaatgggaggtggatgtagagttaattggctgctacataaactgtccttctccaccagtgcttttaggatgagattgtgaaatttgtaagaatcaaaatggagtcacatatgttaaaaccctgacaaatggattcaggaagtgtagggagaattcttacacacatatccctgacaacaagaactatcataaaatagttcttgcaaaaagaccaacatgacctcataatcatgacttctgcaaagacttctactcagaatctacttgcccagccttagattaatgccatctgaattacactgatcatgttactatcactggtcctcaccacagatgcaacaccctcctgagtcctgaaacctgactccatcccatagagtagggcacagatgaggggaatgcaaatctccaccagctccaccctcctctgggttgaaaaagccgagcacaggtcccagctcagtgactcctgtgccccaccatggacacactttgctccacgctcctgctgctgaccatcccttcatgtgagtgctgtggtcagggactccttcacgggtgaaacatcagttttcttgtttgtgggcttcatcttcttatgctttctccacaggggtcttgtcccagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagaccacaaagacacagcccagggcacctcctgtacaaaaacccaggctgcttctcattggtgctccctccccacctctgcagaacaggaaagtgcagctgagatacgttttcctgccagggcctgcatttcccatccccattagactcagagccctgtcttcctccttcttctttaataataaatggcatgactcctgttaatagttcatagaagcagaagctgagtcctgtttgtcaaacattcagcatgaaatgttcatgttacctgggccagatgcatcactggtatgtggccgccagtttaatgggctcatactactccaagcggccgaatacaaaacagcagaacatatgcctttattaaactgcaggaaatgacactggagaaaaatgtggggataagggagcaggaggaattgtgaaaattcagataatagcttttctcgtagagagaaaggtgcgttaataaaataattttataaaacaataaaacagatggaatgtgtccccatcacggagtgtctcacagtaacagtgcagaaataaatttctaaaaatgtcgtagggtaggtgtgatagacaaggcttatttccacacagggagcccataaatacccatgtaattaaaaatccagctcttagaaagggagtgcctcaacttgacatcagaaacccacgtcagtgagtctgaggagcaatgtggaaaagaaatggaaaattcaacaatacctttcttatgaaaatcctagctcacgtttcaacatgaaacataactgtctacaattttaggaaaaccatcccatggcaacaagtcactacactcaaaaggtactgagctaacagagttccagcagtgagcaggtcagtgctgaaatccccggagaatcaaggctctcaggtacgttgtacaaaacccagaactgagccacacaatctatggtcaagtgatctttgacaaagtcaacaaaaatatgcacggggaagaggccacgctcttcatgccatgttgctgggacaattggactgccatatgcagaagaatgaaactggacaccaacctgtcgacatatacataaccataagaaaatggactgaaggcttgattataggacttcaaaatataaatgtactcgaagaaaacaccaggagaactcctctggacattgggcttagtaaataatttaccacaaaaacctcaaaagcacaagcaataacatcaaaaatagatgaatggaatttagttaaactaaagagcttccacacagcaacagagtgaacagacaaattgcagaatgctaaaaaatatttgcacacattgcatctggcaggggactgataggcagaatttacacggaactgaaacaaccccaccacaacaacagctatgaaaaaacaaataacctcattaaaaattggcaaaggacacgagtaggaatttttttaaagaacacatataactggacaagtgctaaacatcactgattatcagggatatgcaaattaaaactgcaaagaggtatcttacaccagtcagaatggctactataaaagaagcaaaaatagcagacatcggtggcgatcaaaggcaaagggaagtctcagtcattgttggtgaggatgtagatgagcacagcctctatggaaaacaatgtggagatttttcaaagaaataaaagcagaactacctttgattcaatgaccccaccattgggtaactacccaaaggaaaaataaatcatcatatcagaatgataaccaaacttttgttttcctgcagaactattcacagtagcatagatatcaacctaaggaattaacctgtgtcttacaacagataattttatttaaaaagtcacatatatatacaattaaatactatccagccatattaaggaatggaatcatgtattttgcagctacatggatggaactctgggtcattattttaagtctaataaacgagaagtagaacagcacacaccacactttttcacttataaatgggagctaagtaatatgtgcacaggcccatagagaaaggaatgatggacattgcagactcagaaacatgggagagcagaagttgggagaatggtgagaaattacttaaagggtatgatgtacattatttggatcatggatacattaaagccaagacgactatgcaatatatatatgtaacaaaattgcagtcactccccgtaaatgtatacgaataaaataaaaaaaaatacaattgaaatgtgaaattattaacagttgatcaacaatcctgaaaattaaaacgtgtgatgcaataaatgaaaataattttagttgaacttcatcaaattttaaaacattttctattcaaccgactatcaagaaactgaaggacaagcttcaggggagaaagtatttgcaaatcatacatctaacaatgtaattataataagaaccctcaaaactcaacagtaaaaagaagcaatctgtttataaaataggcaaaggtttgtgcaaactttctatcaaagaagatgtacagatgacacatcagcatatgaatgtaattttccagtagagaaattcaaatcaagaccaaaaggagacacgactttaggctttagaatgaggaaaaataaagaagaaatactgacagtaccagtgtcagtgagcatgccaggccccgagagactaaaatattgctagtgcaaaatgaaagagtttctgggagaactgtttacagtttcttataaaattaaacatgtccttaatccatgacctagaactctcatccctgagtatgtcctacaaaggattaaaatcatgtgttcacacacacacgtattcagatgtttaacattgtgtgtgtgtgtgtgtggtgtgtgtgtgtgtgtgttagaaactaaaaacaacatgaacatctttgaaaatttgacacaaaccattacaggtgaactccagactttcttctgagtgacagaaggcctgcctgaaagatccccagagacacagtcatggatttcactgtcaccctcacatgtcactggcttgggctgggctctctctggctcttccctgaccaggaccagatgttgagctccactacctgcagttggaagtttatattttcaacaatgcactgagggctaagttgctctacagactgaaccaaacaaacatgggcgcctttgaacaaacagtgcctgacatttgtactgaccccaggagaactcttcccgctctctttcttcttggttctctcctgcaggccagcagccctgcagtttagcctggacctctcatgcatctacccatctcctcccaagtgcattttaccacagcctccactgtttttgtaattctccacactctgttgtaaatgaagtcaggtccttcgagaccagattcgggactctattttatgaccaaatttcagcctcacccccactcctgagacagagctcctaaataagattctgcaggtggagattaagagcgtttttcttcctcaatgtaggagatgagtgctcagtggagggatggggaggagctttccactttaccagcatgcagatcctgctggggtggaccctctgccataggagcagggctgggaaccaggcagccaatgtcctcctccttggtgctgcactcagggcagagcctgcatccatgagtggggctgtgtggaagaagtgagtctctggttctcagtaagtcttgtctagaactgagcctcagcagcatgacctgtgggcaaggtcggagggccaatgtcctggcccctggggaagagtgtgctctgctgggagctgggcagaaggaatcctgtctacttggctgcagccatctgtggtggaatttacatcatgctgagctcgggcatagaaggaaggaagagaatctttgatcaaatatcaatatcatgtctgaccttactgaggttttgtagattatctcgaataaatgttccttcactttctgtatgttgacagggcctttccagacccgttaatttttcaaaattaatctcaccagtttcatggaggcatggatatatcgagctccttataccgtcatgtgagatgtggaactgtttccttcactggttataaaataatgggttgacttttttcccaacactttacagataccatcaattgtcctattgcttatatggttataaccaaagcaatgctgatattattcatttctattctattgcaaggtatgccccctctactcgtctccaattgctggcatgtatttccatttgtctgtatgttttagtaatttgaatatgattcacctaagagtgtttgtgtgtgtgtgggtatgtgtgtgtcgtgtgtgtgtgtgttaagggcttatcctgctatttggtgttctctgacctgcactgatccatgacttacaatttctctaatttggaggaaaaaatagagggaaagtgagtttgagtccagacacaaacctcactgaagtgagcacaggattctaaccccaggggtgctcaggacacgctgatcacaagagccagcctcaggggcaggtgcagatggaggctgagctcttctttcccgtcagcactgtggcttcttctccataaaacatcttcccttgaggaatttatctgaattcatgattttttgcttatctccaaagtctctgaaatgaaaatgtttgttttaataaaagaaaaatcttctcacatgtgtaaaagacagtttcctacagtcgcttaatcttgtctttaaatgtcaattatcaatgcttctgaagtaaatcagctaaatctataaaagacactttgtttaactcaacactgcagcccagcatgacagcactgaaagggccagcaagcagcaggcaggatacggtgcatgccagacactggggcggaaggagttagtatccagtgcaagagaagaaagtgcccgtggtggtcactgtcaggacccaagctcacagctccaattgcaggtgaccccatgcaaaggaagagataccctcaccaatgtttagtgtggatgtcgagtctgatggtgccacattcacacaccacgtgaatatggaaagatttaccaactccattattgaggcgtctgctgagggctgcacaggcctctcaataaagtccaaactggctcaatagagcaggaaagaagctgcctcagggtttttatgatggtttggtgttgaaggaatggtggggcttcctactaaggggaaggagcttgtataatttgaacctaatactggcatccagtgaggacacttccatgattttctactaaatttcccatgtgtgggggacaaaagtgaaggaaaaggattaatcctgtcatcagtaatgaggcatcaaaatagagtctgatgacttattctacttagcaacttaagcaaatgagtgaaaaatgaggtaagtgttcactctgggtggacagcaaataggtctgcagaaaatagagtttttttaagtgtaagcacataacaaaaagaaagagaagaacaaattgaacagggatcttggaccaatgtcctgggtggaagctcttcactctgtgagatcatcagcttgctctgagggtctcgggtcaagtccttcttcaatatatctcaggccttacaggatacatgggaatgctcagcttggtgtccttcactagggaaaagaaagagaaatcagactgtcactgtgtctatatagaaagggaagacataagagactccattttgaaaaagacctgtactttaaacaattgctttgctgagatgttgttaatttgtagctttgccccagccattttgacccagccactttgagccaacctggagctcacaaaaacatgtgttgtataaaatcaaggtttaagggatctagggctgtgcaggacgtgccttgttaacaaaatgtttacaagcagtatacttgataaaggtcatccgcattgtctactctcaataaaccaggggcacagtgcactgtggaaagccgcagggacctctgcccttgaaggcggggtattgtccaaggtttctccccatgtgatagtctgagatatggcctcgtgggatgagaaagacctgaccgtcccccagcctgactcccgtaaagggtctgtgctgaggagggttagtaaaagaggaaagcctcttgcagttgagatagaggaaggccactgtctcctgcctgcccctgggaactgaatgtcttggtataaaacccgattgtacatttgttcaattttgagataggagaaaaaccaccttatggtgggaggcgagacatatttgcagtaatgctgccttgttattctttatgccgctgagatgtttgggcggagagaaacataaatctggcctacgtgcatgtccaggcatagtaccttcccttgaacttaattacgacatagattcttttgctcacatgttttttgctgaccttctccttattatcaccctggtctcctactacattcctttttgctgaaataatgaaaataataatcaataaaaactgagggaactcagagaccagtgctggtgcaggtccttggtatgctgagtgccggttccctgggcccactgttgtttctctatactttgtttctgtgtcttatttcttttctcagtctctcatcccacctgacgaggaatacccacaggtgtggaggggcaggtctccccttcgtacttgagcagccttacaactgggtgggtttatgaattaattcctcggttgcattacatgaaaaatcacacaatctacaaattttaaaaaataagcctttactttttataaaagattacagccatttcacaggctgggaagcacagccattggtgaagacgagagacaggcactcccaaggaggagcggtggggcagaaactttatgctgaacgtgttggctaaacagacataatcaacggattacaggaggggctatgcgtgttcataaaggtggtcatgacacatgaatatgggagcaaacatacacgtcacatgtgacccacttagcagtggggacttagcatttaaatgtgttacagttaggccctaagtgccaaaagctggagcaggggcacaaagaccctcagagcgcagcctccataaatggccagaaccaggccatggtcagtggtctctgatcaggagaaaattcctgaaatcaatctggtgtcccatccaagctggggttatggctgtggaatggggggtcagttagtcaggggatgagctgcagttggttaaatcgtgcttatctcaggatcagtgcttattttgctgctacagaagaaaataacagtttattctttaagagttggggtgagggatgtaacccctgcctggcatggccttaggtcttgtttataacggggcatcttattgccccggagaatctgttctgtcagtcttatgatctccattttaatgttagtgttggtccatgttgtctctgaaccacaaaagggagtgggtataatgaggtgtgtctgatctcttgttctgcccagctgggaactcagtttttaggtgtttttggtgcctccttggccaagagggggaaccactcaatctcatggggtgactgaaattttacttttagtttaaagtttataaatatggacctaagtattgacattctaaaagtcactcctttgttttggctaaaagtacttggcaagagtccttgaaatgaggttcaagagcagtattttctcatgactttatttgcaatagacacatgagagactgttgaaaagatgaagtaccaaagtagccttaatctgttggtgaatggagttggtataatacagaaatcactttcaatattttgtaacacatgcatgcatgcaataagacagcggtgagcactgagtgtaaagtctctaaaggtacgatctttcagccaccaaataatagtgtaataacggacatactctggaggagctgactataataccgtaacaccacggggagaaactttggccaaggaagtccaagattttcttttccttttcctttttttttttttttttttttttttttgttgttgttgtttgagacagagtctcactctgttgcccaggctagagtgcggtggtgcgatctcgactcactgtgacctctgtctccctgattcaagcgattcctgcctcggcctcccaaaagctgatattacaggcatgtgccaccacacccagctaagtttttcatatttttagtagagacggggttttgccatgctggccaggatgatctcgcactcctgacctcaagtggtcctcctgccttggcctcccgaagtgctggtattacagcgtgagccaccacacccagccgagattttcttaaagttttgaaaattttaatttaagggttacaattttttcaacatttccagaaagctgtagacagtattattctgtgttatatgagtgattgtagttccttccatttttagatagtattacaaacaattttagggctgcttgctttaaatagatagatgatagatggctacatacatacatacatacgtacctcgatagagatatagttgcaaacataaatacatagatagatagagttacagatgtattttagttattatgctacttttttctttgccttttcttcctatgttatgttagtcaggtctccaggacttaggagtgcatttacaatcccttcccttgtccattttgacgtgttctagacaatgcgagaatcctttgtgtgtggatcacttccaagtcatgcactacccttgcaataaatgtgtttgtgtatgtctttgccttactgacaagctctgctgagtgcagttatttctgccgtctgagctaactttacacttggtagagaaatatattctagatggaggcttccactattaatttaaattactaattcataacctccagcttaattattgaggtataatctatcagagatggtattagaacaaaggtttccaatgaaatctaacagaagggatgtcaaaaaattttcctaacttaggtaaaataaccctgagcccattcttagtatccagccatgtctcctatctatcacactgaatcccacactaactttgacctgacttgggacttgtaagcttcaaatatgaccttttgattgcaatgcctctaattcaggacgtgtggttattttagccaagagtaaagaaaaccaaatttaactcgctaaaaatgacaaagattaaaacctaatgaaatggaaactgggatatgagtggctccagacttggctattttaagagtctatgtgcccaggtgatttcttttctccattttacacacaggcaaacccaaaacgtcagcttcatctcccgttgactctcatcatctcgttcttcatcagcttgcttagaatgttgacttccagctgcatccatgttgccacaaaagacatgattttattctttttctgtgaatgcatagtgttccattgtatacatgtaccatattttcttgatcaaattcaccatgaatggacacataggttggatttatgtcttaggtattaagagtagcatagcaatgaacatgtaagtgggtgtattttttggtagactgatttattttcttttgtgcatatacccacatatgagatggccgggccaagtggcagctctgcttcaaatacttttcaaatctccagactgctttccacagtgcttggactaattcacattccacccaacactgtacaagtgtttcctgttctccgcagcctctctccagactgctttccaagattcctctcctccactttgacactttggtatatccatgtgtgtcctctctggttcagccagggacagagaaccaggaagacatcatgcattttctagagggagctggcttggggaatcaacgaccggagtagaaagtgcctttgtccatgcatcacaggcctgagggccctgggcaggaggtcaggaagagaggatgaccagacagctggggaaaccgggatgaataaagccagtttccttcctggtgaggaggggcaggtcgaagcctcgtgtccctgtagggatgaagcacactcacctgccactgctacctgccaatcaggtgacctgcagagcagcagctcctgagtcactgatggtgacttcctcctcctccaaaccctctaggatctgtgcttctcagagtgggaaccccagcaggtccccaagttttcaatggattcacctagctagtgtctctcctcagccccatccccaggctcctgccctggtgctgtgtacagtgtcacaacaggggtgacagtaacagctggtgcctgcactttccaggccaagaagtttgaaagaagcaagtcacagggccagccgggatatggggtaatcacacaaatttccttcttggaggaagtgctgggaaacatccttgagtcctcctcagctcacgtgcagctgctgctgttcatcccagtgcgggggacacatgagccctccccatgcccaggatggagctgtttcaatcacagcaggatgggaatgtgtcttctctatgggggcttttgaagcacagctctcctgttcctgagatttgagatttataaagacaagtcccacagagtggacctgcacaaataagacagtacaggatccccaggagagacatcccataagagaagggacaggcgggtcccatcacagacactcatcctcagaaaccctgaccggctactcaccttcacaggtccccagttcctgatcagtgcctgtgtctgctcctgagaagagatgaaaactcaagacaaatacttctcatgatcataggcttaaaaattctcaacgtaggaaatcaaatccagtagtttatcaaaaagttaacacactgcaatcaagtaggctacattctgcaaaagcaaggctgctttaactgctttccacagtgcttggactaattcacattccatccagcactgtacaagtgctttaacctatgcaaagcaataaatgtgatgctctactaaacagaatcaaaagcaaaaaccatgtgagtattccagcagatgcaggaaaaaagctttcaatagaatctaacaacgcttcatgataaaaaccctcaaaattatagacattgaaggagcacacctcaatctgatgagccgtctatgacaaacccatggccaacatcatactgaatgggcaaacactggaagcattttccttaagaacagaaacaagaaaaggatgcccgctctcaccacttctattcagcctagtactggaagtattcaccagatcaggcaagagaaagaaataaaaggcatccaaataaaagaaaaagaagaatgcaaaccctctgttttcactgataatatgattctatatgtagaaaatattgaaggctctgccaaaagtctcctagtattgatacattcgtttaggaatgtttcaggatataaaatcaatgtacgaaaatcacagtaacatttctagtcaccaacaacgttctggctgagagtggaatcaagaacatgctctcccaatagccaccaagacagtggaatacctaggaatagagttaagccaatgagatgaaatatctctaccagaaaaacagcaaaacacatgtgaaaaaaatcagagataaaacaaataaatggaaaaataaacattccatgcttatgaatttaaacaataaatatatgaaaaagttttaaaatttgtgattaattctacgtagcaatgccatttttttcaacatttacagaatattgttgctggtaatagcagtttagcatttgagtaatggaaacaccttacagaatcactttataacagttgcttcctgtagtgggttgcttcagttacctgatgaaaacatctgcatgtcacaggttgaaaacataaaatatgtctatcaactgagaaggttgtaggcttttgtcaaggaattacttcaagtcattcagaaaaacagcagacagtaaacgaaacttgttcaaattccatggagagtcaaagctgaagaaaatccaactagaagtgtccaaaggcccccaaggctcagttcctcggcaagtcccaccttctcaggttttccagaattttgtttttaactgatttacactgagtgaagtagattaccaggagttttccattattttaacataaaatcgggggctaagtgttgttattttataaagacatctttgaatctctcaggaaatttacctcctgagggttcagataagatcctactctaggttaagattacatgtttggcgcaatgaactggtacaaatcttactttagctttcatgttatctatttttccgcactgacttccacctttttattagtcaagtatatgggatggaagagtgcttctaagaggtccttaacttgcccatttcaatggattttcaagaagacatgagaaaccactttgtttgcaaagcatcccaaagccatgtcctgctccagaaacgtgatctcatttcctggtcgtttcttaactgacacgctctaatcagtgcatctgggccaatttgaaatgaggtgaagaaatgtgtcctaaagtaaagctaacattgtaataggaattcgtgtttaaaaacatttagttttattattgggcaggatccatcaacatataacagttgaagtttctcaacaggagtttaataaatataaggaatgtacagaagtgtttcctaatttaaataaaatgtagtgattacctaggctgtgagtgcaatcttggtaatcttctatgtccatgcccatcactctgtgcaccgcaaactaattttgacctcagcagaaacgggattaattttcaaattagtaatttttttccaatttaatttatttagatgattatgaatgactattttagcagaaagagaatcaaggaaacttgaactaaataaccagaatttaaaatgacaaacaattcaacaagatgccaggatgtgagtggctccaggcccaattaattcaaaactttatgtgcccaggttctgtattttcccaaaattacacatctccattccagcttcatgccacagttgactcccaccgtgtaagacatggcgacaccattcccaaaggtcgtgtgcaattctgaaaatggaataagcaaggagaggagatgatagtttatattctcctctgaggaggaagaattgcctcaacagaccacttctcctgcatctgtgactagaactatgtcacaggcacacatggagcaaaatccctcaaggggataatacggtaacattaatcagggtgatcatttttaatactataaaattcatagatgacactgcattccagcctgagggacagagcaagaccctgtctctaagaaaaaaagaacaaatcaatagatactgataccaacattttagataatgaaattttcataatgtaattttaaatacactcacatcattacataaatcttcccagaaatattcctagtcatgttgagtttcatcaacttttccagtgttcaaatctagaaatccaatagactcttgaggataaatcaaaatgagggcagtgaaactggtatctgctcagcacctgttaactcaggaggactcaatacacccttgcacactgctgcttctctgaatggctcacaaggactccagctcactctccatcctcctcaaacatctggcccccacttgccctaagttgactctctgctcttagtctgtgctctgaagtcttcccagaggtgaaagtgagctgtcagatggaacttccctctcacctcagcgtggaatttactgctacatttaactatcactctttccataatggttgatttcttggtctgttcattacagatcaaaggcatctgatttgaatctttatttctttgcatttgtctccatgacaattttgggaggttttaccgccagcactatgacacgatgtagtaacatgacacatttgtggttaacaacacctacaaattcagaagctcttcggttgtcttcccagcaaatatagctgcttcttttctgtgtatgaacacatcctggaaacacgtacacacccacatagatatatacatgcctatgacattttcttctctgtaagtgaaaattaacctcaatttcatacgaagttcatcatttccctgaaggtgaaggtaggtcgtttttcatctgttctaacaaatgctcagacaccagctagtaagtgaggagctaccctgcttctggatgttggatctgtctcttcccctttgctttaccacagaagattggccacttgtccaggtcccaagaagagagtccaggtttgtcctgataatatgactcatccaacttctgataactctactgttacacacattcatggaggtagcctattaattacataattcactaaacaaataccaaatacccacattgcaataccccatacccaagggtatgttcatgcattcagtgaaggaaaaggcttttcagagacagatagatcaggctagattggtcaatatatgggtgaaaacactggacttgaatgtatctgttttcccccatgtcacatgtgagacctgtcagacaggaccagggttccttgtgcactcagaggtgagggctcacagaattcctctctggtttccaggaaaggtaactgcagtaatcttggtaatgagaatatcctccagtgctgacctattatagagtttacatatgaaattttcactgcaattcacaatctactctttcacacagaagtgtacagaggtcaggacacatcctcagggtcacacattgagaatgatgaagatatgtcccacgagtttttcctaaggtctcagaaagaattccaggactcaaaaggtctcagagggcagctcccagtgccttagttaaaatggtggctcaggcctgtaatcccagcattttgggaggccaaggcaggtggatcacctgaggtcgggacattgagactagcttggccaacatggtgaaaccttatctctactaaaaatataaaaattagacggggggggttgtgcatgcctgtactcccagctactcgggaggctgaggcaggagaatcacttgaacccaggaggcggaggttgcggtgagccgagatcaggacactgcactctagcctgggcaaaggagcaaaagttcatctaaaaaatttattttaatttaaaaatttttaaaaaatggcccactccctagaacagagagattccctctaaacatgatggaggtcccgaactatacattaagtgaatcctggtgtgtctgaactcacatgattattacgttaagctgctgttccaatctacttcctcacctgggaaaagaggagccagggcatggctagttgaggccccaggaagagaactgagttctcaaagggcaaagcaagcatcctcatcccagggtgagcctaaaagactggggcctccctcatcccttttcacctctttatacaaaggcaccacctacatgcaaatcctcactcaggcacccacaggaaaccaccacacatttccttaaattcagggtccagctcacatgggaaatactttctgagactcatggacctcctgcacaagaacatgaaacacctgtggttcttcctcctgctggtggcagctcccagatgtgagtgtctcaaggctgcagacatggggatatgggaggtgcctctgatcccagggctcactgtgggtctctctgttcacaggggtcctgtcccaggtgcagctgcaggagtcgggcccaggactggtgaagccttcggagaccctgtccctcacctgcactgtctctggtggctccatcagtagttactactggagctggatccggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagacacagtgaggggaggtgagtgtgagcccagacacaaacctccctgcagggaggcggaggggaccggcgcaggtgctgctcaagaccagcagggggcgcgcggggcccacagagcaagaggccgggtcaggagcaggtgcagggagggcggggcttcctcatcagctcagtgctctccctcctcgccaggacctcagctgtccccaggcctcctctttctttattatctgtggttctgcttcctcacatcctcgctgcaggcaagaaagaagggagaaatttctctgtttaccattaaggttttaacagtcactggcacctttttttcaacaaattcccacaaggcccattttaccttcttgacaaagtatttcaaggcttctcaccatctcttgattggcgtcatcggctgcatcgtgtcctgctcttaaattcatgtgatgaaaccccaatcccagtggctctgtatttggagagagggattttaagaaggcaaataagttaactgtggccataaatgtgggaccctaatccactaggactcttgtccttatgggaagtggaagacatcagaggcctctctctccacatgcacacagaggagaggccatgtggggacgcgctgcatgagaaggtggccctttgcaagcctggaagtggcctctcaaaaaactaaccctttcttcacccagatcttggacgtcaaggctccagaacaataagaaaattaatatttgttatttgaaacaacctagtctgtggtatcttctgatggaaagccaagcagattcacagatacaattgtgttagctccgtctcctggagggagaagcagcccaccgaggctgacacatctctcagattatttttataaagaaaaatagatccaagatgaaaaccccaccacatttctgctgagtcattcacttagcaggcttctctgagatcagccctggggggctgtgttctaggtcatgtctctcactttccactatgagaatccatgtagatcatgagaaccagccagatggagtcctgatcccggcccaccttctgctgctccccaagtatcccaaagaaaaccactccagcgtcacccctgtgtcttctactctctaaaatcccactaaagctgaccttaaaccaggagatatttggggccgggctcttgttctcttcttcttagtcttccataaggtccaggtgctgagtaaagcctcagtaaagattgagcttcagttcccctaacccacatcattcccttacatccttgtcatgcatctgtcctctgtgggcactcagggcaggttacacaggaattgcctgaagctggcctcaactgatgtgctgagaccacgggtcatgcacatgtatgattccgggtcatgcacatgtatgattccaggtcatgcaggctctactgcaggacagacctgtgtcctgtggggcacagacagctgctgaccccgggtctcctctaataactcacacacctggtgtttgtgtgtgtccagatggccccatgagcacagcacactagggtggccaaccttacaggtggggccgtcagatggaatggacaggctggtcactcccatcatcagtgatttcccagtgaattttaaataaattaaacaaaattaacaacaaaggggaaggatatgtacctgtctctgggaggtatacagggtcccagaactgtgctgggagtgggtgtgaaacgcccttttgtgtggaaagccctccagcatgagtgaaagctgaaggaatgatcactgtgcaggtggaggatgataggcagctggcagggtacatttcctgaagctgttcctgggtgcatgatggttggatggcccatggtgttgagggctggactcacataggaacaaggaaattatcccatgggaatggcagaaaagaaaatggagatggacacccctggagacagcttattagatttggtggaggaaaaatagaaatttattccaatgaccccagcattttcagctaaataagagttgcattaatagacagaattatgaaaggaagggagaaggagtttatggagggaaaaaaaaagaagataaattaaaatttaaaactatgcaaatctatcaattggcagataacagagtggagctgatgcagctacttccttgttctggaaacctgccagagacacttagcattcctgtaaggccagtctagtggtgatgaacttgtccactttttacttttttggggaacttctcaaacctcctgcattattgaagaaaagctttaatccatgtaacgtatttatttggaagtttcttggctttgtttttattttcagcaacttgaacagaatcatgcacatcatgatatttcggtgaacaacaggccacctacaggacaaaggtctcattagattataatactgtattttcaccgcatttttccatgcttagatatgttcatctgtataaacatctaccatggtgattcagctgcccacagtattcactacacttacatgacatacagatttgttacctaggagcactatgctatcccacgcagcctgggtgtagcaaggtatttcatgtaggtttgtgtaaacacactctatgatccttgcacaatgacaaattgcctaaggacacattgttcagatgtattcctactgtttttcatttttttttagatggagtctcactctgtcacccaggctggagtgcagtggcacaatcttggctcactgcaacctccgcctcccaggctcaagcgattctcctgcctcagccttccgagtagctgggattacaggcatgaaccaccacgcccagctaattctttttttctattttttagtagagatgggatttcaccatgttgccctggctggtcttgagctcgtgacctacatgatccacccactttgccctcccaaagtgctgggattacaagcgtgagccactgcgcctggccaatgtatccctactgttaagccacaaatcatcgtatctcatttctctcccttttttgtccctgttaatattttcatgttgtgcgtgcattcttctcctagctcagtgaacatatttataaggtttactttgaattttctgctaggtaatcaatgtatctccttttaatttgtgtcagtttctagtgctttttttgttaaataatttggaccacttttttctgttttgtgattattgttattattattattttttactttctctgttgctttctcctcattagaagaaaaagctaccgtaatcactcttcacagaatatgcccagggaaaatgccatcacctatcaacccaggctgtcattgtggcatctcttaaaacttcataatggttgaaattttttgttgttgttgttattagtggcactcagacctacagaggattttaagttttgctcctactctaaattaggtggcattgaaattcatcctgcaggcagtctctgataaagtggaggaattgggcagttttgttatgcatatggttcataaaaataatatgagtttaaggttttctcagccaagtgctatatcctgatattttataatcacttctttgaatctctcttgggtttatcttttgaaaatttagatcagaatataaaccaggtttgaggctttttgtttggtgtaaacatctcctataggtcattgcgtgaaaaggcacagagtctatctgaggaggagaactcagggaagcctcacaacaacaggggagacaaaaccgaggtcactaaaaaaatatgaagcttctggctcctgcagcctccagacatgccccacaccctctcattgcacagaaatgaattcctttctctttcctgagtgatctttgccaagattcctctcctccactttgacactttggtatatccatgtgtgtccattctggttcagccagggacacagaaccaggaagacatcgtggcttttctagagggagctggcttggggaatcaatggttggagtagaaagtgtctttgtccatgtgtcacagccctgagggacacgggaagaaggtcaggaagacaggatgaccagacggctggagcaaccagtatgaacaaagccactttctttcctggtgaagaggggcatttggaagcctggtgtccctgtaggggatgaaccacactcacctgcccactgttacttgccaacgaggtgacccgcagagcagcagatcctgagtcaccgacagtggctgcttcctcctccaaaccctccaagatctgtccttccaggagtgtgaacctcagcagatccgcacgttttcaatgggtccacttagctagtgtctgtcctcagccccatccctgggatcctgtcctggtgctgtgtacactgtcacaatagtggtgacagtgacagctggtgcctgcactttccaggccaagaagtttgaaagaagcaagtcacagggccagcctggatttggggcaaacacacaaatttcactctgtggggaagtgctgggaagcagccttgagtcctcctcagctcacgtgtggctgctgctgctcatcccaggtgggacacatgagccctccccatgcccaggatggagctgtttcagtcacagcaggatgggaatgtgtcttctctatgggggcttttgaagcacagctctcctgttcctgagatttgagatttataaagacaagtcccacagagtgaacctgcacaaataagacagtgcaggatccccaggagagacatcccatatgagaagggacaggcaggtcccatcactgacgctggtcctcagaaaccctgaccagctactgaccttcccaggtcccctgttcctggaacagttcgtgtgtctgctcctgaaaagatgcccatcaagagtccccagggttctgcccccttccttgatgtgcctctgggagtggggctggctgggctgtgggtctggcgtgaccctctccacaggtcagcggctcagtgcaggctgcaccgactcggtggggctgggctgtggctgaccctcccagggggagcctggactcttcttaggggtatctgcaggatcccaggttctgggagaacagggaagccacagtgtgtgcagggccccatctccagtaaagtgtttgctgtcgctctgttgacaagggcatatccccaggcctaggggcactgtgggcgcacgaccaatgcgcgagacacagggagtaaggcacagttccctcccattactgtgaggacactagacacagtgtgtgtgtgtgtgtgtgtgtgtgtgtgtgtgtgtgtgtgtgtgtgtccattactgtggggactctaaccaccgtgtgtgtgtgtgtgtgtgtgtgtgtgtgtgtgtgtgtattaggagttttgcagtggcctctgagacccatgatcttgcaggtttagaaattatctgatgagatgttcatccacaggaaccgacaagagattaggtgttctcccaaagcccctggaagctcctggactcactgtgagtgtggactgatccagtgcttccagagctccacagaaggggctccctggtggtttcatagaatccttgcttggggtgtttctgcagagttcactggctttcctacgaccaatttaccattgcaagcgatggcgtcagcagcacatggtgtcacgtgtcactaaaggagcattctgagccaggacacagccacttcatactggggggaaaatgctctgggagcccagacaggagcctctctgcagtgcaagggctgggctgcagggggcgctcaaggcccacccagcacaggctccagccccagagcaggtgcacaggaggctgcggatggagtccccttaagatctgtgtcattcttctaaaaaaatctaaaataagtatttgacaaaaactgctgaagagtccataaatatcctattcaactgcaagaatttatcaatttacactggagatttctaaccctgctacatatcttaatagtaagcatctggaggtcaattaagcttttattttatataaataagtgcaacttttggagaaacacactcatcccccaaataacacattcatgtattaaagcctagaaatattttaaattacctctgagctattcaagtgtgggttcccagtgaagtcctgttctagggaaaattgttctccagtgggagaagctctgtcaacatacagtttagggatatggcagggcacacatggcctctaaggggattatagcttgaacccttagcatcctcctgttgggtaatccatgtgtcatctctccactctttctcatgctgtgttaggtatgaaatagcatcgctcatgaatatgcaaataactgagatgactatagatatctttgtgccctgagagcatcacccaacaaccacatccctcctcagaagcccccagagcacaactcctcaccatggactggacctggaggatcctctttttggtggcagcagccacaggtaaggggctgccaaatcccagtgaggaggaagggatcgaagccagtcaagggggcttccatccactcctgtgtcttctctacaggtgtccactcccaggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagacacagtgtgaaaacccacatcctgagagtgtcagaaaccccaggggggaagcagctgtgctggcatggaggaaatgacaaagattattagattgaagactttctcagaaaatgatattaagtcattaaggaaaaggaacaatataaacgtgtatttgagaaattttaattatttgagagatttttcatacaatatttattctgcaagcaaatttcagggattgaattaataaaactgatacagaacttcctctgtaggtatctgtgtaaacatcaatttctgaatcagtgttgtaaatattttggaacacacacacaaatcacattttatctctacttttatctctatttttaaaaatgccaaaaaaactcattttgtgcatgtagcattttgaattcccaccatcaatgcatgatagttcttggttttccacattcatattgccatttatcattatgagaattgtgtgttttaaccattctaataggtgagtaatggtatctaatttttagttaaatgcacatttccctaataaaaattcacatttaacaattttcatataatttttgccaagatgcctcttctcatatttggttcatttttaactgcattgttttcttttgattagttgtaagtttacttgcatattgattataaaatcatttaacaaattaaaagaattcatttaacaaatatgtgacttggaagtattttctccaagtctgcggctgtcttttactcccttatcagtatgtattgcagaaaagtgtgtgtgtgtgtgtgtgtgtgtgtttatacaaatttagatttaaaaaatgtaaaatgttattcatccacagatcatgtctttggtattatatctgaaatctcattataaaatacagtaatagcaattactttttccacgtctctaatctcaggctacaatcaactcatgagtgtttaagcttcacctacttgattagaggactatcaacctaacatatttggaatacttctgtaaaaagatgtgttcctcttcctattatttctttatttgatcacttattaatatgtgtattggtttatggatgtctatttcatactctgaagaagatccatgctacattattcattttatttttcaaaccaccacggctttattatgtgctgggagctcattgagtttggatcctgcatccttacagctcacctcatgcttttgtttttgaacacttccctgtttcctgctattataataaattctaaactcattttctatattatctttttcatacatagaatcagccatttttctaaagattgcttgcttctgatgttaaagaatagtatttaaaaaattgtaatactgggtatgtgcattgttaatgtggtataagtacttgcaggacctctcaaccaactggcctagtaaactatgtatctaaccttctgtaatgtgattacattaaaaatgagaacacactggtctctctacccaattatgctaccacatggatctttctagccttccttccttgactgtctataacctctcactgcaaaatgaggaaccccatccaaccatatgccattttattacttagctgcacaatttcaggacacatgcatagcagtatcagaaatgtaaagctgtacccttgtaggaaacatgtttatctactagaatagagtgcttatgttcagtttctttacactttaaacttacagagtttcctcattttcaaagttccttaggtcagcaacttcattttccactttcttcagtgaggtcatttcaatgacactgtataatttgatttatttgaaattctataaaagccaaaactgtagtcaagtgaacaacaacatatagaggatattcgaggagtttagagactggtataaaataagttaaaaagacactgtttaagaagattaaaattatttttagtgatatgcaatggttcagatatgacacaattaatttgtctaagcacatagttttgtgatggaaaatataaacctaaatatatacaattaaaaaaaaatttagcagttcattaacccaaggatcaaatgcagattgtataaaattatctcattacttattttgtgagggtggagatttcatgagatgtatgcaacaaagaatgaggtaattttcctgatttgcatataagatgttgccattcactaaagacctttaattttttaaattgttttttttttaaatcaattttctatgtgacccaggtttttttctcttgacaagcaaataacccacaggattattttctttccttggttgagaaatatttccccaaacttcagctcagttcaggcatacactgtccctgaatgggcatttaccctcagatgggtacacacacctgtcaacatgtggactcttctgtcagacaaacgcacctttactcacgtggattcttctctcagacaaacacacatgtccccacgtggactctttcctcagactaccacatatgttcttacatttactctttcctcagaaaacagacatttcctcatgtggactcttgtctcagacaagcaaacatgtctccatgtgaactcttcactcacataagtacacatatgtccacattgactgtttccttacacaagtacatatatccaatgtcgaattgttctgtggcaaaatgatctcaagataatgataatcataaaccccctccctgacaaggcatagatctgtatttttttcattgcaacctaactttgccttattgtcaagaacagtagtttgcagctctaaatataccaattagagacaggtgtccattttctctggaaacgtatttttatgttcttactggacatatttgttgataatgtttgctattatgaagataccccaacagtgtccacattagagaataaaaaatagtaatgggcagattaactctgtgcatccagacccagaaatcctttgaccttgacttccctgaaatgtagacacagaggatggatgagcaatgctgagcagtgcacccatgaccacaaaaagaaagacgtggaaatgtgtcccctccacttctcatgaaaggcagctcatcccctgttccctcaggccctggcgaggagccaccccatgtctgtgcccttcctcagtgtccacaccgtggggtctgcattgatctggattctcttctcatccccgtcaatattagtgtccttcgtaaatcaggtccagctgtggcttctcctcacggggctgttctcagtctgtttgctgtgttcacggaagtcctgtgtgaagtttactgatggagtcagagggggaaaaaatttacagcccagtggtgagactctcctgcaaagcctctggtttcacctttactggttacagcatgagcttggtccagcacgcttcacaacagggataggtgtgggtgccaacagtgagtgatcaagtatgaattctcagggttactttccatgagtacaaataaattaacaatctcaagcaacacccttttaagtgcagtctgccttacaatgaccaatctgaaagccaaggacaaggtcatgtattactgtgagtgacacagtgagggaaaccctgtgtgagcccagacacaaagctcaccgcagggagacaggaggggactatgtggtagatgctgctcagaaccaccagggggcatcaggaccatcagggagggtgcacagaaccaccaggaggggctcaggacaccagggggcgctcagaaccaccagggggccctcaggacaccagagggtgctcagaaccaccaggaggcgctcaggacaccagggggcgctcagaacactaggaggtgctatgaatcactagggggcgctcaggacacaagggagcactcagaaccaccagggatagctcaggataccagggggcactcggaaccgccagggggcgctcaggacactagggggcgctcagaaccaccagggggcactcaggaccatcagggagggtgcacagaaccaccaggaggggctcaggacaccagggggcgctcaggaccacaagggggccctcaggacaccagggggcactcggaaccaccagggggcactcagaaccatcagggagggtgcacagaaccaccaggaggggctcaggaccaccaggaggtgctcaggacaccagggggcgctcagaacactaggaggtgctatgaatcactagggggcgctcaggacacaagggagcactcagaaccaccagggatagctcaggacaccagggggcactcggaaccgccagggggcgctcaggacactagggggcgctcagaaccaccaggaggcactcaggaccatcagggagggtgcacagaaccaccaggaggtgctcaggacaccagggggcgctcagaacactaggaggtgctatgaatcactagggggcgctcaggacacaagggagcactcagaaccaccagggatagctcaggataccagggggcactcggaaccgccagggggcgctcaggacactagggggcgctcagaaccaccagggggcactcaggaccatcagggagggtgcacagaaccaccaggaggggctcaggacaccagggggcgctcaggaccacaagggggccctcaggacaccagggggcactcggaaccaccagggggcactcagaaccatcagggagggtgcacagaaccaccaggaggggctcaggaccaccaggaggtgctcaggacaccagggggcgctcagaacactaggaggtgctatgaatcactagggggcgctcaggacacaagggagcactcagaaccaccagggatagctcaggacaccagggggcactcggaaccgccagggggcactcaggacactagggggcactcagaaccgccaaggggcgctcagaagaagcagggggtgctcagaacaccagagggtgctcagaagcaccagggggcgctcaggacaccaaagggcactcatgagactgtggcaagggggtgctgagaaccacaggatgtgaccaagacaccaaggggcactcagaactgccagggggtgctcaggacaccagaggattctcagaaccaccaggggatgctcaggaaactagcgggtgctcagaaccaccggaggacactcagaaaaccaggggatgctcaggaaccaccagggggcgcccacgacaccagagggcagtcagaaccaccggggcatgctcagaaccaccagggggcgctcaggacaccaggggatgctcaggacactaggggcgctcaggaaccaccaggggacgctcaggacactagtagggtctcagaaccaccaggggatgctcaggacactagggggcgctcaggaaccaccaggggtcacccaggacaccaggggtcgctcaggaaaccagagggtgcccaggaaaccaggggaggttcaggaaccaccagggggcactgaggacaccaaggggtgctcagaaccaccagggggcgctcaggaaccaccagggggcgctcaggacactagtaggcactgaggaaccaccagggggcgctcaggacactagtaggcactgaggaaccaccagggggggctcaggacactagtaggcactgaggaaccaccagggggcgctcaggacactagtaggcactgaggaaccaccagggggggctcaggacaccagaggtcgctcagaaaaccagggggtgctcagaaccaccagggggcactcaggaaccaccagtgggtgttcaggacagcaagaatggctcaggacaccagggagcactcaggacctccaaggggctctttggaggcagctccatatcaggtacctggggaggatgaggtttccttttccaccttggtgattcctgacctggtcaagcaaaagtcttccccaggatctcttacgatgtcttccttgtaactcatggtttctttcacctataaaacattaacttagaacaggggttcaattcaacttttaactctgcctattttcagagttatactagcaatgatatatctcagtatattttttttaattgtgtatattcaatccaaagtctggctctatgcacaatttttttgttttctgtgctgtcagacacactattgtaaatgcttttctaacaactcagcatatgcatggggtccagtttcttttcctttcatcggctgtttgtgcagatgaaacaccactttaagggctcctgtcctccactttggcccctggtgttctgcttctcaaactttctccatcttctctttttctgtcaaaatattttatcttcctcagtctccatgcaggaaacaggaagtccttttacttcctgtcctccatgtctggtaaatcagttcacttcttttcatgatcactgaagccaaccaagtttaggagagtaacagttctccttagaatacactctacctgcagaccctctgccctcatcacacttttctagggtcctgcagacataacccccacccattcctctttttccctaagtaccacagactaggctctgcaacttatgctaccctctgtgtgctcagcccaggggctcagtagtgctttcatgaagtccaaatccctaatgtgtttgcccactctcagaccaccctccagcaagctgccattgtgattgaatcctgcaaagcatgggctgctttcagtttcctattgctggatgttctttattataaaggcatattggcaaataacgactagagtttgtattgaaaattaacgccaaaaagttttttaaaaagtttttcaaatagaaaagttctatcctgcctagtttaaaaaaatacaatgttactttaatcaatgatttaataaaaatttaagtgatgtttgtcttattagttattcaatttattaataactgactgatatttaaaaagtaaatactggctgggcgcagtggctcacgcctgtaatctcagcactttgggagggtgaggtgggtggatcacctgaggtcgggaattcgagaccagcctgaccaacatggagaaaccccctctctactaaaaatacaaaattagctgggcgtggcggggaagctgaggcaggagaatcgcttgaacctgggaggcggaggttgcggtgagccgagaacacgccattgcactccagcctgggcgacaagaccaaaactctgtctcaaaaaaaaaaaaaagtaaataccattgtacacttaagtaatatatttggcaagaatggcatttacattcattcaaaaatgaaactgcaaatacgagttacattcaattaaataattaaaataatatagaaaaaaatgggtgtgttgttttggtgtttaatatacattcatttttgcatggacgggtatatgtgtcattgctgggctgttgtgtatgtgtgcgtgtgtgtgtgtgtctgtgtgtacaactatgaagtttaaaatatattattaaattacgtagttatattaatccaaatttatcatgttaaaatattaggaaaaaaacaccagtagagaaattacagagaacatcagcaatgcctacagcatttacaagagtcacattaataacaaacaaactagttcaaatgtttagatatgacacatgcagtagaaaacgttcacatggtattaacacaaaaatggtgcacaactgaggaaattataatacgttcatgatattggctacataaatgcttatgatagtaatgcttttcatccatcaaatgcttatgataatgcttttcatccatcatattatagatgataaaacaactctataaacacttccatcactagcgtttaatatgagatgcctcacatctttttctgaaataaataaacatctgtccaccacttcgatgatcatttcaggattatcctctgaaataattatccataataattttagtaacaatattattttcagaagcctattttataaggtctttgaactattatttttatgattgttactttatattttacacactttttatttggaataattataggttatcagaacaattgtaaggaaaatacagtgtgttcacatccatctccaagttttcactaaagttaatatgtcaaaaaaaacatgggacatgggactaatatatttacattgataagtttctgtttattcagctctgggatttatttgaattttgccaatttttaacagtttccttttttcctttttcttttctttttgagataaggtgtcactttcctattgctttttgtttgtttctttgttcaacccacgtaaccacatcaaattcagtcaccatgttcctctcatatcttctggttaatcacagtttgggttcctgctgtcttcccattgaatattctataaatgaaactagtcaaataagttgattctggtcacttatatatttacctattttatcacgtttgttttgtcaatcacagtaagtgtcgaattcgctatctgttatagatgttagcctattttctatcccagatccattggttaaatctttggtgatgccttttagaaaactgatccctttaccctatgtaatatgccccttgattcctgaaagtcttatgtctaccttgtctgaatttaacatagctaagcacgctttcttttcgttcatattttcatggtccatgttttcctgtatttaacttttctatgtagagcaaatttctgtacagagctagtagttgggtcttgctttttaaatcaactataataattctattttaaaactggtattactatttttctgttaatttctgttttaatttggcattttatgatcatgtttatttctctattaacttattgtttagttcatcttttatgaatattgtattggccctaagatatacaataagaattgtgtataatcagattctaattcaaataacgtaaaacctcttcataggttgtagagctattataacttattcttctaaacactctttctcatccgttgtcttagtttattctcagtttgcacttatatgtgctataaaatataatatgtgcatttttatcattacatagacatatattagaacaattaaaaatataaaaactacatttcaacttcattttttcattcttgaccacatgttttatttggatagattcatgtttcggatgtatatcatatggctactcaccctggcagaaaatttgccaaagcacctactgaaggatgaatgcactagcaataaattttctcagaatcgatttgtcttacagggtattcatttgactttcgctttaaatgaaatttttaatatatatagaattccagtttgactttaatttgtaatttattttcttgtactcatgtattcattattttcttcctgaagatggtcacacattccattctgctgggccttcattatagatatttgtgtgtatctattcagggctatatttgcaatttatggatgccacaattatcagagttgaagtcagcttctgctgtccacagagatttcaagttcctcccatgatacttgcttttgtgtccctgtttgatcctgggtctttatatttagttttccccagggaggctgtctgtttcagctgtggaaagtgcaccctactgacagtttaaattgatgactgtgtggtgaaggaggttggacaaagcgggacttcctccaaccttctgactgagtctccttcttatgcaggagtagtaagcatagttctggggagtggccttccacattgtcctgtccttaactctttccccagggctggaacgtcttttcccagacacaactgtttttcaccagtgtccccagctttttacccactatccttaccctaaagagtaaggatttctttcctgaggaaggagatgggaggtgtttctggatcaagtttccttggtgtcgtctgtttccttttgtttctgttgacttcaccacagctcatatgacacatgctttggtggatttcccctggaggtagtggaggtgcattcaggcattccacaggagctgctgttcttttccccagtcaacaccacaagacaccagatgaggaagttgtccgtggatttttcaagttctctaggaaaagcttgcaagcactaggccaatctaacaccattagtacatgcatactaaaaaaaaaaaagtcattaagtatttctaggttagtctgtttctatctcaaatgccatccagtggcacctgccctacgtacactagcaggtaggtcctggttctctctgcaggctcctatcttctcagatttcagttttcttgtttgcttggtgaaatcaactcagatatgttgaatgttttttctctcttttatttgtagctgttcagcttcgttgttaatgaggtcagaataaaatcacagttttctcatttttttcacattcccacactgaatagctgctttccgtataaaagccagaaactgagagaacacattgaatatccattacaggtgaatgttaaacaatttgagatatgtttgtgtactggaataaaatgctgcattacaatcaagtcatcactcattcacataaaacatggccacattctcaaataatgtagggacctgagtgcccctccatctactggcctctcctggggccctagcctggccacaccttcttgcagggcagtcttggacgccctgggatcccgcaccaaaatttctgccctggcagaacatgcctgactggtggagagctccaatcgggcagccctcatgtgcacacaccagcttacacacttcctccgaatactgtaggttcacccaggcccacgtaacttcccacatcactttgcagtcacatgtctgtataggtgggttttgcttttcttgtcccaccattgcgtggagtgcagtcccctccccccaccccaaccaccatggcagaggaagctttggtggggaaaaagccagggccgctcctgtcagcgtcccgcacttgcgctaattctgcacagagaatagcagatcatctcacacattcagaaatcactcctgcttgtggggcatgaatacggcacccgggcctgtgcccacaagtgtcccatccctgagccaacacctcctccagtgtgaccttgaacacagtcaccaacagggccccacagacgcaatgcctctgccactgtggcgaacacctgcagggaggcaggcacccagacacccactagcactctgccacagctgccacacctccaacagcccaggacagtggattcctaaccttaaggagccggagaaccaagtcagggactagtataacttcccccagagtcagagcacacagtctaggtgttgggagctgagcactggccacctaaatttttccagaaatgaagccagttggctgaatccaccttataccacaatcaaaccctcaaggtcatccaatagggtaaaagaaaataaaaatgtatccaaaggtcagcaacttcaaagattgaaggtggataagcccacaaagatgagaaagaaccagtgcaaaagtcctgaaaacaaaaagggcgccctctttcctccaaacaaccacagcacctcttcaacagcagttctgaatggggctgagatggctgaaatgacagaaacagaactcagaatatggagagtgaaaatgtagatgaatacagctatttatggagaatactataaatgttcctcaaaaaataaagaaacaaaatctactgtagaatccagcagtctcactgctggctatgtatccaaaggaaatgaaatcaacatgtcaaagagatatctgcactccatgttcacgttcattgcagcattatttaaaatagtaaagatatggaaacatcctaaattcccatgaatggatgaatgaataaagaaaatgcatacagacacaacagagtaatgttcatccttaaataagaaggaaaccctgcctctgtgacagcatgcatgaatctagaggaccttatgccaagtgaaacaagccaggaacagaggaagagtcattcatgatttcactgtatatattaaagcagtagacttgcagaggtagagtagaatgttggttaccagggcctagaggggtggactgggaaagggagatgtgggttaaagtgcacaacgttccagttagaccggaggtataagttatgcctttctaatgcacagcatgtcaactatagctgataaggtagtatatatttcaaaattactaaaaaaataaacattagaatttccccactaagaaatgataaatttgtgaggtgatgaatataagcggcttgagttacccagttcataatgtatacatgtatcataactaaacaacatatgtcataaatatatgcaaaaattatttgtaatttataataaaataagtttcatatttaaataattacattaagaaaatgaacagaaactttcagatttcaagaatattttatatatatatatatatatcttaaaacaaacttgcaacagaatatagaaataagttttacgactcaatggaaaagaacagaattcaataaaaactggctaaaagaaacaacagctgcatcattatagaaaattctggaataatcagccatataaagattctcactctcttagaactagaattccgtaggacttgtaattcctcctgacctgggtgggaggcaaaaggaagaacagctaatggtgattcagtgagttttatacctgtgtgtacttctgtgctcactcagcagaaagaaaagaagaaaagaaagaaagagagaaagaaagaaacagaaagaaagaaagaaagaagaaagaaagaaagaaagaaagaaagaaagaaagaaagaaagaaagaaagagaaagaaagaagaaggaagaaggaaggaaagaaaagaaagaaagaaagagagagagggagagagggaaggaagggacagcagaagtcattgtggtgtgtgtgaaagcacaatccttgggctcccccacatccatctctactccagtcccatcaatgtccagcaaatacattttctaagatgaagtattttaaactttctaaatcctgctagaaaacccctcagctctttcagttttgctctatcacttgaattattgaattaaatctagtttttgtgggcctatcaataccataagccaaaataacacatgaagaaattgcactgagacacatgaaaaccttctgaaagctccataatttcagatctgcattcttatttccccgaacctaaatcactgaatagagactcagaacgagttgatcttgttcctgaacgtgcacagagccaaggacatcctgtctgtctggaacagctcaggtttgttcctgtttctcctagaggatataaaatcttgagttagggaaaaacagccagggacaccctgggctttgttcttctctcccctggaggcaggatgtccttcagagctttgtcccagtgggtaacacagctgctgaggtgtacaacccacgtggcctcgttttggtcacttttgcatggtgagcctgctttgcaccatggcctacaatatgcgtgtgtaactaatctgtctccatcttcaaaatgacattattccacatcaaatctagtgcaggtgcctcacacagaacattctcaattacctccatcattcataaaattgatgccattaatttcaagtatacatacatcagactcatttaacgtattgttattctcattgtttgaaacataacttttagatcaaataattaacaataataaaaatataaattttgaagtcaggtaatgtgatttctctagttgtgttctctttgctcagaatggcttgggctgttctgcatcttttgtttttccacatatattttaggattttttaaaaatttctgtgaagaatatcattgttgttttcatagggattgtactgagtctgtagattgctttaagtattatggacattttaacaatattgaatctttgaattcataaacatggaatattgttccatcttgtgtcctctttatttcctcaatgttttatagatttattgtagtttttttttactttgttcattacacattgtatgcctgtaccaaaacatcacatatacccaacaaatagaaatatatatactattatgtgcttataacaattaaaaattatgtatgtatattgaatctattcaaaatcagaaactatttctttttactgtttgtaaggtcttgtctctaggctataaaaagaatttgtaaaactcaacagaaagcataatataaacagaattctaaaatgagtgaaaatctgaacaaacacctcaccaagaaaaaatgttatctgaaaataagaatatataaaattgttcagtatcaattgtcataaactgatactcatatttaccaaatacaaaagtaaacatgatgtatttcaacagaattgattctcaaatatttgtatactcatacagtggaatactatcagtcataaaaactatgggttattaattcagaagacaacattttaacattttttctaagtgaaggaagatggacaaaagagactaagtattgtacaattccattcatgagacctgctaaatacagtaaaattaaaaggattttaaaaacaggtttgtgataggcagggcttttggggaaagacaagagactgacttggcaaagctcaggggatatttttagggtaaaacaaactgtgtgccattgtgatatgcctaatttcttattatatttgttcagagttaatagtgtacgtttcaaccaactcggtgattttatattttctatttgctgatagagacatgttcatttttgtcaatcactttgctaaatgtggctgagaggctgttgaaatgaacgctgagcaaatgtattcaccaaatctacaagagcaaattatttgccaattgctgattgagtggggtctataatgtatttgagattgggtgtggggatgttattgtgtgagatcatgatgtttagaccatgacactctctggtgagggatcactcattcattgcacatttaatgaaaggcaggtaggaggagcagaaggggatgagtcacactcctgaccacagccacaggttattgaaggcagaactgatgtaatcccctaaggtagaccactgcccctccaaggtgaccttatcctagagttgacacacatcctgggacaccagagacaactccttctctcccctttctctgcacttcagctggaagcaactgtctcaccgagcaccttgtgttaaggaatgagagttcctgttccaggtgtgagggcccaggtgcatccacttgatccagcacaagagcaagaacagccttccagaaaatgacatcgcctgaggtataaccagctctcacctgctgcagcttcctctgaataaaaaggaaactgttgaaacttcctcataagtgtcctgctgtgccattccctttgtccccacatgttcagttgtgtctgtccagatgtcacttttgtgtagggagattagggttctgcttccagtaccagaacacacatgacctcttaggggacttcagggttttgctgacatatgtgatgatcttaaaagtcattagctccatttctacatcaaaaaacatctgaaccaaaggagcacataggctcaggcctgtaatcccagcactttgggaagccaaggcagaggaatcacttgaggtcaggaatttgagaccagcctggtgaacatggtgaaaccccgtctctactaaaaaatatatacaaaaattagccaggcgtggtggcactagcctgtaatcccagctacttgaaaggctgaggcaggagaattgcttgaacccaggaggtggagattgaagtgagctgagatcgcaccacttcactccagcctgggcgacagagtgagcctccatctaaaaaaaaaaaaaatttatatatatatatatatatatatatatataataaatatatattatatatcatatatatattttatataatatatatgtatatttttatatattatacatacatatcaatatatgatatataatatgtatatataatatataatatgtatattcatatattatataatatgtatattgatatatattacacatatatattttgatatatatatatctccaaaccatctaaatatcaagtattttttaatccatctaagagctgaaattgctgaaaaaactactccctccaaaagctgtagagacaggcacatccacagtcacagcagagacttgctgacttggaagagaagctcctggagacacattggtgagaacatttacctggtgattatgctgaatgtctggaggacaaatgtggactagggggagggtgagcactcctagaggctgtacaccccacacttgtgtggacttgccctccagggccttcaggttctcgtggaagcaattaaaatagattccctatagccatgaactggggaggagtaatcacggagaaaagatgcacaaaaagacttttctagaaagctcatccaagggaaggtattctccaaaatcttagtttatgtgggggaaggaaatacttccaaattacagacccctcctcctcagccttcctctatcacgcaaatgataaaattagccaagaggagtcagattcaaggcggtagccctgggtgcagcatctgcagaagggaggaaagagagaaaatcagctgtatcactggagattccttgtgaaggtcactgctcaggagaagagggcaaccaaaccagggagagtcaactgtaagaacataccatgctcccctgccccacacattacctcctcaacagcatcattaatatggattaaagagggcagtgtgattgctttagatctgtttgagaaagaaagtcacatactgaggcctagggtcagggtcggcggcacttcccgtgagtaagatactacgaagaaggaaaaattaggggtccataactgtgaaaatcagccacagtgtgtgtgagaatgtttgtgtttgtgtttctgtgtgtttgagtaggagttattggaacagcggacgtggagtgagctttaatccacatccatctgcagcttcaggtattctcagatgcagtattcatctgcaagagccgaaatgagaaaagagccacctccaacccccccagagttttagcctccctttgtttccagtgatccagtgcatctagacctccaggaagtggactccctggtgattttagcgattcttctcttggagccaccctgaagaggacattgggtttccaaaggcccattcactatttcaagaagtggtgccatcagctcatgttgtcactgaaggagcattctgagccagggcacagtcacttcctagtgagctacagaggctgagagaaaaatgctctgtgagacccaatgggaagctccctgcagtgcaaggtctgggtggcagggagcgctagggcctcgcccagcacaggctgcagccctggagcaggtgcaagggaggctggggaggggttcctcccagggtctgatgtcttccttttctcggacaaacatgctttaataagttaaacaagactttagtaaagactattgatgtgtctttgtgtctttcagtatacagttctatttgtaggatttatctaacctaacaagtcaatgagaatcacatgtaaaaggagaaatttctaggattttcagatatcttaataggtaggagatggagaaaagggatggttttattaattcagtgcttgccaatcttaacagagacagtagtaagacatgcagaaagcaaagcccagaaaagtatgaaggtgtcaaagtgccatttaagtatgggttcacttggaggaccatgttctgcgggaacttgttttcagcagacaatctattttagcagagttctgggcatacaaggggacacacatcattaaacaaggattgggacagggacttcagcgtcccactgttgcatggcccataaattatgtgtgttctctttctcatcttggatcaagtctagagctatgaaatagtatccctcatgaatatgcaaataacctgagatttactgaagtaaatacagatctgtcctgtgccctgagagcatcacccagcaaccacatctgtcctctagagaatcccctgagagctccgttcctcaccatggactggacctggaggatcctcttcttggtggcagcagccacaggtaagaggctccctagtcccagtgatgagaaagagattgagtccagtccagggagatctcatccacttctgtgttctctccacaggagcccactcccaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagacacagtgtgaaaacccacatcctgagggtgtcagaaacccaagggaggaggcagctgtgctggggctgagaaatgaaagggattattatttttaatgttgtttacagtatgtcattaataaattgaaaaaaagtaacaatagaagtatatactctaattatatgggaactttgttttttcagttttttcatttttttttttttttttggtttgtttgtgacagagtctcactctgccacccaggctggagtgtaacggcacaatctcagctcactacaacctccacctcccaggttcaagcaattctcctgcctcggcctccagagtagttgggattacaggcacccgccaccatgcccggtgaatttttgtatttttagtagagacggggtttcaccatgttagctaggctggtctcaaactgctgatctcaggtgatctaccctcctcagcctcccaaagtcctgggattacaggcgtgagccactgcgcctggcccaattatatgggaattgtttatataattatcaccctataagcaaaattcatggaggaggaaaagctctactgaagaaagctgataccggcattcccatgaaagtatctgtgtagaagtaagtattaaaatcagttgaataggcaaggcatggtggctcacgcctataatcccagcactttgggagaccgaggcaggtggatcacaaggtaaggagttcaagatcagcctgcccaagatggtgaaaccccttctctactaaaaatacaaagaattagctgggcgtggtggtgggtgcctgtaatcgcagctattcgggaggctgaggcagagaattgcttgaacctgggaggtgaaggttgcagtgagccgagatcacgccactgcactccagcctgggcgacagagtgaaactccatctcaaaacaaaacaaaacaaaacaaaacaaaaaaacagttgaataaagtaccttagagtcatctgttcaattaacatgtttaactccaaagaaatactgaaaatattttccaaaaaggaagtgccattttacgttcctaccaacagtgaataagattttcttttctggagccttgtcagtattcactaatgctttgctgtgcagccgttgtaatattatagtaaatgagtagcagtatttaatggttgttttaaatatacatattcttaatacaaagtcttgatgaacacttttttatacattgttttatgaggtgtgtgttcagatctatgtatgccagaaatgcctggcagcgttaatttaagcacactgtgagaatgaccctatagtttatgaagaatgtatgttcagagctctgagctaagaaatccaggagctgtcaacccagaagtttattccttgtctgtgaaggacatctgaatccctggcctatcccttggaacacaggatgtccaggtgattgatgctctttgttaaatctggaggttgctaggtagagggtgctaagtgaaaatcataatataaactacacgtgttttacaaatggtagtggttttcctgtccaacacacttttcctgggccacattgtatgcaagtcctcaatacaccctaggtcttgttcatgggctccaggtctcctcttcagccttttggacatggtgccatgcctattacagtcaataggggtctagcatgacaactggtaggcccagaacaaggtcaaagaaaatcctgcaagctcttagacaacagtgtcaaggaaggggagacctgtggggaaatcccaggcaggccatgcacatctctgtgggcccaacagctgcaatccttgatggatggggcccgctgcatgtgtacggggatgcctccaaaatgccaaaagttctggaggacctgttgcctgaggtggatgtgacaatgtgacaaagtgacagtcagattcctgagctgtggcagctgttggccactcctgactgcactctgagcaaccactgaggcagagctcattgcacaggctagggtgtgtcagccacgagaacagttgtaactataatgagatgccgcctgtagggataggatagcaaattggagaccattgtttatttggtaggccatttaaagtgttgctgactgccacaccaatgcattaggactactatgactacgtcatcctgggagcctaagtcctggcgtccgatgtagagctccagtgggaaggagatgaaggttaggatgagtccataaaggttcttgctctgcagcccctgctttgctgtctcacttggtgaacagagaatgggaggtcaatgcggacaaagtccagggtccaggcttatcagtcaaatacttggtgtcatctggttacataagactatagttattccatatttcatcatagataagataagatgcaggtctactcatgtcccaccacaccaaagcagttggaaacctcccaaggcctcctgggacattggcgatcctttattccccatttcggcaaaccccttgggcccccatggcacttagacaagaaggtgccccactgcgactgttccaaaagggaggatgagggctctgaagaagctgaagtcacagtgaaatgaatacaaaccttgggagttctagtgcagggacagccctgtgaattggatgtagtcagttaccctgaggggtttaggtggggactgtgttaaaggcaaggacataagtgtgtgtccctaagaccctggtctcaaagacagaaggaagctgaagtgagatatactgtttaggagtagcaactgcactacatgtcatgccttacgagtgtaggatgtgacaaagagggccactccacatccggaacaacctttagcaggctggctaaaggatgccttccagacacaaaagccttggaatgccaggacacagtctgtagccaaatggtacttgtggtggtcaccaccaacataaaagtgggccaactgtgccagcagaagttagccccacagaactttcccccacctaagagaaggcagtgcaccacaatgcggaattccaccactgtggaattgggggagcttagaattggattcagacacaaggggagagagtggatcacagggtggcttctctatgggatagggggtggagagtattatactctctggactcaagatgagtaaaatgacacccatcacaaaccatccagccctatgatggcacctttatggtaagtggttgcaggctccaagggggccgggtccaatgaggaagatgcccccacagctcgttctcaatggcagactatagaagagttgcaggatatcttctgggagtcgagatgaggcatgctaattatgctgagaattattgaagtcccaacaatgaattgtttactgcaaaataaaagctacagttatgtattcagtgcctacccaatggcatggtgcactgatttccacgttaagccccctgggagggcagccaacatttcatgtgccccaggtagttgctgacttaggagaaaagaagaaactgagtaagcaagggatgcaccctactgtgatgaagaacaatggcaccaaaggaagagagacagccaaggagccagtcagggtggccagacaacgaatgtgctctaactggcaacacctaccagttctctgggcccatagcggcaataggtggttatggaagggccacggaagtcagaccggttgaactagtgatacgacctgggggactgccacccagaccctgtgtagtatacacagcttccatcctagaacacatgagaatggatatcttcttaggcgtgaccctccaaacaacggccagggaattccaacggagagttagagtggtgatatgtgtgaccaagcagaaggcaaactggatgccagtagagctgccaacccatggggagtcccacagctggagcaacaccacccgccctgggaggggaagatgatccaatcatgaagattgttaaggagctagcccaggtaggcattaggaggccactgcatggttcctacaacagacctgcatggcccatgcagaggccagttgagacatggagaatgacagtagattactgggagttaaataaggtggtctcccgagtgaatgcagctgttcctaatatctcctccagtctgacgagaataggagaggtgttagccacgtagcatttccttatcagtttagtcaataccttcttcagcatttctgttgccccagagtcaagatcaatttgcattaacctaaaaagaacaatggacttttactgtcttgttccagggatatttacacagcccaaatctcacagcctagtgacctccaacctcagtcgatgggctgacccaaaggggatacatgttttccactacattggtgttatcatgataacctctgagtcttttttcagcttataaattacagcccctgtcttgctgtctcacttgctgaatagaggatgggaggttaatacagacaaaatccagggtccaggcttatcagtcaaatagttggtgtcatctggttgggtaaaactaaagtcattccatctgccatcatagataaggtgcaggcctacccacgtcccaccacaacaaagcagctgcaaactctcaaggccttctggagcatcagtgtccttttattccttttatttgacatccctgaaggaggctgctaggggagactgtgtccctcctaaattcatgtgctgaagtcccaacccttggtccttcagaatgaaatcatacttggattagtgtcctttaaagaggtgaataagttaaagtgagattcctggagtggggccctaatgcaatctgactgttgttataagaagaggaagcaggagggagggtgcacaggccccgagggacggccatgttaccacagaacagtgagaaggcgccatctgcatgccagggagcgagacctcagaggaaacccacccagctggcagcttgatcttaggctttcatcctccataagtgtgaggaaattggttttgtattgtaagccatccgatctgtggtatttcgttataaaagccctataaaatgaatacagtaggtaataggagagcttctatacattgaaaaagtcggatggccagaaaaacctagacactcctgttcagacctgagcagggtgatggacctgctttgggacaggagaggggaagagatgaacccagcacccagacccagctgagcccattcctcagcaggccgtccctgggccggagcttgcacaggtgtgaaagagcctgtcttggtcttcaggggctcatggagttggacggagaatggtgtagactcaagaacacgtcatcggtgtgcccgtgtttatctgaatgggatgtgtttctagggtgtgctcatccccaaagaagaattaatcaggtctcttgggctaaaaagaggttgtggcatttgtgtgtattaataactgtggtcggacagtaaattatgttaaactgcttatgggaaggcacaatggaaagaaacactttgttacagaaggaaaaaaaaggtgattatttaaatgaggtgcctttgaaggtcaccatgccaagaggagcccatcacatgatagtgctggctttcatgttcaggagatcaggagggtccgtccgctggcttttatgacaccctagacagagctgagagtgtaatgtatgaatggaggggaagtggagagaggggaggccaaatgtttggtgggaatggagggtcactattggagccattaggaaatacacaagcatgaattatgctggaggacagaacagtgttcctggggaatattgtgttgctttgggagctgctgaacatacaggagtttcactgttcctagttctcaaattctctagactctctggacaacccagttttaaatattgggaatataggtaagacacattcgttattaaaaattattaagagaagatgtaggaagaaatttaaagtaatccatttggttatgaaaatttagttacagcgaactgtgatgtccgtttcttacttggaataatggaatgtaagtcattagtcatctcaacggttcatttttccataaccatcaattacaaaactgctgagtaatttcctgaattgcccaccatagaaactgacctcacatttcctcaatgagaaactgccagtcccgttgatccagcctcgttcttcccatcagggattttgtatctctgtggacgtgtggcacagtgctgcatatccatcggcatatggcctcaggaaaggcgccagcctatccatgcatgatgaagcttacttaggggatgaagcccgcatgctgggtgagccagtgccaacagctgaaagaatcaactgcctggtgtatgatgcttttatgaaaacaagcccagggcctcttgcattcttctgtattagattctctggtgaagatttttattcatttctgcctgaaattgccacatataattacctggaagcattacaataaactgatttggaagttaactgacttcctggtgaggttaaaatgagtgtcaggtgcatagtgagacagaccggagacatggatgcatagcaaacttgtgctcaccatggtttctatcttagttagggaaacttctgtaccttccttagatgttcaggcactccattgaggaccctggcataacattatttattgacagaccatagctcaaagtatagaactggatactaccaaggaggatatactattactattttatctttatcttaaaatatactcttccatctgaggtgaaaattaatccagatggtagaacttattgcagttactacagcattttagcaaatcaaaagccgcagaacaaacatatggacagatggcaggtatgttttcggaatcgtaaacaagttcgtgatgactgtaaaaccaaggggtgtctcacgagggctggaaacctctcacaatgaaacaacacaatgaggatctttgaaaagtactctgacctcctggtgagctggctgatatggaggctgagctccatgtagaaagccaaaggaatttctgcaggacgtcatcatgccaagcacagccgtaacctgggtcccagcccttttcacacgctcaatggttagatcttgggagggaatcaaagaagccatagtaaaatatcaaaatttaaaccccgattttgaatttaaaaagtgttaaaatatggttgtggcctacactcagaaaatctgtgtccttcagatggtttctcagtggcaccagatggtttcaagtggctattcattaagtttctcagtgaaattaccagacatagaataaataaattgtcactgtcttaaatcaacccatgggaaaggaaaactgtgtaaatacagcagagaggaaacattgctcaagggaaaaacaatctccagaaagtattgttaaagaaacagaggccctctttccagccagcgccgagcgatgggcacctctcgggacaactggcacaagggccgcaaagctgggggcaagagaaggccctgccacaagaagcggaagtatgagttggggcgcccagctgccaacagcaagactgacccgtgccgcatccacacagtccgtgtgcgaggaggtaacaagaaatactgtgccccgaggctggacgtggggaatttctcctggggctcagaatgctgcgctggtgaaacaagggtcatcgatgttgtctacaatgcatccaataacgagctggttcgtaccaagaccgtggtgaagaattgcatcgtgcccatcgacagcacgccctaccgacagtggtacgagtcccactgtgcactgcccctgggccgcaagaagggagccaagctgactcctgaggaagaagagattttaaacaaaaaacgatctaaaaaaattcagaagaaatatgatgaaaggaagaagaatgccaaaatgagcagtctcctgggggagcagttccagcagggcaagcttcttgcgtgcatggcttcaaggccgggacagtgtggccgagcagatggctatgtgctagagggcaaagagttggagttctatcttaggaaaatcaaggcccagaaaggcaaataaatccttgttttgtcttcacccatgtaataaaggtgtttattgttttgttcccaaaaaaaaaaaagaaagaaaaagaaacagaggcatcacacttactagaaaaacatattctatttcatatattatggggatatgacgtgatgttttgacatatgcgggcattgtgaaattattaaatcaagtaaataaacatgtccatcacctcacatacttattttttatggtgtaaacgtgtaaaatctactctcttatcagttttcaagtatatagtacattagtatcatggaagtcaccatgctgtgcaatagatcttcaaacgaattccttctatctaaccaaaactctgtaccctttcaccaacgtctcagctttcacatgcccctgacgccagcccctggtaggcaccattctactctctactctgagttcaacatttttagattgcatgtgtaagtgagatcatggagtaattttttatacctggcttatttcactcaacataaagagtcaaatgctcaacatcactaatcatcagggaaatgcaaattaaaaccacgataagatatcacctcacacatgttacaatggcttagtctcagtctgtctttttgttactataaccgaataccagagactgggcaatttctaaagaaaaggaatttatgctttatggtgcttgagtcagagaagtctaatatcaaggcactggcatctcacaagggccttctcactgcctcatctcacagcagaggtgggtgagcaagagaccatttgtccacgagagaaaagagaccatcttttattagaaattcactcctataataactaacccactccattgatagtgacagtaatccattcatgaggacagagccttcatgacttgatcacataataaaggtcccacctctcaacactgttgcattaaagattatttccagatcctaaactttgggagacacatttaaaccatagcattccattcctaatatcaaaatttatgtccttatcacaatgcaaattacattcattccatcccaattgtctccaaagtcttatccagcatcagtgcaaaagtctgaagtccaaagtctcatctaaatcagatatgagtgtgactcgaggcacaatttagcctgatataaattgtttccatctgcgagcctataaagtcaaaacaagttatctactttcaaatacagtgaacaatggggcaggtatgggatagaaattcccattccaaagctcagagagaggcaaggagaaagcggtgcctagttcaaaacccaacagggaaaaaaacattaagtcttatagctggaaaatcatcctctttaacggcatcttgtgcacactggggagggggatgggcccccaaggcctccggcagtcttgcctctatatattttctgggttcagtccactcagccgctctcacaggtgggactctcaggcctctagctctcctaggctgactggaaactctttgtggtacctccaaacccacatttctgcttggcattgtgctaagggcccagtgtggtgactctgtctctgcaacaagtcactgcccgagaccttaggctgtccttaggctgcccgagaccttaggccgtccacagcattctttgaaatctaggtggagaaagccatgccctcgtggttcttgtattctgcacacctgcagaattaacaacacatggatgccatggaagttgatgacttgtaccattaaagtgatggcttgagccacacctaggtcctcctgagccacagcatgggcagccaaggagtgctgtgcctggacaccgggaacagagtcctaaagtgcctgctagaagtcaggccatagatttccttcaaatttctcccaccatataacctcgttcatggctctgaacttccaccttacagaaggacctagggatgaacacaattcagccacgttctttgccactttatggcaaggatggcctttgctccattttccgatgagctattcttctttttctcctgagacctcatcagaacggcctttattgtccacggttctactgacattctaatggtcatcacctaaataatctctaagaagtttcagaatttcctcacagctctcttcttctgagtcctcaaaagaatcacctctagtgttctattcagggcaatccagactttttatagtctgatcctccaaattattccagtctttgtgcattactacatccacttctacattttggggtatttgttatcgcaacagccccacctcttgatactgatttttcgtcttagtccactttgtggtgcaatgagtgaataccacacactggctaaagtataaggaaaagaaatttattttctcgcagctctagaggctgggaagtcaatatcaaggtgttagcatctggcaagagccttcttgctgtgatgtccatgtggaaggcaggagagcaggtgcgaaggatggaaaggggtttaaactcattttttaatgaggaacccaggcctgtagtaactaatctgctaccacaatgagtaacctactctgacgataatggcattcattgcttcatgagggcagagccctcatgacctaatcatttcttaacattcccacctctggacactatggaatttgggattaagtttccaatacacatcctttctaaacagcaggggctttttaataggttgaccacccaaggctgcaggaggctctgaagcagtggcctgaggttggctgtcctttgtgagaatggagagaagtgaactgactcatggagacacaagtagatgaggtaaaggcattcattgcttcattacatggatggtgaggtcgattgaaggcattaacggattaaagatggtggcaaaaccgtctgaggtggagaccacggggagtccatcagaaatggaggacacgtcccaataaatggtgcttcatttccctgcaaagcagaagaaagcaaagaacaaaacacaacatcatagtgtacactgagcagtggattgagagaagagtttcctaaggcataactgacagagtggagaagacacacaaatctttgcatgatgctaacatttggactgtggcttcattatttcttattaatattttactgaaatatcgctagaaggagactgaaaatgaagtgtgaaaagttaaatgggatttctgctctatgtccttttcagatgagaggaactagggaattccagggaagaaacaataatagctgctgagcaaggcttttgcagggcaggacaaggaatccccaaagagaaaacggaaacctcagcttcactttgcatctgctcctgagccaggtcctgagcgacccctgtaggtcctgagtgcccctccgtaggttctgagcatcccttggttgctgggcgccctctggtggtgtctgagcccctctggtggtttctgagccccccgccttatgtctgatcctccctggtggtgtccgagtgcccctgctagtgtctgagccccctggtggtgtctgagtccccttcttagtgtctgagccaccctattagtgtctgaggacccctgatggtgtctgagcccccagttagtgtctgagccaccctattagtgtctgagcccccctggtggtgtctgagcacaggagagctcctctgaaggaagggtctacatggggacaggcgtgcttgtctcagggaagggtccatgtggggacaggtgtgcttgtctgaaggaaggttccacatggagacaggtgtgcttgtctcagggaagggtccacatggggacaggtgagcctgtctgaggggacagaagtgcttgtctcaaggaagggtcctcatgtggacaggtgagctcttttgagggaagggttgacctggggacaggcatgcttgtctgaggtaagggtcctcctggggacaggtgtgcttctctcagggaagggtccacgtggggacagaggtgcttgtctaaggcaagaatccaagtagggacaggtgagctcgtctcagggaagggtccaggtggggacagttgtgctcatctgagagaagcgttgaagtggggacaggtgtgcttgtctcaaggaagggtccatgtggggacaggtgtgctagtatcaagaaagggtccacatagggacaggtgtgcttctctcagggaagggtgcatgtggggacaggtgtgcacatcggagagaatggtccacctggggacaggtgttcttgcctcagggaagagtccaccttctcagggaagaagtgtgctcctctgagggaagggtgcacatggggacaggtgtgcttgtctcagggaagggtccatgtgggaacaggtgagctcatctgagggaagagtccacgtggggacaggtgagctcatctgagggaagggtccacatggggacaagtgacctcgtctgagggaagggtccacgtggggacaggtgagctcgtctgaaggaagggtccacttggggaccggtgtgctcctctgagggaagggtccacgtggggacaggtgtgctcctctggagggaagggtccacgtggggacaggtgagttcatctgaaggaagggtccacatggggacagttatgctcctctgagggaagggtccatgtggggacaggtgtgcttgtctcagggaaaggtccacgtggggacaggtgtgctcaccttggggaagaggacagatgagctcatctcagggaaggggccatgtggggacaggaccaagggttgggacttcagcacaagaatttaggaggaacacagtcttccctagcagcctccttcagggatgtcaaatattttccttctgttccctgtgaaagccttaaaggggtagggaaagggcgttcaacctgcacactcgtagaggggaaaccagcttcattagtaatcgttcatctgtggtaaaaaggcaggatttgaagcgatggaagatgggagtacggggcgttggaagacaaagtgccacacagcgcagccttcgaaacacaccacggtcacgttaagtttaaatggagtgaccacattcgccaggaaagggaaatatttacacttttgaagaaacagtaatttgtgtttctgattatgatctggccttggattttccctcccctcataagcaatgacagaattggcagaaatatgtgaaacgttagttctcagacatgagacacccacagagggccccctgtgcccttccctgagagctgatcagctcctgcatctgaagaaatgaccaaagaccaggagagaaccacacagaagcatcggagggacagcacctggggctctgatggggtcaggaatagcatctgttcccaatagatggactaagtaaaaagtatcataattcacaagagttttacatagcacagaagaaaaagttaccctatatcaactgttgatcttgtgaatccaggaactctggattcaaggtggtcgggcacatcttgatttacgcatttcagggacacatgagacatcagtcaatataagtaagaaggacattagttccatccagaaaggctgagacaactcaaagcaagtcctccccacttagggcttccaggtcacaggtaggtgagagacagatggttgcattcttttgagtttctgataagtgtttgcaaaggaggccatgaggatatgcacctgtctctgtgagcagagggacaactttaaatagactgggaggcagatttgtcctgagtggtttccagcttgacggggcccaagatattttcctttcacaatctggtaacttcaaacaaaacttcaaagccacaacaaaacaacacaacaacaaaaagaataagacatgggtacttattaagagtagaaaaacattcagtccccaaggaaaatattggcagtgtctacctccacatgacaaaggagtaagcagtgtgagccacagaaaggagcactattaacccacagagcaaccgagaataacacgggtgatgcgagggcattggacgcacatcattgcattttgtagattcagaaagaaacggaaaagattgacggtggtaaaagagacagccctgcttccctctcccttttccctccccgatgaggcctcacagccatgaccctcagcctcatcccgcagtgcagcagctgccgtcctgtccaggcccaccccctgccccgccctgggactgttacctcattccctcccggagtccaggtgccccccggggtgtggtgcgggagcctggggaggccctttgttctctgtcagggtctccctgggagggacgcagccaccgcagctggttggggcctggcttcgcccaggacagtcctttcctttcccattgtctttggatgactatcgctgggctgggacatgaggcgggcagaggcgcgggtcacccttaggacccccctcttgctgctggggctctgggcgctcctggctccggtccggtgttctcaaggccgtcccttgtggcactatgcctcctccgaggtggtgattcccaggaaggagacacaccatagcaaaggccttcagtttcccggctggctgtcctacagcctgtgttttggggtcaaagacacgtcattcacatgcggaggaaacaccttctttggcctagacatctgctggtgacaactcaggatgaccaaggagtcttgcagatgggtgacccctacatccctccagactgctagtacctcggctacctggaggaggtgcctctgtccatggtcaccgtcgacacgtgctatggggacctcagaggcatcatgaggctggacgaccttgcgtacgaaatcaaacccctccaggattcccgcaggtttgaacatgttgtttttcagatagtggccgagcccaacgcaacagggcccacatttagagatgatgacaatgagacagaccccctgttctctgaagcaaatgacagcatgaatcccaggatatctaattcgctgtatagttctcatagaggcaatataaaaggccacgttcaatgttccaattcatattatcgcatatatggcaatattacaacttgttccaaagaggtggtccagatgttcagtctcattgacagcattgctcaaaatattgatctgcggtactatatttatcttttgaccatatataataatcgtgacccagcccctgtgaatgaatatcgaattcagagtgcaatgtttacctattttaaaacaactttttttgatacttttcatgttcattcatccacactacttattaaatacgtgccacatgaatctaactatgaacctgaaaggtataacttctgttcccgtatagccctgttacacattggtactccaggcagacattatttattggtagccgtcataataacccagacacagatgagaagtattggtctggagtatgatgataactactgcacatgtcagagaagggcctcctgcattatgcagcgatttcctgggatgacagatgcgttcagtaactgttcttatggacatgcacaaaattgttttatacattcaggccggtgtgtttttgaaacacttgctcctgtgtataacgaaaccatgacaacggttcgctgtggaaacctcatagtggaggggagggaggaatgtgactgtggctccttcaagcagtgttatgccagttattgctgccaaagtgactgtcacttaacaccggggagcatctgccatataggagagtgctgtacaaactgcagcttctccccaccagggactctctgcagacctatccaaaatatatgtgaccttccagagtactgtcacgggaccaccgtgacatgtcccgcaaacgtttatatgcaagatggaaccccgtgcactgaagaaggctactgctatcgtgggaactgcactgatcgcaatgtgctctgcaaggcgatctttggtgtcagtgctgaggatgctcccgaggtctgctatgacataaatcttgaaagctaccgatttggacattgtattagacaacaaacatatctcagctaccaggcttgtgcaggaatagataagttttgtggaagactgcagtgtaccaatgtgacccatcttccccggctgcaggaacgtgtttcattccatcactcagtgagaggagggtttcagtgttttggactggatgaacaccatgcaacagacacgactgatgttgggcgtgtgatagatggcactccttgtgttcatggaaacttctgtaataacacccagtgcaatgtgactatcacttcactgggctacaactgccaccctcagaagtgcggtcatagaggagtctgcaacaacagaaggaactgccattgccatataggctgggatcctccactgtgcctaagaagaggtgctggtgggagtgtcaacagcgggccacctccaaaaagaacacgttccgtcaaacaaagccagcaatcagtgatgtatctgagagtggtctttggtcgtatttacgccttcataattgcactgctctttgggacagccaaaaatgtgcgaactatcaggaccaccaccgttaaggaagggacagttactaaccctgaataacactaattcagcctcccgatccctgtaaagatacagagaatataacagcaaaatctatgaaacaggatcaggggaagggatggcaaagctcaagtccacatttcttgaagtccacaggaagcacagggtcctgtttcacatcacagggaaacgggaggcattggcttctgtcccaggttcttgtaggtcgctgatgctcactctgaaataaatcttcaaaaacacacattggtgccttccacattttcttagactcctctgggagcccaaacttggccagaacctcttgcctggagagacatgaatgagcatctggctcttgtcctgaggtctctggtcccagaattaacggaagttgccaccagctccttacagggaacattcatgacatttctccagaagagagctccagagcaatgagcttcctcattccccaggtaatctgtccttctctaaacccgaagtcagtttagggtgatccagggctactccctgttccctgtctgttcctcacgggggtgctgtgggctttgcagtgagagggacttgggttcaaatcccccaccaagcaaatccccctacctggggccgagcttcccgtatgtgggaaaatgaatccctgaggtcgattgctgcatgcaatgaaattcaactagaaaaataggtagacgtgaggggcaagctgtctgtcatttagtgtgagctctgtgagtggcagctgccccctttcttcctgcccccacatttccttgaactgaaacaggaagggaagctgagtaagtcgtgatgaggaagagaaaccaggcttgtagcagcacaggctggtccgggtggaaaacagggctaggtgtatcactgagttattgtaaaggaaaatggaagttaaatgtataaataactgaatgagataacattttattttaacttaaaattcacactaatattgacttttaaaatgcagtgtagatatgtcagagagaatttcaaaggcaaagcccaccgacggaagaaatcacccttcccataccatccacagaaaactgttggtattctagggtagtactgagatctagcatttttctgaatacatctgtggttctagatgtcctgcttccatagatattgtttagaattcccacccctttctccaaacacagcttgatatcctttctctgaacctgttagaaatttcctccattcagctgtcataaagatgcgagcaatccattcctgtgcctctgtcagtgtgttctattattttgtggctgaacgctaatggacagttaagtgtgaggtcagtgaatacagtgccctccctctatgtgtccttcgggtgtgaggggttttgctgatagagcagcaggccccatcccaccctttatgcatctccgccccccacctcacgctccagctgacctctcccctgtggcctggggcgttccccagggggaatgacctctcctctctccagggcccacccactcagtgcccgtgcaagaccaccacgcttggcacggccccacctcgtgtcagggcctgtgtcccctgccccaccccctaaacagatgggaaccactgggactctgctcagggcagggggcggaggtatgtgtgaaaggaaggcaaatgtgcactctgttggagaaatattataggtagtttgagcaaaaaatctaatgccatgggaacttttagaatgatacgtattttaacaaagaacatgaccaatagagtttgtattgaagccaggaaaacactatttagagcaacagcaatatcaaaaacacaagccaacagttcaccaagaaaaaccaccattaaccccatggaaatggtcttccaagagcatcggcacttaaatcctggaaatctgcctgcctcagcacctgttgtcctgacctgccctcctgtgtgtcctaatcactcccaaacacggggcctgcactgtgggagattcacactgtgccaggtggagggagcaggacaactgctaacaggttgttggtgtggatgccgaggccacccaagcaggtgtaaactcccacctgtggggcagggaagagtgcacgggagacatgtcccgggcatagggtgagggagagctgtgggggctctgggttctgaagtgggttctgaagagggttctggcctggcagggataagaccaaccagcatgtgaggccaggctggagtctggacctctgaagctgcaagggtcatgggctgcttggccccaggggctgtcctggttctctatggagtactttcaaacattctttcttcttccaatccccctccttctctcccaaagcctgcatctcccaaatcctctttgtcggatcctcggcttcactctgcatccgtcctgagcatcgatcttccaattccatcctcttctcttctgctatgtctaagctgctgtgaagccacctgctgtaatttactgctttatatttaatattgtaccgtacatctgttctgtttccctcatcataaatgcttcatttcatgctcagcatctgagaacacaaggccttgtcagctgtcacctccttccgttctctgtttccttcctcctatccccatattgctcatcatgtccagtctcctgccatcctgaatgcttctgatggaaggtctgagatgtctcatgagcactgtgaagattctttgtaatgtgagcttgttccaggcaggaattctccttcacccagccctggaagccaagtataggcagatggccatgctcaatcaaagactgagctaacttaacagtggctttggttttaaggtttctccaatccccagggcacaggatttcagggaattcaggtgagagtctgggtgttacccttcaggaggctgtaaactccatttcacctagtctacaccacagactatggaaactatatatatatatagttctgtccctctagagaaacctaatatgtatatatacaatatataatacgtattatatattatatataatacgtattatatattatatatattatatatatattagagtttattgaggagtattaaactcacaatcacaaggtcccacagtaggccatctgcaagctgaggagcaaggaagccagtccgagtcccaaagctgaagaatttgaagtctgatgttcgacggcaggaagcatccagcacaggagaaagatgtaggctgggaggctaagccagtctagtcttttcacgtttttctgcctgctttatatcctggccacactggcagctgattagatggtgcccacctagattaagggtgggtctgcctttcccagtttactggctcaaatgttaatctcctttggcaacaccctcacagacacacccaggatcaatactttgcatgcttcaatccaatcaagttgacactcagtatcaaccatcacaagtccaccccttgtcaacttgaacccatacaaatctcctgagatcatacataatcttcaaataaagacaataataaggtcataattacacctaatgtaatacaactatcttttgtacaaccagaaatgcaccaatccccaacccaaatgctattatgtaaagttaagaacacttaaatgctgatatgaagtcaataaattttatgtcacatgataaaggaaaaaagaaatgaaggaattttcttagtacaagtgtgtacatgcacaaacatgtttttaacaaaagaagaaggaaatactgatgacaattacagtcctcatttctgcaactgatcacgtggttgtagctggtattgatgactaccttcttctactacccattctgtattccctttgccttcagcaagcatcacagcaggtagagttttttctcctagtggagtgatgcaaaccttcattcctgaagggtctgggccatttgtagtcctgcctggattgggctgttgtagtttcccgttgaccttaatgacagggcatggtaatgttaagagacgccctaatggatctcctgtattccatacatattcttccttacctccattgtggagtaatagactgattgcatcttgatagtccaggtcaatcagcccagccaacactgtaactcccctcttagcctgtggacttaaaggtaggaggggcccaaagtggccaggtggaaatctttacttccagtttaatggaattgttgttgtttctcctgatggcagcattattcccactggaactaagacctctaggccaacagaatgtaatgtcatgggaccaggaagcaaaaattttgctagtggatcactaggggtgatggtgaatggtgccatttccacttccaccccttgattcctggatccatgaattatggctatgggagaaagagtaccatatattggatgctgatttggagcatacatggccttttggagagctttgccccagccctgcaaagtattggagcctagttgacattgtaattgtgactttgaaaggccattccattcttctatcaatccagctgcttcaggatgatggggaaaatggtaagacaagtgaatcccatgagcatgagcccactgccacacttctttagccgtaaagggagtgccttggtcagaggcaatgctatgtggaatactgtgacagtggataaggcattccatgactccacagatggtagtcttggcagaagcattgcatgcatatctgcagtaagtgtctatttcagtgaggacaaacctctgccctttccaggatggaagaggtccaatataatccaacctgccatcaggtagctcactgatcaccctgaggaatggtgtcatttgggtagagacccagagccaaaccagatcacgccacccaacccctcccaaatctcatgtcctctttgcatttcaaaaccaatcatgccttcccaacagtcccccaacatcttaactcatttcagtattaactcaaaagtccaaatccaaagtcacattggagacaaggcaagtccctttcatctatgaacctgtaaaatgaaaaacaagtcagttacttccaagacaaaatgggggtacaggcattagatacatgctcccatttcagttgggagaaatgagccagaataaaggggcttcaggtcacatgcaagcccaaactccagtggggcagtcattaaatcttaaagcttcaaaataatctcctttgactccattcctcacattcagggcatgcttatgcaaagtgggggctcctacaaccttgggaagctctcaccctgtggctttgcagctctgaccccatggctgctctcatgggctttgcagagttcagccctcctggctgctctcattgagtgcatgcagcttttccaggtgcacagtgcaagccgttaatggatctaccattctggggtctgaaagatggtggccctcttctcacagccccattagtcactgtctccagtggggactctgtgtgggggctccaaccccacatttcccttctgcactgccctagcagaggctctccatgaaggctttgcccctggcgcagacttctggctggacatccagtcatttctataaatcctctgagatctgggtggaggatcacaaagctgaactcttctcttccgcacatccctaggcccaacatcatgtagaagccaccaatgattggggctttctgaagcaatggcctgagctgtacattggacttttttagccacagctagacctggagcagctgggacacagggcaccaagtcccaaggctccaaagagaagctgggccctggacccagcccatgaaaacatttttccctgataggcctccaggcctgtgattggaagggctgctgcaaagatctccgacatgccctggaaacattttccccattgtcttgattattaatattcatctcttcattacttatgcaaatttctgcagccaacttgaatttctccctagcaaatgtgtttttctttactaccacatggccaggctgcaaattttccaaacttttatgctctgtttcccttttaaaaataagttcctatttcagatcatctctctcaagggcaaagttccacagatttctagggcagggacaaaattccatcaagcttggttttatacattttagagaggcatgagacatcaatcaaatacatttaagagacacattggtttggtccagaaaggtggaacaactcaaagctagggcttccaggctataggtgaatttaaatattttctggttgacaattggttgagtttgtctaaagacctgggatagatagaaaggtaatgttcaggttaagataaagattgtagagtccaaagttcttttgaagtcttatagtggctgcccttagagataataggtgacaaatgtttcctattcaaatcttagttgaactctttaggattgggaggttctagaagaaaaagatctagctatgttaatagagattctttacagatgcaaattttcccccacaaagaacagctttgcagggccctttctttctttctttctttctttctttctttctttctttctttctttctttctttctttcttttttagatggagttttgctcttgttgcccaggctagagtataatggcacgatcttgtctcaccacaacctccacctcctgggttcaagtaattctcctgcctcagtctcccgagtagctatgattacaggcatgcaccaccacacccggctaattctgtatttttagtagacacagggtttctccatgttggtgaggctggtctcgaactcccaacctcaggtgatccgcccacctcagcctcccaaagtgctgggattacaggcatgagccaccatgcccggcctgcagggccatctcagagtatggcaaagaaacatgttttggggtaaaatattttgattttcttatttgtctcataatgttatgccagagtcagtttggaaagtaaatcatgatatataggtttaaataaaacccatctgatgagaatttatgatttgtagagcatgcctccccagactctttagataggaatttgggcaagatgaaaaaaaaatcagagtttagtcctcactacctaagaccagctcagcttggacttcactgttcatgtcactatcagcattttagtcaaaaccactcaataagtctctaggaagttccaaactttcccacatcttcccttctcctttcaagttctccaaactgttccaaccgctgccaggaggtacccagttccaaagttgcttccagattttgagttatctttatagcagttccccactcctggtaccaatttactatattagtctgtttccacagtgctataaagaactgcccgaaagtggttaatttgtaaagaaaagaggtttaattgactcacagtgctgtgtggttagggtcggaggctcaggaaacttgcaatcatggtggaagtggaagcaggcatgtgacacatggcagcaggtgagagagagaaagagagagagagggaatgaaggaggaaccaccatacatggataaaaccatcagatctcatgagaactcactcactatcaggagaacatgaggacagcatgggggaaaccacccctatgacccagtcacctcccaccaggtccaccccttgacacataaggattactatttgagatgagatttgtttaatgacacagagccaaaccacatcagcatgtgacaaaggtctaatatcaagaatctatgagggggcagttccaaaatggctgaataggaacagctccagtctacagctcccagcatgagctacacagaagacaggtgatttctgcatttccaactgaggtactgggttcatctcacgggggcttgttggacagtgggggcaggacagtgggtgcagcccaccaagagtgagctgaagcagggcgaggcattgcctaacccaggaagtgcaaggggtcagggaattcccgttcctagccaagggaagcggtgatggacggcacctggaaaatccggtcactcccaccctaatactgcacttttccaacggtcttagcaaatggcacaccaggagattatatcctatgcctggcttggaggttcccatgcccacggaacctcgcttattgctagcacagcagtctgagatcaaactgcaaggtggcagtgaggctgggggaggggtgcccacaattgctgaggcttgagtaagtaaacaaagtggctgggaagctcaaactgggtggagtccactgcagctcaaggagacctgtctgcctctgtagactccacctctgggggcagggcatagctgaacaaaaggcagcagaaacctctgcagacttaaatgtccctgtctgacagctttgaagagagtagtgtttctcccacatggactttgagatctgagaatggacagactgcctcctcaagtgggtccctgacccccgagtagcctaactgggaggcaccctccagtaggggcagactgacaccttacacggctgggtgcccctctgagatgaagcttccagaggaattatcaggcagcaacatttgctgttcagcaatattcgctgttctgcagcctctgctgctgatacccaggaaaatagggtctgcagtagacctccagcaaactccaacagacctgcagctgagggtcctgactgtcagaaggaaaactaacaaacagaaaggacatccacatgaaaaccccatctgtacatcaccattatcaaagacaaaaggtagataaaaccacaaagatggggaaaaaacagggcagaaaagctgaaaattctaaaaatcaaagtgcctctccccctccaaaggaatgcagctcctcgccagcaatggaacaaagctggatggagaatgactttgatgagttgagagaaggtttcagatgatcaaacttctccgagctaaaggaggaagttggaacccattgcaaagaagctaaaaaccttgaaaaaagatcagatgagtagctaactagaataatcagtgtagagaagtccttaaatgacctgatggagctgaaaaccatggtatgagaactacgtgatgaatgcacaagcttcagtagccgattcgatcaactggaagaaagggtatcagtgattgaagatcaaatgaaagaaatgaagggagaagagaagtttagaggaaaaaaaagtaaaaagaaagaaacaaaccctccaagaaatatcagactatgtgaaaagaccaaatctatgtctgattggtgcacctgaaagtgacagggagaatggaaccaagttggaaaacaccctgcagtatattatccagcagaacttccccaacctagcaagacaggccaacattcaaattcaggaaatacagagaaccccacaaagatactcctcgagaagagcaactccaagacacataattgttagattcaccaaagttgaaatgaaggaaaaaatattaagggcagccagagagaaaggtcgggttaccctcaaagggaagcccatcagactaacagctgatctctcagcagaaactctacaagccagaagagagtgggggccaatattcaacattcttaaagaaaagaaatttcaacccagaatttcatatccatccaaactaagcttcataagtgaaggagaaataaaatcctttacagacaaacaaatgctgatagattttgtcatcaccaggcctgccctacaggagctcctgaaggaagcactaaacatggaaaggaacaactggtaccagccactgcaaaaacatgccaaatcataaagaccaccaaagcgaggaagaaactgcatcaactaacgagccaaataaccagctaacatcataatgacaggatcaaattcacacataacaatattaacctttaatgtaaatgggctaaatgctccaattaaaagacacagactggcaaattggataaagagtcaagacccatcagtgtgctgtattcaggagacccatctcacatgcagagacacacataggctcaaaataaaggcatggaggaagatctaccaagcaactggaaaacaaaaaaaggcaggagttgcaatcctagtctctgataaaagagactttaaaccaacaaagatcaaaagagacgaagaagaccattacataatggtaaagggatcaattcaacaagaagagctaactatcctaaatatatatgcatccaatacaggagcacccagattcataaagcaagtccttggagacctacaaagagacttagattcccacacaataataatgggagactttaacaccccactgtcaacattagacagatcaacgagacagaaagttaataaggatatccagcaactgaactcggctctgcaccaagcagacctaatagacatctacagaactctccaccccaaatcaacagaatatacattcttttcagcaccacaccacacctattccaaaattgaccacatagatggaagtaaagcactcctcagcaaatgtaaaagaacagaaattataacaaactgtctctcagagcacagtgcaatcaaactagaactcaggattaagaaactcactcaaaaccactcaactacatggaaactgaacaacctgctcctgaatgactactgggtacataatgaaacgaaggcagaaataaagatgttctttgaaaccagtgagaacaaagacacaacataccagaatctctgggacacattcaaagcagagtgtagagggaaatttatagcactaaatgcccacaagagaaagcaggaaaaatctaaaattgacaccctaacatcacaattaaaagagctagagaagcaagtgcaaacacattcaaaagccagcagaaggcaagacataactaagatcagagcagaactgaaggaaacagagacacaaaaaaacccttcaaaaaatcaatgaatccaggagctggttttttgaaaagatcaacaaaattgatagaccactagcaagactaataaagaagaaaagagagaagaatcaaatagatgcaataaaaaatgataaaggggatatcaccaccgatcccacagaaatacaaactaccatcagagaatactataaacacctctacggaaataaactagaaaatctagaagaaatggataaatttctcgacacatacaccatcccaagactaaaccaggaagaagttgaatctctgaatagaccaataacaggctctgaaattgaggcaataattaatagcttaacaaccaaaaaaagtccaggaacagatggattcacagccgaattctaccagagctacaaggaggagctggtaccattccttctgaaactattccaatctatagaaaaagagggaatcctccctaactcattttatgaggccagcatcatcctaataccaaagcctggcagagacacaacaaaaaaaaagagaattttaggccaataaccctgatgaacatcaatgcaaaaatcctcaataaaatactggcaaaccgaatccagcagcacatcaaaaagcttatccaccatgatcaagtgggcttcatccctgggatgcaagtctggttcaacatacgcaaatcaataaacgtaatccagcatataaacagaaccaacgacaaaaaacacatgattatctcaatagatgcagaaaaggcctttgacaaaattcaacaacacttcatgctaaaaactctcaataaattagatattgatgggacgtatctcaaaataataagagctatctatgacaaacccacagccaatatcatactgaatgggcaaaaactacaagcattccctttgaaagctggcacaagacagagacaccctctctcaccactcctattcaacatagtgttggaagttctggccagggcaatcaggcaggagaaggaaataaagggtattcaattaggaaaagaggaagtcaaattgtcgctgtttgcagatgacatgattgtatatctagaaaaccccatcgtctcagcccaaaatctccttaagctgataagcaacttcagcaaagtctcaagatacaaaatcaatgtgcaaaaatcacacgcatttctataacccaataacagacaaacagagagccaaatcatgagtgaactcccattcacaattgcttcaaagagaataaaataccttggaatccaacttacaagggacgtgaaggacctcttcaaggagaactacaaaccactgctcaatgaaataaaagaggatacaaacaaatggaaaaacattccatgctcatgggtaggaaggatcaatatcctgaaaatggccatactgcccaaggtaatttatagattcaatgacatccccatcaagctaccaatgactttcttcacagaattgggaaaaactgctttaaagttcatatggaaccaaaaaagagcctgcaatgtcaagtcaatcctaagccaaaagaacaaagctggaggcatcacgctacctgacttcaaactatactacgaggttacagtaaccaaaacagcatggtactggtaccaaaacagagatacagaccaatggaacagaacagagccctcagaaataatgccgcatatctacaactatctgatttttggcaaacctgacaaaaacaagaaatgggaaaacgattccctatttaataaatggtgctgggaaaactggctagccatatgtagaaagctgaaactggatcccttccttacacattatacaaaaattaattcaagaggattaaagacttaaatgttagacctaaaaccataaaaaccctagaagaaaacctaggcaataccattcaggacataggcatgggcaaggacttcatgtctaaaacaccaaaagcaatgacaacaaaagccaaaattgacaaatgggatctaattaaactaaagagcttctgcacagcaaaagaaactaccatcagagtaaacaggcaacctacagaatgggagaaaatttttgcaatctacttatctgacaaagggctaatatccagaatctacaatgaactcaaacaaatttacaagaaaaacaaacaaccccatcaaaaagtgggcaaaggatatgaatagacacttctcaaaagaagacatttatggagccaaaagacacatgaaaaaatgctcatcatcactagccatcagagaaatgcaaatcaaaaccacaatgagataccatctcacaccagttagaacggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaaacatgctgctataaagacacatgcacacgtatgtttattgcggcactattcacaatagcaaagacttggaaccaacccatatgtccaacaatgatagactggattaagaaaatgtggcacatatacaccatggaatactctgcagccataaaaaaggatgagttcatgtcctttgtagggacatggatgaagctggaaaccatcattctcagcaaactatcacaaggacaaaaagacaaacactgcatgttctcattcataggtgggaattgaacaatgagaacacttggacacaggaaggggaacatcacacaccagggcctgttgtggggtggggggagtggggagggatagcattaggagatatacctaatgttaattgatgagtttatgggtgcagcacaccaacatggcacatatatacatatgtaacaaacctgcacgttgtgcacatgtaccctaaaacttaaagtataataaaaaaatttttaaaaaaagaaacacctgcttttttctgttttccatttgcttagtagatttttctccatccttttactttgagcctggggatgtcattgcatgtgagatgggtctcttgaagacagcatacatttgggtcttgcttctttctccaacttggcaattctctgccctttaattggggcatttagcccatttacattcaaggttaatattgatatgtgcatatttcatcctgttatcatgttgttagctgctcaatatgcagatttgattgtatagttgatttatagtggcaatcgttatgtacttaagtgtgtttttgtggtggccagtaacgttcttccattatcatatttagcaatcccttaagggcctcttgtaaggcaatctagtggtgatgaatacccttagcatttgcttgtctgaaaaggatcttatttctccttcacttgtgaagcttcatttggctagatatgaaattcttgcttggaatttcttttctttaagaatgctgaatataggcccccaatctcttctggattgtacagtttctgctgaaacctccattgttagcctcattgggttccctttgtatgtgacctgaaccttctttctagctgcctctaatattttttttcctttcaacctttaagagtctgatgtctgatggctatatgtcttagggatggttgtcatgtataatatcatgcagaggttatttgcatttcttgaatttgaatgttggcctctctggtgaggttggagaaattttcatggaggatagcctgaaatgtttttcaagtttctttttttctctttctcttcttaagggataccaatgtgtcatagatctggtctttttacataattgcacatttctctgaggttttatgccttcttttttattctttgttctttatttttgtctgactgagttaattcagagaatcagtttttaagctctgtgattctttcctcagcttggtctattctgctgttaatacttgtaattgtattctgaaattcttgaagtgagttttttagctctatcaaatcagtttggttctttcttaaaatggccatttcatctttcagcttctgtatcattttactttatttcttagctcccttggattgggtttcaacattctcctgaatctcagtgatcttctttcctgtgcatattctgaattctatgtctgtcatttcagccatttcagtcaggttaagaaccattgctgggaaaccagtgtgattatttggaggtaagaagacactctggattttagagttgcagagtttcttgcattaattctttctcatctttgtgggctgtttctttaatctttgaagtggctgtcctttggatgtttttgtcttttttgttgttttttggtgtgtgtttttgtttgtttgttcatttgtttgttttttgctcttatcttctttgatactcttgcaggtttgattgtggtataaagtggattcagttagctgtgtttcttgaaaatcttagagggtccaggctcacctcagcactcttgtggtgtgttctctgctctgggactgggcccctggctttattctctggccccttgagtttagaaacttgctgcattggaggggctgaggtgttcccagtccattggccacaacactatagtagggggtgccggccaaagcacttcattagagtggtggcagtgggatccattcttactcatgggtgccagcagttgtggagtcatggcagggtgcacatgcatctgctggggtgggggtactggcaggagcagagtggcagcatccctacataggttcctgctggcagtcacagcgcagtgaggtgcccgtgtgttggcagggacagggtggtggggcacacatgcacatgcttgctggtggtagagggagttgtgatctgctgtgcactcatgccagcaaagcagttgggaggtactatgggtggactggtgcacatcagcagaggctggcctgctggaggtctccaatggttaggcatggtctgctggcaaaggagctatgatgagggcccccaggaaacaccctggttgggcttccaaggctgtactgcaagcaggcacagccagcctggggccccaggagaggccagaaggcaaggaaattctcatttcagatgggccctgtcccatggacaagaccaccctgctttattcaggtcccatagtcactctaaggttaaaatctcctagaggaggttggtgagccttgggggatgggtgtcccctggctgtgctccactacagccattctcatgtcaaacactctgggctttacacagactggagtcctgcccctggcatctctctaagcagctgtcccttccagcacaagtgtccatgggggtcatggggtctcctgctgctaggattctggaggcccatggcaacagcaggccactcctcacctgttcaactcaacctttccccaggagttgctgggagccaggaatgagtcctggtgcttggcatccccatgcagggttcccatcttcctccaccttcagctcagcatctgtgtcctcccccgtctactctcaatccactctcaatgcctccccttcaaagatctgcttggaaagcacccgtcttcctgatgtctcactccctccatggcagatattcctcctggctgcatctagtcagccatcttgactcgcctccaaagtctttttaattaccacttcggttaaattagtaactatcattttacaatggcctgtgattctgttttgatcaaatattttgagccttttagcatctataacaaatgttctcaaaaatcaaaatcctaaatcaagtctctgccttagtcttatttctggggcttattaaggctataaaaattaatcaccataaggttgtacaagctttttacagcttccagtcaggctatgaactccagtatcaccacctccagcctgataattacatatattggaagaaaatcagttaaaggactccctctagacccttgaaagggtgtgagagacaacatggtttcgcctgccttcatgtgtcccagtccatccctgtggctgcctctgtccacctcagcttgcccactgtctttccttcccaactgtctgccctgctgacttctggcctcagtgacagatgcaaagacaaggcgacagccccacatagaccgtttaaccagtcccacatttgcataagctaaatggtcatgtcacagtctgttgcccaggctggtctcaaactcctgggctcaagtgatccacccaccttgacccccaaggtgctgggattacaggcttgagccacagtgcccagccaagaacccgtttttgagtgggcaccttggcacacacctgtaaacgcaacactttgggaggccaaggtgggagtgtggcttgaggccaggaggttgaggttgcagtgagctatgatggcaccacctcactccagcgtgggtggcagagtgagatcctttagaaaaaaaaaaaaaaaaaacttgttttctctgcagccgggctccgtgaccaaacacaaacacaaacttcccctccagagggtccaggaggggctgggctgcaggaggtgcttagggcctcttagggaatggtaagtgaccacccaacgcaggcactcagccccaggggcatatgcagagagagggtccaggaggagctgggctgcaggaggtgcttagggcctcttagggaatggtaagtgaccacccaacgcaggcactcagccccaggggcatatgcagagagagggtccaggaggagctgggctgcaggaggtgattagggcctcttagggaatggtaagtgaccatccaacgcaggcactcagccccaggggcatatgcagagagaggctgggaggacactttcagtgactggggttacaaaccccaaccataagacattgctggctctgtgagccgccacctccagaaatctcccacttagttcttagcacttatccactcttcccttttcctactctcaattcctggaggatgccctcctttctcaggctcagaccaacctaccagctccactctagacctgaacacatgactcctccctctgtctccacctggaaatctcatcagtgcctcacatttacactcctgaaaatcaggtcctgcctacccaccctcttgctccacctgattcctgccctgtttcagccagagaccttgcagtctcctttaactctcaaacccacccatgtcgtgtgagcatactgactgtgttctatgcaagaaagagcagtttcttggtggtcctgcggttttattagtccagaggcaaagcgttggcagagctggtttcttctgaaccctgggagggagattctgttttcatgccttttccagattctagaacccatattccttgctctgtgtccccttcttccatcttcaaaggccatcctctcatctctgtgtccatcatcacatcacccttcccctgactctggttctcctgcttccacttataagcacccttgtgattacatcatacccacccagacaatgcagggccatattctcccctctcgagattaatttaatcacatctacaaagttcctcgtgccatatgaggtcactaaaccacatgttctgggggtttgaatgtaaacatttgggggatgcattattcagccacccacaagcactgctccccactggccacacactatgcacagccgagatcatgcaagtgaggcacgttcatcaacagcagcttcagcaggaaactatatgctccactttcctgccatttgtatctggatttttttttcgctatcattgtagaaagagtggtattgtaaaattaaagatggattattttctttctagaacactttggcaatctatccaacattatttatccccttctgagtgtcaagtgtgaggtcattctttcattgagagctcaatgcctacaattatgataatgcatattgggtactttcacacatcagaaagttcttctttcttaaaatctgttcttgaattattcattcttctctagctttttgttgatctattttataattttagaaaaatcagaaagtaacttgaagtatctgtcatctctacaggtttacctccctctttgtggccttcagaatgtcatgacacgcttttcccttgctcatcacatggtttctatgtatgagacctcatcacaggagctgtggtcccccgggagcaggcatctgtggatggtgccttgctcctggctgctgggacctgtgtgctgccagtggcactccacgacagtgatttcccagctcagttttgcagctccagatggtgggtgagacactaggaccactttgtgaacagcgagggcttggggtttgcttttctaccatgtccagggctgctgttcatgagggaatgtttctaacctgacatcatggctgaagccaacttagaacctctctagccgtatggggagtaggtgagtgatacagatgttaattagctcagtggagccactcccctatgtagacatgttacaaaacattatgctgtacagaataaatataggtcatttttatgtgtcaatcaaaagagaaactaattatttaaaaaaaaaaaaaaaacctctctactcaagccgaaacctcagctccagtcccacaagtcacacaaggctgctcccgtcctgtgtatgttaaacctacctcagaaatgcaagggggcattcaggtttcattctcaattcaaatgccctttttaattttgtctattcctagcacctggcaacttccagctctttttttcggggctcattcattatttaaagcacgtataatttttcacccacattctaacacatgtagtactgtagagaatccttccctaggaggatctacagcattagaaaagaattaagaactccaatatttacaagaaggaaaaagcaaaaagagatcaaaaaatgggcaacttctagaaatagaaaaccctcatgagtatgatgataaatcgctggcacacatgtgaatagttacttgatgcttatagtgatgtctgggaaaataacatgaaatacttataatctgtttctcacacatgtaattcaaaagaatagagagaagatgatttgaaatattcttaagtttgtaggaaaaaagctacttccatatgcataattgcatgtattttgatactgccattattaagaactatctaagagggtccattaaaaataaaatttcttggctgggcacagtggctcatgcctgtatcccagcactttggaaggccgaggcaggtggctcacctgaggtcagaagttcaaaaccagcctggccaacatggtgaaacgctgtatctaccaaaaatacaaaaattagctgggcatggtggcatgcacctgtagtctgagctacttggggggctgaggcaggataatcgtttgaacccaagaggtgtaggttgcagtgagctaagatcataccaccgcactccagcctgacagacaaagcaagactctgtctcaaaaatattaaaataaaatttctcattcctattacagagtaatttaattcattaatgccctgccctgttacaaaactcatttgtaaaatactaattgtaattgtgaaaaaatggcaattgatactaattttaaattctaaaaacagggcacccatattaaagattattctgcagtaagagaattagctataacattttgtaataaggtggagaaaacattctccaacttacaatggttggtgagaagaaagtttccagcacggtagatggaccctaagagcccttgttgaaataataagacaaaaagatatacagagagatgagccagatgaagggagacagagagagagagagagagagagagagaggcacagaaatgagagatacaaagtgaaagagggcaacctgtggggtcatcagatatttgttttctgttttgtttattctaacataaaggcagtggtgggtcatcgatgtatttagagtttgcacaatcactgtggaacacagacagacacaggggaagaggagaaacacagggcggtggcttgcccttggactgttcttagttcctcaaaacgtaacagctttgcccaacctaagggaactttcagcagctgctcttctgccataggcctctttcctgccttgttttcatgtggctgactgtttctgttcctgcaggtcttagctcatcagacaggcatttattacctctgtgtcaacagtgggagcttccattactctctagcatgacactccccttcctcttttaggaaatttaacatggaagtgagtttgccatcggccttctccccacagtgttaacagtggtgaggaagccagcctgttccaccttgcccctcccatgattccaacactgagttcagacttgtcacatggaacttatctttgcatgtttgtggcacagacagatggacccaaccatggattagtggatggatggatggatggatggatggatggatggatggatggatggatagatggatggatggatggctgagtaggtgtgtggatggaagagtgaaaagatagatggatgcatgtatgggtggatgggtaggttgatggatgcatggatgggtggatggatgggtgagtggatgaatgggtgggtaggtgggtggctacatgcatggatgagtacttggatagataagtgagtggatggatggatggatggatgaatgggtatgtgaagggatggatgtattagagtgggtagttaggcaggcatgagctgatagtcaagtgattgttaaactgcctctctaaaataataattggtctcggctggacgcggtggctcatgtctgtaatcccaacactttgggaggctgaggtgggcggatcacaaggtcaagagattgagaccatcctgaccaacatggtgaaaccctgtctttactaaaaatacaaaaattagctgggcgtggtggcgtgcatctatagttccagctactcgggaggctgaggcaggagaattgcttgaacctgggaggaagaggctgcagtgagctgagattgtgccactgcactccagcctggtgacagagcaaagctctgtctcaaataataataataataataaataataattgatctcagccagcgccaagaaaaggcagtctcccaatagatagaaaacacccgaaactggtcatcagcagcttcctgataagatctcaggcattgggtgagtgggctcaagcatatgcactaagaggcaaagtggcagagtttaactggcacataatcttcctctaggaacactctaatagtaagagaaggacacctcaaatgagcatgtgcacatttcattaaacccactgtgtatgcagcccctcccaagtgctggcaggccactgtacatgtgggcagcccactccaagggaagaatcaagggagaagaaatacaaatcccagaaccatgtcaatgtataaaaccccaagtcaagggccggacagagcacttagatctctcaagtcgcccacttagccctcttccaagtgtactttacttcctttagttcccactttaaaactttaataaacatttactcctgctctaaaacttgcttgggtctctcactcttctgtatgccccttggccaaattctttcctccaaggaggcgagaatcaagttgctgcagacctgtatggattcgctcctgctaacagatagctggatgggtggacagatgcatgaattagtggatggacgtttggatgtgtgggtgggtgggtggattgtgggatggctggatgaatgcatggctggatgggtggacagatgcatgaattagtggatggatgtttggatgtgtgagtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctgggtgggtggatggatgcatggataagtggtggacggatggacgggtgagtggatgggtggatgtgtgtgtggatgggtggataggaaagccctctaattgattacagggctcagtgtgtgcttcaacatcatgatggcatcatcacattggtccctgtatgaagcagtgggggaggagagtgtaccaggggagcaggaatgacttttctccagaatcgacctctcccaccctgcagcctgggctgtgcaggccacattggagaaggtgcggtcgactactcctaaatgttgttgtgtccaatggcttgttgacgttgatgtaggaatgagcctacatctccaccatagatggaactgtttgggtccccaaagcagaaagcctcttctgttgcaggtgctgaagtttccatcttcttctgcttatacggaagctcacgcatcccttggatggcaggcgtcaggttcctgtgcgcactgagttccccccttacatgctttggacagaagtgtgagacacacaagattgctgcaggaagtccacctgtggggatgctgcgacttctccagcaagaacacgagtctgctcattgaccatcaccacacataacaaattaagtgtcccttttttgataacacgtcattgtttcacagagtattcttttaaagtgtataagttgactgcagttattattttttacttctgttactaatttactcataattaggcacaatttacacttaagaaatttcttaatagttttttcctccttaaggtgaactacagtcagataacatacttatcaattgtctctagctcttgtcagaaaaacatatagatgtgtgtgtgcgtgtgtcttggcctttccaatgatgaattaagatgtgcattgagaaggcattcactttatttgacgttaaggaagtaccaagaagacgctctccacagaccctgggaaagccagcagctgcaccccgaggctgtgccaggcagggaacaaggaggcagcaccacctgctgggcagggaaaatgtcctcccagtccctgccgcttctctgcagaggcacaaagagctgccccttctcctgggccttctcctgggctgatgagattgctccccgatatgccaaatcagggttgtgcatctgaggctctgtctagactctcagctccttcctactcctgcaaagtgaagaaaacaatgccaaggggtcctggaggcgtctctacccctggagagttttgactctcttcaatagtctccactaccctgccctcactccatgtcctccgtttctccctaaagcggtgcccagtctgattgcactgtggcagggataacgaggggccaggacatcaggggagagaagtttctacctgagtcacagcagcggctgccctgcagactcctgaagacacaagacacatttccatcccagagacccagcgaaatgcaacctcaggctagagacagccagttattttttcttgttctgtcctggagaggccactgagaaagtcgagccccttgttgaggaaaacatgagatctctgtgtgtcgtcctctgcctgatggctgtacctccatgtgagtgtctcagagatttcagaacgggggctgtgggctgtggtgtccgcttgtgactcatctctttgcttcttgtccctgagtgtcctgcatcagatgcagctactggagtcatgcccagggctggtgaggtcctcacagacctctgggcctggacccagcagccctctgggaaggcgctggggcacctcagctccaggggcagcacacacttcagcccagcctttctgggccaactctccatctgtagagacacatccaaggcccagttatccctgcagctgagctccgtgatggccaagggcagggccgcacattcccgtgggagacagaatggggacctcagcgtgagcccagacacaaacctccctgcagggaagcacaagaccaccaggcggcgctccagaccacacagcggccccagaagcaggttttagggggcggggcagacgtgtccgcgttgagtcaggtcattggttttactttccctgagcaaacggcctctgccaaggactcactgcacctctcaccttcacagttgttttttttttttttttaatcaccctgtagagttttgctagctaatttagatattgaggagtgcttcatacttccttgggcctctgcttgcagaaacatagcaattgtaaggaggcacgtgggaaagccccggctcggtgacccgggggatgctgctgtggccctggcaagagggcgtcgggccgcagtaacaaaggtgcagacggctctcagcctgcgcccgcggagtacaacacataagggctgtaacctaacgaaaaaagaatcgcagtgcaactgtcctgcatttgagtttgtgatcagttttgccctttgtctttaacaggttctaacataaaattttgaatgttggttcaagccctgtgggtaaaatgcacttacccacattccttaaacaaatagaacactgaggtggaaatgttttgaaaaagtagttttcagacatttggaaacaagcatcacaggatcataacccctgagaaaagaaaaacaaatgaacgaatcctgctattgcctgaaagcagctgccaggacacacggaaaggcttagtgagctgagcggacagagagcagagttcaaggcagcagcagcccgaggggaggagcaccggggagcaggctgctgtgcagccaggatgggccggggtggggcggggggagaacagctggagacttgccgcagggagggggatccctcaggtttggggctgagaactgacttatgcctgacttatgcctgcatgaaaagaaactactcgatatcagggggaaatcaccagaaacctgtggacccaaaactacacagagcctacacaaggaaagcattgtttgtgttctcccagccagggtggaaagaccttgagatatgtaaagcttcaagcaatcttccgaagtaatctcgtgagtagtggtgccacattaattcaggactaaaggctgctctgaactgaacctaagaaatgcttcaagtgtagcctggagcccgggtgcagtggctcacacctgtaatcccagcactgtgggaggccgaggcaggcggatcacttgaggtcaggactttgagaccagcctggccaacatggcaaaacctgtctctactaaaaacacaaaaattagctgggcgtggtggcagatgcctgtaatcacctcccacctggacccttccttgatacatcagaattacaactagagatgagattggggtggggacacagagccaaaccgtatcacataggaacctaaaaggataataaagtaggaaaacttcccacatcagtaaccctttatccgatagtaatcccaatctgcaaagtaaaactgtgtgattttactaagataacggaatcttctctacagaaggactttccagtgcaaaagctccccaccctcaccatgaaatgcacgtgaccatttccaatttgtgtaaagtcctcagttagtactgagacttcggaaggttagaaatccctttgctcatgctgcatggtccggatgagatgtaagaatcattagctaatagacatgcaacagcttttgtgtgaaagatgttatgagacatttaaggtatttgcttgtgattactaagcattcattgtatcattggagcacatgtgcttttataccctggagaaattccagtaattgaattgctgggttgaatgggattttgatttggattaaatttaaactatagattttatttagggaaaactggcatcttaattatgttattggggggcccttgctcccagagctcccaagatggtggcaggccgcttccaaaatgaccgcaggccacttccaagatggtggcaagcctcatgttctctgacctggggttcttggcctcacggattccaaggaatggaagcttgggccatgcagtgagtgttatagctctattagaagccgtgggtcacggaagagaaccgtggaacccagtgactagtgttcagctcgattaggacgaacccaggcacttagccgtgcaggaacaatggcgagcatttggcccgatcgagagtggcaatgggcgcctcgctggatcaggagcacagcggataccctgatggatccggagggatggaagccagcggtgggtctcccacgggggcaaacagcagtggtggacggtgagcgaaagcgaagctcgagccgtaacaaacatggaccagaagagtgcagttgcaagatttagtagagtgaagacagagctcccatacaaagggaggggacccaaagagggtagctgttaccggctcgaatgcctgggtttatatcccgatcattgtccctcccgctgtgctctcaggtgatagatgattggctatttctttacctcctgcttttgcctaattagcattttagtgagctctctttactatctgattggtcgggtgtgagctgagttgcaagccccgtgtttaaaggtggaagtggtcaccttcccagctgggcttagggattcttagtcggcctaggaaatccagctagtcctgtctctcaattacactgagttttccaatccatgcatccaatatgtggtgtatctcttcatatgttcatagcctctgagcaatgttttacaattttctgtgtaaagaactccacatcgttttatgtttcttctaaggtatatcctgattgctttttatgtcttcacaagttttttcctttcaaaattaattttccaattgtttggtgctaatatgctcaaatgtccttgattttcttagtttgaacagtccgtttttgttttggggatttatttttttttcagattctttaagattttctatgtctataaccatataatctctgaacagagacagttttgctttttcctttcaacttgaggtaggttttctgggtagttcaggacgcgcaggcactgggtgggtggtgttagcagctgcacgatgccttggagaggacactctcgggggactgtggccgctgctcagctgtgaccgttcttatagcaccagcagctgcggccaccattcttatccaatttccaaagccacaccacaggccctctcaagaacgaggcgtggaggctatgccctctcctggacacatcatcattcccaagccccacgatgtgggccccatgggacgcacacctttgtctgtccagacctcagccccacctcctcatcctgcaccagaactcttcagagcccagtgcatgaaatgggctaccaaggaaatgagggtaggttcctgagaggaaactggccctgcatttgggagctaggagtctgctaattcgcctggcagccctgtgcagccctccgtggctacagtccaccccgtgcccatcagtgcctccttcctgtgcaagcctggacctcgccctgggctcaggatgggctgtagaccgagaatgcaggcgggaaagtctttgtctatcggggccatagtcaggttctacagtgagtcagggaaagacctgtggaggtgtggatgaggacaatgggtccaccatcaacaggaggacacgggttcgaccccttgcagaggcacagtcccacatcactgggaggcagccacactcactgcctcgccctctcctcacacagtgcagtttccacgttcacagccccagccagtcaccaggaatgccctgggggcggcctttccccagtgcactccgagccctcccttggctgtgcggtgagctccatgcccaggagatatccacccatagtcctccggaaagcagctgacctgccatgccctggaaccacaaatccccacagatcagccagcctgcagtgggccttggatgtggtgaggagtggtggcacccccgttcccaccccacagatgcaacgcctgtgggtgacgcatgtgagtactgaggagtagagggtagaactgtaggccccgagaaccacagaaactcgggtgttacactctggggccatgtaaggagaaagtgtcactggacagaaacaggcccctcctagacactgtgtgcgccatagtcacctgtcattagctctcactcttgcagattcatgattgaggtggttaaaaaaaaaaaagctcctactcacccatccaaccccatcctggggtgtttccaccacccttggggtttgggatgagctgcccttgcccactgtgctctgtggacctccctttagaagctcacagctccctgcactcggctccatcctgccccaccacacagaagcaaaacccctctcctttccactgcaggcttttcctggaccagaatgctgacctgctgcccttcactcccgaagtggtgggactgcctggggtggtgtgggtgttgagccttcttactctagggacctggcacctggccccaggggcacagggatggtgcatctgcctagggatgcctcctcatgccagggggtgggggttagtaccatcggccctcaggatttgttgcatgaatgagtgaatgggtgaataaatgaaggggatctgatctatgaataagggtatatagactttggttgatgtaggacgccaaatgctggaatttcagagtcatcacacccaggggccctgcctctgagctcctctttgcatccaatctgctgaagaacatggctctagggaaacccagttgtagacctgagggccccggctcttcaatgagccatctccgtcccggggccttatatcagcaagtgacgcacacaggcaaatgccagggtgtggtttcctgtttaaatgtagcctcccccgctgcagaactgcagagcctgctgaattctggctgaccagggcagtcaccagagctccagacaatgtctgtctccttcctcatcttcctgcccgtgctgggcctcccatggggtcagtgtcagggagatgccgtattcacagcagcattcacagactgaggggtgtttcactttgctgtttccttttgtctccaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagacacagtgaggggaagtcagtgtgagcccagacacaaacctccctgcagggatgctcaggaccccagaaggcacccagcactaccagcgcagggcccagaccaggagcaggtgtggagttaagcaaaaatggaacttcttgctgtgtcttaaactgttgttgttttttttttttttttggctcagcaacagagatcatagaaaaccctttttcatatttttgaaatctgttcttagtctaatggagattctctaatatgtgacaatgtttttctcttgctgtttttggaattctttgtctttgacttttgacaacttgacttttgacagtgtgcctcaaagaagttctattttgggttctgtgaacctcctggatctgggaagttttcagctatgatttcattaaacgtgttttctacaccatttccctactcttttggaatacccataatgcaaatatttgttcacttaattgtgtcccataaatgctggggattttcttcattcctttttactctttttttctttttattcatctgcctgaattatttcaaaagatctgtcttcaacttcagaaactcttttgcttggcctagtctaatcttgaaggtctcaattgtacttttaatttcattcattgaattcttcaactctggaatttctgttggttcttttttatgatacttatctctttgttgaattcctcattcaaatgataaattgttttcctgatttcactgaattttctatctgtacactattgtatctccctgagtttcttagagattatccttttgaattatttttctgacattctgtatatttccttatgattggggtctgctactggagaatgactgttgtctttttcaggtgtcgtgtttcctggccttttcatgttttatgtgttcctacgttgatttctacacatctggcggaccagtcatcccttgcaatttaatggagtaggttttgcaggaaaagacttcctagtacagacgggtctcagggtgtcagtgtggcggggcgtgctggctttagttctaggttgacgcagtagcgtagtctccatgtcgtttcttcagctgccgtccacattggtgacgtttgcgagtgtctcagtggcctgggctgagaggtttgtggcagtggaagtgcaacgttgctagaggtggactcaccaggctgtttctgaggtcgaggcacatgcatgcacatggtggattgaccaacttggtgccaggctcactagggttggggacatggggctgtttctcaggcccaggatgcaaacacaagtctctttggctggcctgggggtgtggcttctgagggcaatccacagggctgtttctcaggttcaggacacaagtgcatggccgctcaactggcctgggcatgtgtctcccagggccaccccatgggctctttctcagacccaggacatggccacatggcttcctcagctggcctgggtgtgtgtctgctggggggctgcaggggcacagggttatttctcaggccggggtcatgggcgcacagctgcttgctggcttataggagtgcctgccaggggtggcccatgatgctgtttctcaggcctaatttcaggtgcagagcctttgggcaggtcaacggcatacctgtggaaattggagtggatgccacagggctatttctcaggtgcctgagtgtgggcacatatccactctgccagcctggagttagtatcaggtgctcggtggctcaggggcctctcctgctcaggggagggccctcagcagcttggccaaatcaatggtggattcaccctgggcaggcctggcaggctcttcctccagctggatgtgcagcagcaggggttgggttttttgctgtgcagggccagagtcacggccaatcctcagcctaggctctgcacagccagggttgtggcattcagccacccagatatgggcatcctgaagatggagccccaatgctagaaaggggcagtggctaccagcctcagggcaggatgcactccagaggcggctccggtctcaaggtggcgctgggctgcagcagctaggctcacagtggatgaatgggggcagggagtacacaccttgtgctcctaatctgggatcattcctggcagctcccaaacttggctgagggcttgcaaaacctgtggaattctcctgttgcaagggctgtagatgtttgcagtggcagtgggtgctggcgggaaatctgcttaccttttccctacatgggaagtccctcctgtgtccagaccaatccgatctgggtggggaagacaaggctgcaaaggccaggtgcctccatgctgccctccgatcaccacgggtgcgtttccacacctccactgcactccgtcagtctcccttcaacactccagtcaaaccttagctgtttcttctttgccttattccttcctcatggggagggtgtgggtgaacaccaggcttctctaagttcttcatccatcttgctgatgtcattctccatccaggcatgggtttttaagaagtagtgaatactgaaatttcagcagaggacacctctataaaaattctgcaactggaaaacctccttaaattggctgattgtcattacaattggaggaaaactgccaataatttcaaatttagaaggctgagactctataaacaaagactaacaatatgttttctgatatttttccccaaaataatacttttccaagacgaaaatttttccagggtatataagcacatgtgctccaatgatacaacaaatacttactaatcataagcaaataccttaaatgtcttataacatctttcacacaaaagctgttgcatgtctattagctaaaaattcttatgtctcgtccagatcatgcagcatgagcaaagggatttttgaccttcaaaagtctcagtactaactgaggactttacacaaattggaaatggtcacctgcatttcatggtggtggtggggagcttttgcactggaaaatccttctgtagagaagattccattatcttggtaaaattacatagttttattttgcagattgggattaccaactgataaagggttactgatgtggaagttttcctactttattctcctattaggttcctatgtgatatggtttggctctgtgtccccaccccaatctcatctccaattgtaattcccatgtgtccagggagggtccaggtgggagtgattagatcaagggtggtttttcccaggctgttttcatgatagggtgttatcatgagatatgatggtttaaaagtggcaggttcccctgctctctctctcgcctgctgccacataagacgtgccttgctttcccttcaccttctgccatgattgtaagtttcctgaggcctccccagccatgcggaactatgagtcaattaaacctcctctctttataaattacccagtctcaggtagtatctttatagcggtgtgaaaatggactaatacactatggctttgaattaataatttaaaatttgtcagcttggcaataaaacatcctgttgacatttattttttaggtaatattttaaattggcagtttcattcatgtttttacaaattcttattttcagggtgtttaaggcctttgctttgaacttggtggttccttacactccatgctgttagtgaagagggaccaggttgggaggcattggtttgggtggtggtcaggaagggcagagtgatttgagtagggtctgagtggataatagctcatcagtttggaatttataaatgaccagggatgatttaaggagattcctgccagacacctatgccatggccatgccctatctggatctccagccgtgagatgagaacccagccatgcgggggagtctgttcgttctgctcaatgttgtaagtggcacatgctattggataatgtagaattgaatggatatcattttattattataatttacaaacttcctacaataaacttatcacctttatacatagaaacaaatataagtacattttccctcccctatgtcattttgagccctctctccaaaccatcctcccactctgcgactcactgtcctgcatttggctatgctctggcaagtcctgcttagacaagcactcaccagaccacctactcagcctcccttcagcgcccacctggcccacctgctcaaatacatgttgagtggtcacacacatggactgaacaccatctattccatgcactgccccagtgaccgcactgagcagcaagagagaaatgatcgcattagctatcaattatgccaattcaaatgctggagtctttctcagatacttttcaatgttcaagaattgttgattgtgaattctatacccaatgaaactatccttcagaaatgagcagaaaatggataccttctcaaataaacaaaaactaaaagaattcttgctacaagatgtactcttaaagactggctaaaggaagttcttcaaacagcaaggaaattgaattgatcttatgtcctgcacacttgctaaatttcctctcaattttagcagcactgtttagattccataggattttccatacaaacagtcatgtggtctatatatagagacagattttcctcttttccagtggggataaatttatgtctttttctttctgtgttacagcaggtaggacctccagtacaatgttaaacagaagtggtgaaaacagacattcttgcctgtttcctaacgttggagtttggtcttttactatggtgtcagatgttagctgtagggtttttataaatgcccttcatcacattgaggaagtttgctcctatgcctaattttctgagagtcttttaatgtgacactcatgctagaatttattaaatgctttctgtctactaagatgattatgcagttcttatattaacatgaataattacatttatttattctttaatatcaaggcaattttgcattcctgagacaaaccccatttagtcatcatgtgttgttattgttacatattgttggattcaatttcctcaaaatttgttaagaattgttacatctatgtttacaaggaagattagtctgtagggtattttttcttataataactttgcctagttttgcaatcagggtaatgctggactcacagaatgagttgggaagctatttcctcctcttcatttttctgaaagaatttgtataaaattggaattatatcttccttaaaggtttgcaagatttcataatgaagtcattggcctagagttttctttgtgggaaagtctttgtttgtttgttttgtggtttgggtttttttttaagagacacagtctcactctgttgcccaggctggaatgcagtggtgtaatcatagctcacagcagcctcaacctcctgggctcaagcaatcctcctacctcagccttcagagtagctgggactacgggcatgtaccaccacacccagctgtttgtttgtttgtttatcgctttgtcttgtttttgaggtcttattatgttgcccaggctggtcttgaactcctggcctcaagtaatcctcatgcctcagcctcccacagtgctggaattacaggcatgagccactgcacacagactgtgggaaagtttttaactaaaaattcaattttctcttccttttccagtgagctttccagtgtctttcaattaatgtatctattttatctaagttgttgaatttattgtcaaaatttttttaaacaatattcctctcttagaggttgaacatctgtagaatctgtagtgatggcacctcttaaatccctgatcttgctcatctgtgtcgtctctctttctctaatcagtatgcctaaagtttaatttcattgattttcttaaaaaactggttttggttttattgatttttttccctagttttttgtgttacatttcattgacttctgctctgatatttactatttcctttctactgcctacagtaagtttaatttgctattttcttagtttcctaaagtggaagctaagtttattgacttgaggcctttcctctgtctggatgcggatatttgctgctaaacatttccctccaacaccatgctgtgagttttagttacagcgggcttggagttggcctgagaaattctacttaaacagctgcacctatcatgtaagtgataaatgatgtacctgcctggccctcacccctggtcaaagaatgggatgtactaatgagcaatgttgctgcgtagctgtggatttcaaggtattttctgtgtggttttatcatcagcattgtttgttgatgactgcaagactgatgatttgcacctggcctcggtgagatccccgaaagaccctgcagatgggctggttacttagcagaaaatatgacaacgtggccagcaggaaacaggaaggtacaatcggctgcaggtgagctgttggaagtaagttccaattttcctattttgtatttgcattttaatagtgagactgcgcttatgttatttgtgtgaaacagctttattcatagcactgtaatttaaagagaaaacccattcatgggaacaacaaacgacctagacaccaaggtagctcatgccatccaaggctatactgtgcagtgattgggaaaatgggcactggtcccagaagtctgatcgacactctgccactggctagtcccgtgctggggggcgaggatccacactctgccactggttagtcccatgctggggacaagtatccacactctgccactggctagtcccgtgctggggggcgaggatccacactctgccactggttagtcccatgctggggacaagtatccacactctgccactggctagtcccgtgctggggggcaaggatccacactctgccactgattagtgttgtgaagatttaaataaagaacccacaccatattctttgacttgtgctttccgtatactgagagatagtaagagtacattattattatttataaagtaaactagaaagcacatgggaagacaagaagaaaacctgaataaacatgaattaccccattttcctcaggagaaaactttcacactctgaaggtacacaaattagcctacaaatttaatgtaaagcaaatagactgttgtaggtaccaattctcaatgtcacagtgttacatggaaagtaaaatacacaagaacagcccaaaagatggaaacaatggacgtggtcaaatgacatcagtacaacatccatatggtcctaagtagccatctttaaaatgggttagaaatgccttcaatcattcacacagacacatgcattgaacaaactctaagaagtgttcttacacgggaaaagcaagttacagatgcatgggcatgatatggatgtagatgtgtgtatgtgcatcccactcatacacaaaatacccagcatcgcccacatgcctgctgtgtgcgtaagtgtgagcgagtgcacagacaacagcgtgcagaaattcaaaccaagctgtgggtacttgttaccactgggaagggagtcggtcacagagggaaagagaaacaggacatcagcctttgacttcagaactgttcctgccttttcacatcctgtgctgttttcagcatcatcggagcccttaacacacatcacgggagtaagagtgtgttagagggagcattcggtgggacagatattgccatggcttgtggatagagttcacagtccttaataatccccgagatggcagccaagagctacgttctcaatcacgcagcttcaccccagaaactgacagaaacccaacaaccaaaaggtgtccattctgacagcctcagcctgtgctggctcagatgagcaaaaatgtacagatattaataatgatgttgatttgaagagcacagaggggggtatgcatgataagggtccaaatttttaccttaaaaaagaatacatttacttctcaatcacctacataacgatcattttttaaaaaactgatcaaatttggtgttacaagggcacgttgcaaattcttctggctacttttctctgactattctaattacgttaccgtgttttctcctgtatgtgcccgttcatgtgaatgtcatttctggctacttttctctgactattctaattacgttaccgtgttttctcctgtatgtgcccgttcatgtgaatgtcatttctggctacttttctctgactattctaattacattaccgtgttttcctgtatgtgcccgttcatgtgaatgtcatttctggctacttttctctgactattctaattacgttaccatggtttctcctatatgtgcccgttcatgtgaatgtcatttctggctacttttctctgactattctaattacgttaccgtgttttctcctgtatgtgcccgttcatgtgaatgtcatttctggctacttttctctgactattctaattacattaccgtgttttcctgtatgtgcccgttcatgtgaatgtcatccaggcagatttcccaaatccggcttcctgtaaccaagggctgaaagagggaacggtttcctgggaatcctttttgcagtttattttacccggaggcagaagcccacggttccgtgaagagtctattgctctcccctctctccttttgtgtctctatttttaattgacaaaaaagcaaatgtgaagattcctggggtacaatgcaaagtgacaatgcctgtctatattgtgggatgattaaaacaaggtaagtggcatatccatcacctcacacacttatcattttgtggtgagaacatttaaaatctcatcttttagcaattttgaaatagtcattattgttaactatagtcaccatgctgtgcaacagatcaaaagaactgactcctcccatcagcagaaacttcatgccctttgaccagcatctctcctttccccgtccacgactaacccccagcccaagagaacagccaacacccacctcgctgctgccacacgacatgtcgggctttgatgggatggaggtgagggtggggaagacaattccaaagctggagcactggcctcacagctcagacactcttctacttatcctgagagaatgatgtgctgagaccaactaaacctcccctgctcttcccacatggcagaaaagaggcaacccagggaagccattgccaggacatcatggtcacccaacccttgtgcagaaaggaagcacctgcccaggatgccatagcacccaaccctcatccccaaggaaacacagcccagggcaccatggacacccaaccgtcatccccaggggaggacacagcccagggcaccatggacacccaaccctcatccccaggggaggacacagcccagggtatcttggacacccagccctcattcctaggggagtacacagcccagggcatcttggacatccaaccctcatccccagggaaggacacagcccagggcatcttggacacccaaccctcattcccataagagcacacagcccagggcatcgtggaggcccgaccctcatccctaggggaggacacagcccagggcaccatggacacccaaccctcatccccaggggaagacacaacccaggccaccattaacacccaatcatgtgcagggagggtgtccttggagcctgggactcttgccagtgaagcggtggacaagaaactgaggatgcgatcagcacacagaaatctcaggcagcctaggatacatgaggcctctcacccctgggaacactgagcagccaccaggagcccacaccttgaggtacagcaggagccatgcgctcttgctcttgctcactcacactcctgcacacagccactgacacacgccctcgtgcacgttgcagattaactccactggccttgcacttgcaacgctggaggctgagaggtatccccaggttcttttctcgtgagaggggcaggctgactttcactctcctccatgtgctagaggcagctccaccaacactggctgccctgagtggatgcacctggctctggaattcctgtcatttgctttggatccaggagcccctgcctcatgtagctacttaacagaaaggaggaatccacccaggacatgcccagacgggagcctcacaggatggacagtggtgtctggggtcacgggcagccctgacccagcagcgccagcaccagcacacccagtggggaaggcggggaggcccaaacgccacccacagtttgttactccactgggtgggacccggcacccctgccttcctgacaccctggagtccctgcctcctcctagagcccccaagcccatctgcctcagagcatccagagacagacctggggagccatttcctcaggccctggacaaggaaacagggaattccaggttatgggtgcctggggcaggtctcaggcaggtgctgggaaccagagagaggggtcaccgcgaggcctcaggcctggcaccagcactttgagcctcagtttaccagcccacgaggtgctgagtctggactggatgaccttcccacccccagtgacctctgccctttcccgagcatgtcagctctgctccagcatcctggtgtgagcgcaatgccactttttttctcaacaaatacgaaaggaggaaggtgcccccagggccctgtgccctgaggatgcctgtgtggaggggtccatttcatcactggtgtcactcacaggaagggacgaagccacctgccttgacggagcttactccacctccgccgaaggccggggaggtccctcacagagaacctgaggcccagcaggctgcagaggtgctggcatggaatgactgctcagacgcccggggccggcagagaggacggatgtgggggaggtgcacactgaggagcctctccttggaggtggagacacgtgcaccacatggaccaggacacagtccacgaagcctcgcatccccctgagctgcagctcaagggcctctctctgagcccagagtcccacccctgggaggcagctgccccagctctgagggaggagggcatccaccaggccctccatctcctgggggcaccagcccagcccagaggctctgcaggactctgcacctccaattcatggccaggactttctggatgtatcttaaggactgaggactccacatcagggaccacacaagaccggggtcccggacacgggggttgggggtgagcatgtcaccgggatgggctgtggcgtcactctggtacttcatccggacagccagggaccaaagccacgccctcagccccaccccacccctgcctcacatggcaacgcagggtctgcagatgcaggagagtgagaagcatggtagccaggcagactagaggacccgagctggggttgagcacctccctgtctacccagggcatggcctgtgagactgcaggtggcctagtgtgtgctgcaggctcaaggtcctgccccagggagcatgacattcaggcccagaaattgcatcgtgctgcacacagtccaaggggataaccctgtgaagttcaggtcaccagcaggcttggggtcaagaccgagctgcagaggacaggtttctggaaggcacagcatcatgggtggagggacttggagcaaggtccttagccccgggaccagtgaatgtgtgcccttatagggaaagggggtctgtgcagaagcaagttagctgaaaatcatgaagtggagaggctcccctggattaaaggggtgagccctaatgtaatcacaagtgtccttctaggaggttggcagagggagactgacatagacagaagccaggtgaggtgggaagcggaggcagaggccgagagagcagacgctacgccctggccctgaagacggaggaggagccgagagctcagggatggagagactggaggaggcagggaagttctccccgcaagcctggagggagcatggcctccagcacccccagaccttggccctgcaggattcatctggacctgtggtataaatggtgtttaagccactgggctgtgcaaattgtcatagcagccatggcgcattcctagagggagccctggtggggacccagcaggcagcgacggggccctcacaagcctgtgagccactcagagccgcgagagtggctaggcttggtgaggtgcaggccacgcgcacctccactaaggcagccttagggcccacacatcctctctctctctctctctctctctctctatctctctccctccctccttccctccctcccgctctcttggttggacagctctccatcatccccctggacacgaccacctcccaaggccgagctggggcgctttgctcgaggtgagcactgacatcctgggggtgtgaggggcacctgcccagcggccccgtgtgcaggatgggcggtgggccctagctggcactgggcatatggcccggctggtgcctgcaggctgcagcttttctggggtggctgggatcagtgaaggcctccagagtctgggcctgggatccctgcagtgctggctgaggacaggcggggctgggcagtgagggcactgggtcactatcaccacccacggtttattacttcactaggtgggacctggcacccctgccttcctgacaccctggaatccctgcctcctcctacagcccccaagcccatctccctcagagcctccagagacagacctggggaggcatttcttctgcccccagcagaagcccgggaggccgggaaggcacagtgggtctaaaggagaggatcccaggactgcctgaggggtgactccgacgaggcaagcatagagcccactgagaagcggggtgggagccccaccagggatgggctagttcctcatgaaggaccaggacccaggaaggacaagggggcctgctggggcagggtctgctatgccggagtccctgtgagcctggcccagacctgcctctctctttcctcattggtccccacaggtccgtggtggttgccgtatcgggaggccccatggtggcaggggtgggacacctggtatacgtcgccaggtgtgtccaataggctcatgctcacaccttctcctggcacctgggcaaagcctgagcacccaggcactgaagtgagggcaaggcctcggggccccacaggatggccgaggagacagctgcagggcgcctgggacccctgggctcaggaggtagaaggatacagcctgaaaacccacaccacaagctcaccggccagtgcaggcccacagagctcgaggaggcagccctgagcctcccagggagagatgctctgtgcacgccggcacaggccctgggttacaaaccctaggcacagcccaggagaggcccaggccccagtccagcaaggggttgcaggaagcaagaggtccccggccacagcatgagataagcccatcaagccagggccaggtgggcaatgggaggcaggcagggcttgggggtgagtccctgctgcagcgccgtccactgtcgaccggaggagtttcttccctgtgcggagtccacgggcctcctgtgagtgtgtgcatgggcacaagtgtgtgtgtggctctgctgtgtgtctgtacacacgtatgttttgggtttttttgtgtctcagaccacagagtctgcccctcccaccaaagcccaggcagaaggatgaacccacgcccctggggcccaggcctcagcagcctctgcaggatcattgttcccagttgtcacttgcctttgccacagccctatttctccacaattccttaaagtcctcaacatgcatttaaggcacaaaggtgaaactgcccagaaacatctgactccgccgtggaacccaggagcaagctgggttagctaaggagcggggccgttggcagaggctggggatccaggctgaactttggaggaggcatgtgccagcatgggctcctgactatgtcctcctgggacaaacccaaacccactctttgaatatgggagggactttgctggccccggccctgaccgcagcacttggaaactgaggagtggtcgcctcctccgtgtcacagctgcccgttcaccatcatagaagcaactctgtcacctccatgggcccctctgtggctgctgcctgggtccaagctgagcccagctgcccaggcccagaaggaaagcccaggccaggtgcccagcacagaggcagtcacataccccggggagagccacagcaagcagccaatgttgcccaggagaggagtagctgacaaggtagaacgtgagctgccatcggctcgagaggctttgctggtcctcctggggctctggacatgaccaggaggagcgagggaagaagtcgcatggtggtcccatcctgggtggggcctgatggcagctggccacccgtcccagagtggcagccagatgccagcgccattcccacagtcacatcattggtcacagaatgcaggacatagagtgtcttctttccatcacagtgctgtccagacccatagcctagggtagacctggaagattcaatgtccacacccggggctggagcgtagccatgagccacgccccctgcccgtgcatggaaagccagcccaagctctgctccatccctagccaaagtcagtgtcctttccccttctcccaagtgagctctagccacctgcctaccctgccatctgaggatgacagccttcattccattggaacctggctctgccaccagcaggcttgcagtcctgggcagactccgtcacctctctatgcctcagcctttccatctgcacaggaggaagatgatgatggtggtgatgatgatggcgatggtttccttttgcatctgaggcaaggactaattgagatgatacacatcaggcactgggtatggtgctggtccttcctgagcactcaatctatgtgagctgtccttgtgaaatgggtgtcaccacatttccccacgcagaacatcctttgtctgccatacttgaaacatctgccccaatattaacagttccttcatggaagatgtgcacacccacccaccctcatactcccaaaggtgcccgtgctttatcaagccaaagtccagccaggaactttacagcagcatccctttccctctccaagcaccaaggagcaaggcaaagcactacatcttccatctggaggcaatgccaccctcttctcccattttcactgccatccctaagaggcagtgcttccccaaaaggttccatagcagcctgcctacagcaactctgttcacacgagtttcagcatccttgcagtggctcccctgccatgctgtggctcttcattcaccctcttctcctgctccccgtgacaggcatagattctgagtgatctggatacattgctttgtttaataacattacagcttctgtgctgaaaaagatacagcagatagagaaggcaattgttgaacacaaaatagtgacagcagagatgacggcaagttggcatttttcttttctagcaataaaacttaaagctgactcaaggagaaatggaaatcataattggaacagtaatcctcaagaaagcattaagattattaaataattgccctcacagatgacttcaggccaagatggctttatgggtgaagtttagactttcacaaaactaatcagttcccataagaactgctccaggatttggaggaacatgggaaagtctattaaagggatcacaattcacagtccccagagtaaaacatgggctaacttgcattttggcaaagagccaaatgttataaatgacatcctagaaggccaaattctgtccatctcgttgaacaaggacttacaccaggaatttagaactatttatagctcatcccaccactcaggccaatgatgacccatgatcatctcaccagaaatggaaagactcagatgattaatagagtctcaatttctctgagacatctaagagcccagcccaagcccagacccaggagggcacccaggcctggacagagaacactgatatcacaccagccctccagagggaagcagagactccttcaagctctggaaacacaggcccagacagctgcctaaagttgggcaggcttcactgcaaacccaaatcatgaagctaggtaacacctttacagattctttacatttaaaaatcatcaaaacaagagtaaataataaactcaaataatattaatctaatatgtaaaggtcttgtaccattattatgcaaacaacatacataagctaataagaaaaagaacaaatcccttaagaaatcggcaaaaaggatataacacaatttctaaaagaaaacaaatggctagcacacataaggaaaacactttgtgaacagacattcttcagaacattatttataattataaaatagttgaaagcaagatagtgcctgaagaaattatggtgcatacattagtgggactattctgcaaacattcccaattatacttgtcacatatctgtgataacgtgacagccagcattcatggggtgacctcatttggtaaaagggtgcaaagctcaacacgcattgtgagatgactgtggtgtaaaattagtgggattattccgcaaacattcccaattatacttaccgcatatctgtgataacatgacagcattcatggggtgacctcatttggtaaaagggtgcaaagctcaacacgcattgtgagatgactggtgtaaatacaaagaccaaactgtgaaaaggagtccatcaattaatcgatgcttaccttcagttttgggctaatttttaaagtatgctataagcatatgctcctgttataacagaatggagggattatgagagatgatgcaggtgtgtcctgggcctcccctggcccactgggccctagagatgccttcccaggcatcgctgtcagggcttccctcagagggagtcctgtattgacctcaccaccaaggtctggagcaggggatccttagatattggttggggttatctcaccttaggtctgaatttggggttgtcttagactgttttgtgctgttagaatagaatacccaagactgggaaatttatactgaacggaaatttatttctcacagttctagaggctgtgaagtccaagagcacaggtgccagagcaagtccaagagcaagggaaagtccaaagcaagtccaggagcatctggcgaggaccttcttgctgtgtcatcacatggcggaaggcaagaaagagagcaagagggggccgaactcacccttttataacagcaccaatcccacccatgaggtggggaccttatgacctaatcactcttcatactgttacaatggcaatgaaatttcaacatgagttttggaggagagaagcattcaaaccacagcaagggtgctcctacctcctctctcagggcatctgcagaaagagctgcaactgcacgtccttcctccgtccatcctccatcccttcccaatgtccgtgcatatcctgtgacccaggaggtctggcatagggggtgctcctgccttaggtctgaggccctgtctgaagaggggtaggtgaggaggccatctgatggtctgggccaagacagtcacaggacgcatcatttatcatcaaggaggctgagggttgagtctccaggtccagggaactccccacaaagtgggaaccctgcccagctccacacagcctctgctgggggaccctgctctggtgcagagcctggggacaggtcttgagctcagccagagtctgcctccctgtcatttaggaactaaaccaagcggcaggatgctggagcccagcccccatctgaccttacagggccaaggctggggccctgggttcccctcaaggcgcagcaggactggagccccaggcagtgcaggagtggccaaagctggggcttcctccagagcccccaagcatcacggcaccaagaagggtaggaccctggcctgaggaattggcaccaaagccccagaaactaccctggacaccatggagagaggcctggaggggaagcaccaggcactgcctccccttctgatcccacctgaggtggctgccaagcccagagagccgctctgatgtcccccagccctgcagcccagggatacctgtactgtgcccctgggggacccctggccagtctgtgcaaagaagtcaccaccctacactcagagacagtgggggtcctcgtcccacatcctcagagcatggcccggctgctgcagggatggtctcctggtcctcagagcatggcccggctgctgcagggatggtctcctggtcctcagagcatggcccagctgctgcagggatggtctcctggaggccccccagtgctctattgtcagggctccctccaccccccgcaccaagagagagccagaccccagcaaggcttccagtggcttcaggtcacacccctaggctgaccccagccccattaacacctgcctgagaaagctccacgcaccagaactgaccgtctgctccaactcttgacctcccgttctcagggcgtctgctgaaaaggctgcaactgcacatccttcctccgtccgttcccgatgtccgtgtgtctcctgtggccaggaaggtctttctcgggacctgagagccgctccctgaagtgtccccattgggaaggatggggcctgtgtctccaggctctgggaggacagaatcctgacctcaacagtggccggcacggacacaactggccccatcccggggacgctgaccagcgctgggcaacttttcccttccccgacgactgagccccgagcaccctccctgctcccctaccacctccctttacaaggctgtggcctctgcacagatgataatggagcttggctcattcccctagagtcggtagggagttaaggacaaaactcagtttcctccacctgaactcaagtctgcctatgtttacctaatcacacctggtggacagtttggacaaacttgcacactcagagacacagacacttctagaaatcattatctccctgccccggggaccccactccagcagaagtctgctaggcactggcctgggccctcctgctgtcctaggaggctgctgacctcctgcctggctcctgtccccaggtccagagtcagagcagactccagggacgctgcaggctaggaagccgccccctccaggcgagggtctagtgcaggtgcccaggacaagaaagattgtgaatgcaggaatgactgggccacacccctcccgtgcacgccccctcctgccctgcaccccacagcccagccccccgtgctggatgcccccccacagcagaggtgctgttctgtgatcccctgggaaagacgccctcaacctccaccctgtcccacggcccaaggaagacaagacacaggccctctcctcacagtctccccacctggctcctgctgggaccctcaaggtgtgaacagggaggatggttgtctgggtggcccctaggagcccagatcttcactccacagaccccaacccaagcacccccttctgcagggcccagctcatccccctcctcctccctctgctctcctctcgtcgcctctacgggaaatccgggactcagcagtaaccctcaggaagcagggcccaggcgccgtttaataggaggcttcctcacaatgaaacttttagaaagccttgactacaatgatgaccttggtgtggctgtgaacactgtcagctcccacagctgctgcagcaaaaaatgtccatagacagggtgggggcccggggtcgtctgctgtcctgctcagcccacagcacgcatggaggatctgaggtgccacacctgacgcccaggccagaacatgcctccctccagggtgacctgccatgtcctgcattgctggagggacaggggcagcctatgaggatctggggccaggagatgaatcctattaacccagaggaaaactaacaggacccaagcaccctccccgttgaagctgacctgcccagaggggcctgggcccaccccacacaccggggcggaatgtgtacaggccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggaacgaccaccgtgagaaaaactgtgtccaaaactctctcctggcccctgctggaggccgcgccagagaggggagcagccgccccgaacctaggtcctgctcagctcacacgacccccagcagccagagcacagtggagtccccactgaaccccactgaatggtgaggacggggaccagggctccagggggtcatggaaggggctggaccccatcctactgctatggtcccagtgctcctggccagaactgaccctaccaccgacaagagtccctcagggaaacgggggtcactggcacctcccagcatcaaccccaggcagcacaggcataaaccccacatccagagccgactccaggagcagagacaccccagtaccctgggggacaccgaccctgatgactccccactggaatccaccccagagtccaccaggaccaaagaccccgccccggtctctgtccctcactcaggacctgctgcggggcgggccatgagaccagactcgggcttagggaacaccactgtggccccaacctcgaccaggccacaggcccttccttcctgccctgcggcagcacagactttggggtctgtgcagagaggaatcacagaggccccaggctgaggtggtgggggtggaagacccccaggaggtggcccacttcccttcctcccagctggaacccaccatgaccttcttaagataggggtgtcatccgaggcaggtcctccatggagctcccttcaggctcctccctggtcctcactaggcctcagtcccggctgtgggaatgcagccaccacaggcacaccaggcagcccagacccagccagcctgcagtgcccaagcccacattctggagcagagcaggctgtgtctgggagagtctgggctccccaccgcccccggcacaccccacccacccctgtccaggccctatgcaggagggtcagagccccccatggggtatggacttagggtctcactcacgcggctcccctcctgggtgaaggggtctcatgcccagatccccacagcagagctggtcaaaggtggaggcagtggccccagggccaccctgacctggaccctcaggctcctctagccctggctgccctgctgtccctgggaggcctggactccaccagaccacaggtccagggcaccgcccataggtgctgcccacactcagttcacaggaagaagataagctccagacccccaagactgggacctgccttcctgccaccgcttgtagctccagacctccgtgcctcccccgaccacttacacacgggccagggagctgttccacaaagatcaaccccaaaccgggaccgcctggcactcgggccgctgccacttccctctccatttgctcccagcacctctgtgctccctccctcctccctccttcaggggaacagcctgtgcagcccctccctgcaccccacaccctggggaggcccaaccctgcctccagccctttctcccccgctgctcttcctgcccatccagacaaccctggggtcccatccctgcagcctacaccctggtctccacccagacccctgtctctccctccagacacccctcccaggccaaccctgcacatgcaggccctccccttttctgctgccagagcctcagtttctaccctctgtgcctaccccctgcctcctcctgcccacaactcgagctcttcctctcctggggcccctgagccatggcactgaccgtgcactcccacccccacactgcccatgccctcaccttcctcctggacactctgaccctgctcccctcttggacccagccctggtatttccaggacaaaggctcacccaagtcttccccatgcaggcccttgccctcactgcccggttacacggcagcctcctgtgcacagaagcagggagctcagcccttccacaggcagaaggcactgaaagaaatcggcctccagcaccctgatgcacgtccgcctgtgtctctcactgcccgcacctgcagggaggctcggcactccctgtaaagacgagggatccaggcagcaacatcatgggagaatgcagggctcccagacagcccagccctctcgcaggcctctcctgggaagagacctgcagccaccactgaacagccacggagcccgctggatagtaactgagtcagtgaccgacctggagggcaggggagcagtgaaccggagcccagaccatagggacagagaccagccgctgacatcccgagcccctcactggcggccccagaacaccgcgtggaaacagaacagacccacattcccacctggaacagggcagacactgctgagcccccagcaccagccctgagaaacaccaggcaacggcatcagagggggctcctgagaaagaaaggaggggaggtctccttcaccagcaagtacttcccttgaccaaaaacagggtccacgcaactcccccaggacaaaggaggagccccctgtacagcactgggctcagagtcctctccaacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctatgcccacagtgacacagccccattcccaaagccctgctgtaaacgcttccacttctggagctgaggggctggggggagcgtctgggaagtagggcctaggggtggccatcaatgcccaaaacgcaccagactcccccccagacatcaccccactggccagtgagcagagtaaacagaaaatgagaagcagctgggaagcttgcacaggccccaaggaaagagctttggcgggtgtgcaagaggggatgcgggcagagcctgagcagggccttttgctgtttctgctttcctgtgcagatagttccataaactggtgttcaagatcgatggctgggagtgagcccaggaggacagtgtgggaagggcacagggaaggagaagcagccgctatcctacactgtcatctttcaagagtttgccctgtgcccacaatgctgcatcatgggatgcttaacagctgatgtagacacagctaaagagagaatcagtgaaatggatttgcagcacagatctgaataaattctccagaatgtggagccacacagaagcaagcacaaggaaagtgcctgatgcaagggcaaagtacagtgtgtaccttcaggctgggcacagacactctgaaaagccttggcaggaactccctgcaacaaagcagagccctgcaggcaatgccagctccagagccctccctgagagcctcatgggcaaagatgtgcagaacatatgtttgtcatagccccaaactgagaatgaagcaaacagccatctgaaggaaaacaggcaaataaacgatggcaggttcatgaaatgcaaacccagacagccagaaggacaacagtgagggttacaggtgactctgtggttgagttcatgacaatgctgagtaattggagtaacaaaggaaagtccaaaaaatactttcaatgtgatttcttctaaataaaatttacagccggcaaaatgaactatcttcttaagggataaactttccactaggaaaactataaggaaaatcaagaaaaggatgatcacataaacacagtggtcgttacttctactggggaaggaagagggtatgaactgagacacacagggttggcaagtctcctaacaagaagagaacaaatacattacagtaccttgaaaacagcagttaaaattctaaattgcaagaagaggaaaatgcacacagctgtgtttagaaaattctcagtccagcactgttcataatagcaaagacattaacccaggttggataaataaacgatgacacaggcaattgcacaatgatacagacatacattcagtatatgagacattgatgatgtatccccaaagaaatgactttaaagagaaaaggcctgatatgtggtggcactcacctccctgggcatccccggacaggctgcaggcacactgtgtggcagggcaggctggtacctgctggcagctcctggggcctgatgtggagcaggcacagagccgtatccccccgaggacatatacccccaaggacggcacagttggtacattccggagacaagcaactcagccacactcccaggccagagcccgagagggacgcccatgcacagggaggcagagcccagctcctccacagccagcagcacctgtgcaggggccgccatctggcaggcacagagcatgggctgggaggaggggcagggacaccaggcagggttggcaccaactgaaaattacagaagtctcatacatctacctcagccttgcctgacctgggcctcacctgacctggacctcacctggcctggacctcacctggcctagacctcacctctgggcttcacctgagctcggcctcacctgacttggaccttgcctgtcctgagctcacatgatctgggcctcacctgacctgggtttcacctgacctgggcttcacctgacctgggcctcatctgacctgggcctcactggcctggacctcacctggcctgggcttcacctggcctcaggcctcatctgcacctgctccaggtcttgctggaacctcagtagcactgaggctgcaggggctcatccagggttgcagaatgactctagaacctcccacatctcagctttctgggtggaggcacctggtggcccagggaatataaaaagcctgaatgatgcctgcgtgatttgggggcaatttataaacccaaaaggacatggccatgcagcgggtagggacaatacagacagatatcagcctgaaatggagcctcagggcacaggtgggcacggacactgtccacctaagccaggggcagacccgagtgtccccgcagtagacctgagagcgctgggcccacagcctcccctcggtgccctgctacctcctcaggtcagccctggacatcccgggtttccccaggcctggcggtaggtttggggtgaggtctgtgtcactgtggtattacgatttttggagtggttattatacccacagtgtcacagagtccatcaaaaacccatccctgggaacctgctgccacagccctccctgtggggcaccgccgcgtgccatgttaggattttgactgaggacacagcaccatgggtatggtggctaccgcagcagtgcagcctgtgacccaaacacacagggcagcaggcacaacagacaagcccacaagtgaccaccctgagctcctgcctgccagccctggagaccatgaaacagatggccaggattatcccataggtcagccagacctcagtccaacaggtctgcatcgctgctgccctccaataccagtccggatggggacagggccggcccacattaccatttgctgccatccggccaacagtcccagaagcccctccctcaaggctgggccacatgtgtggaccctgagagccccccatgtctgagtaggggcaccaggaaggtggggctggccctgtgcactgtcactgcccctgtggtccctggcctgcctggccctgacacctgggcctctcctgggtcatttccaagacagaagacattcccaggacagctggagctgggagtccatcatcctgcctggccatcctgagtcctgcgcctttccaaacctcacccgggaagccaacagaggaatcacctcccacaggcagagacaaagaccttccagaaatctctgtctctctccccagtgggcaccctcttccagggcagtcctcagtgatatcacagtgggaacccacatctggatcgggactgcccccagaacacaagatggcccacagggacagccccacagcccagcccttcccagacccctaaaaggcgtcccaccccctgcatctgccccagggctcaaactccaggaggactgactcctgcacaccctcctgccagacatcacctcagcccctcctggaagggacaggagcgcgcaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtaactaccacagtgatgaacccagcagcaaaaactgaccggactcccaaggtttatgcacacttctccgctcagagctctccaggatcagaagagccgggcccaagggtttctgcccagaccctcggcctctagggacatcttggccatgacagcccatgggctggtgccccacacatcgtctgccttcaaacaagggcttcagagggctctgaggtgacctcactgatgaccacaggtgccctggccccttccccgccagctgcaccagaccccgtcctgacagatgccccgattccaacagccaattcctggggccaggaatcgctgtagacaccagcctccttccaacacctcttgccaattgcctggattcccatcccggttggaatcaagaggacagcatcccccaggctcccaacaggcaggactcccacaccctcctctgagaggccgctgtgttccgtagggccaggctgcagacagtccccctcacctgccactagacaaatgcctgctgtagatgtccccacctggaaaagaccactcatggagcccccagccccaggtacagccatagagagagtctctgaggcccctaagaagtagccatgcccagttctgccgggaccctcggccaggctgacaggagtggacgctggagctgggcccacactgggccacataggagctcaccagtgagggcaggagagcacatgccggggagcacccagcctcctgctgaccagaggcccgtcccagagcccaggaggctgcagaggcctctccagggggacactgtgcatgtctggtccctgagcagccccccatgtccccagtcctgggggcccctggcacagctgtctggaccctctctattccctgggaagctcctcctgacagccccgcctccagttccaggtgtggttattgtcagggggtgtcagactgtggtggatacagctatggttaccacagtggtgctgcccatagcagcaaccaggccaagtagacaggcccctgctgtgcagccccaggcctccagctcacctgcttctcctggggctctcaaggctgctgttttctgcactctcccctctgtggggagggttccctcagtgggagatctgttctcaacatcccagggcctcattcctgcaaggaaggccaatggatgggcaacctcacatgccgcggctaagatagggtgggcagcctggcggggacaggacatcctgctggggtatctgtcactgtgcctagtggggcactggctcccaaacaacgcagtcctcgccaaaatccccacggcctcccccgctaggggctggcctgatctcctgcagtcctaggaggctgctgacctccagaatggctccgtccccagttccagggcgagagcagatcccaggccggctgcagactgggaggccaccccctccttcccagggttcactgcaggtgaccagggcaggaaatggcctgaacacagggataaccgggccatcccccaacagagtccaccccctcctgctctgtaccccgcacccccaaggccagcccatgacatccgacaaccccacaccagagtcactgcccggtgctgccctagggaggacccctcagcccccaccctgtctagaggactggggaggacaggacacgccctctccttatggttcccccacctggctctggctgggacccttggggtgtggacagaaaggacgcttgcctgattggcccccaggagcccagaacttctctccagggaccccagcccgagcacccccttacccaggacccagccctgcccctcctcccatctgctctcctctcatcaccccatgggaatccagaatccccaggaagccatcaggaagggctgagggaggaagtggggccactgcaccaccaggcaggaggctccgtctttgtgaacccagggaggtgccagcctcctagagggtatggtccaccctgcctatggctcccacagtggcaggctgcagggaaggaccagggacggtgtgggggagggctcagggccccgcgggtgctccatcttggatgagcccatctctctcacccacggactcacccacctcctctccaccctggccacacgtcgtccacaccatcctaagtcccacctacaccagagccggcacagccagtgcagacagaggctggggtgcaggggggccgccagggcagctttggggagggaaggatggaggaaggggagttcagtgaagaggcccccctcccctgggtccaggatcctcctctgggacccccggatcccatcccctccaggctctgggaggagaagcaggatgggagaatctgtgcgggaccctctcacagtggaatacctccacagcggctcaggcaagacccaaaagcccctcagtgagccctccactgcagtcctgggcctgggtagcagcccctcccacagaggatgaacccagcaccccgaggatgtcctgccagggggagctcagagccatgaaggagcaggatatgggacccccgatacaggcacagacctcagctccattcaggactgccacgtcctgccctgggaggaacccctttctctagtccctgcaggccaggaggcagctgactcctgacttggacgcctattccagacaccagacagaggggcaggccccccagaaccagggatgaggacgccccgtcaaggccagaaaagaccaagttgtgctgagcccagcaagggaaggtccccaaacaaaccaggaagtttctgaaggtgtctgtgtcacagtggagtatagcagctcgtcccacagtgacactcgccaggccagaaaccccatcccaagtcagcggaatgcagagagagcagggaggacatgtttaggatctgaggccgcacctgacacccaggccagcagacgtctcctgtccatggcaccctgccatgtcctgcatttctggaagaacaagggcaggctgaagggggtccaggaccaggagatgggtcccctctacccagagaaggagccaggcaggacacaagccccctccccattgaggctgacctgcccagagggtcctgggcccaccccacacaccggggcggaatgtgtgcaggcctcggtctctgtgggtgttccgctagctggggctcacagtgctcaccccacacctaaaacgagccacagcctcagagcccctgaaggagaccccgcccacaagcccagcccccacccaggaggccccagagcacagggcgccccgtcggattctgaacagccccgagtcacagtgggtataactggaactaccactgtgagaaaagcttcgtccaaaacggtctcctggccacagtcggaggccccgccagagaggggagcagccaccccaaacccatgttctgccggctcccatgaccccgtgcacctggagccccacagtgtccccactggatgggaggacaagggccgggggctccggcgggtcggggcaggggcttgatggcttccttctgccgtggctccagtgcccctggctggagttgacccttctgacaagtgtcctcagagagtcagggatcagtggcacctccctaacatcaaccccacgcagcgcaggcacaaaccccacatccagggccaactccaggaacagagacaccccaataccctgggggaccccaaccctgatgactcccgtcccatctctgtccctcacttggggcctgctgcggggcgagcacctgggagcaaactcaggattaggggacaccactgtgggcctgacctcgagcaggccacagacccttccctcctgccctggtgcagcacagactttggggtctgggcagggaggaacttctggcaggtcaccaagcacagagcccccaggctgaggtggccccagggggaaccccagcaggtggcccactacccttcctcccagctggaccccatgtcttccccaagataggggtgccatccaaggcaggtcctccatggagcccccttcaggctcctctccagaccccactgggcctcagtccccactctaggaatgcagccaccacgggcacaccaggcagcccaggcccagccaccctgcagtgcccaagcccacaccctggaggagagcagggtgcgtctgggaggggctgggctccccacccccacccccacctgcacaccccacccacccttgcccgggccccctgcaggagggtcagagcccccatgggatatggacttagggtctcactcacgcacctcccctcctgggagaaggggtctcatgcccagatccccccagcagcgctggtcacaggtagaggcagtggccccagggccaccctgacctggcccctcaggctcctctagccctggctgccctgctgtccctgggaggcctgggctccaccagaccacaggtctagggcaccgcccacactggggccgcccacacacagctcacaggaagaagataagctccagacccccaggcccgggacctgccttgctgctacgacttcctgccccagacctcgttgccctcccccgtccacttacacacaggccaggaagctgttcccacacagaccaaccccagacggggaccacctggcactcaggtcactgccatttccttctccattcacttccaatgcctctgtgcttcctccctcctccttccttcgggggagcaccctgtgcagctcctccctgcagtccacaccctggggagacccgaccctgcagcccacaccctggggagacctgaccctcctccagccctttctcccccgctgctcttgccacccaccaagacagccctggggtcctgtccctacagcccccacccagttctctacctagacccgtcttcctccctctaaacacctctcccaggccaaccctacacctgcaggccctcccctccactgccaaagaccctcagtttctcctgcctgtgcccacccccgtgctcctcctgcccacagctcgagctcttcctctcctagggcccctgagggatggcattgaccgtgccctcgcacccacacactgcccatgccctcacattcctcctggccactccagccccactcccctctcaggcctggctctggtatttctgggacaaagccttacccaagtctttcccatgcaggcctgggcccttaccctcactgcccggttacagggcagcctcctgtgcacagaagcagggagctcagcccttccacaggcagaaggcactgaaagaaatcggcctccagcgccttgacacacgtctgcctgtgtctctcactgcccgcacctgcagggaggctcggcactccctctaaagacgagggatccaggcagcagcatcacaggagaatgcagggctaccagacatcccagtcctctcacaggcctctcctgggaagagacctgaagacgcccagtcaacggagtctaacaccaaacctccctggaggccgatgggtagtaacggagtcattgccagacctggaggcaggggagcagtgagcccgagcccacaccatagggccagaggacagccactgacatcccaagccactcactggtggtcccacaacaccccatggaaagaggacagacccacagtcccacctggaccagggcagagactgctgagacccagcaccagaaccaaccaagaaacaccaggcaacagcatcagagggggctctggcagaacagaggaggggaggtctccttcaccagcaggcgcttcccttgaccgaagacaggatccatgcaactcccccaggacaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctatacccacagtgacacagccccattcccaaagccctactgcaaacgcattccacttctggggctgaggggctgggggagcgtctgggaaatagggctcaggggtgtccatcaatgcccaaaacgcaccagactcccctccatacatcacacccaccagccagcgagcagagtaaacagaaaatgagaagcaagctggggaagcttgcacaggccccaaggaaagagctttggcgggtgtgtaagaggggatgcgggcagagcctgagcagggccttttgctgtttctgctttcctgtgcagagagttccataaactggtgttcgagatcaatggctgggagtgagcccaggaggacagcgtgggaagagcacagggaaggaggagcagccgctatcctacactgtcatctttcgaaagtttgccttgtgcccacactgctgcatcatgggatgcttaacagctgatgtagacacagctaaagagagaatcagtgagatggatttgcagcacagatctgaataaattctccagaatgtggagcagcacagaagcaagcacacagaaagtgcctgatgcaaggacaaagttcagtgggcaccttcaggcattgctgctgggcacagacactctgaaaagccctggcaggaactccctgtgacaaagcagaaccctcaggcaatgccagccccagagccctccctgagagcctcatgggcaaagatgtgcacaacaggtgtttctcatagccccaaactgagagcaaagcaaacgtccatctgaaggagaacaggcaaataaacgatggcaggttcatgaaatgcaaacccagacagccacaagcacaaaagtacagggttataagcgactctggttgagttcatgacaatgctgagtaattggagtaacaaagtaaactccaaaaaatactttcaatgtgatttcttctaaataaaatttacaccctgcaaaatgaactgtcttcttaagggatacatttcccagttagaaaaccataaagaaaaccaagaaaaggatgatcacataaacacagtggtggttacttctgctggggaaggaagagggtatgaactgagatacacagggtgggcaagtctcctaacaagaacagaacgaatacattacagtaccttgaaaacagcagttaaacttctaaattgcaagaagaggaaaatggacacagttgtgtttagaaaattctcagtccagcactgttcataatagcaaagacattaacccaggtcggataaataagcgatgacacaggcaattgcacaatgatacagacatatatttagtatatgagacatcgatgatgtatccccaaataaacgactttaaagagataaagggctgatgtgtggtggcattcacctccctgggatccccggacaggttgcaggctcactgtgcagcagggcaggcgggtacctgctggcagttcctggggcctgatgtggagcaagcgcagggccatatatcccggaggacggcacagtcagtgaattccagagagaagcaactcagccacactccccaggcagagcccgagagggacgcccacgcacagggaggcagagcccagcacctccgcagccagcaccacctgtgcacgggccaccaccttgcaggcacagagtgggtgctgagaggaggggcagggacaccaggcagggtgagcacccagagaaaactgcagacgcctcacacatccacctcagcctcccctgacctggacctcactggcctgggcctcacttaacctgggcttcacctgaccttggcctcacctgacttggacctcgcctgtcccaagctttacctgacctgggcctcaactcacctgaacgtctcctgacctgggtttaacctgtcctggaactcacctggccttggcttcccctgacctggacctcatctggcctgggcttcacctggcctgggcctcacctgacctggacctcatctggcctggacctcacctggcctggacttcacctggcctgggcttcacctgacctggacctcacctggcctcgggcctcacctgcacctgctccaggtcttgctggagcctgagtagcactgagggtgcagaagctcatccagggttggggaatgactctagaagtctcccacatctgacctttctgggtggaggcagctggtggccctgggaatataaaaatctccagaatgatgactctgtgatttgtgggcaacttatgaacccgaaaggacatggccatggggtgggtagggacatagggacagatgccagcctgaggtggagcctcaggacacaggtgggcacggacactatccacataagcgagggatagacccgagtgtccccacagcagacctgagagcgctgggcccacagcctcccctcagagccctgctgcctcctccggtcagccctggacatcccaggtttccccaggcctgccggtaggtttagaatgaggtctgtgtcactgtggtattacgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattataaccacagtgtcacagagtccatcaaaaacccatccctgggagcctcccgccacagccctccctgcaggggaccggtacgtgccatgttaggattttgatcgaggagacagcaccatgggtatggtggctaccacagcagtgcagcctgtgacccaaacccgcagggcagcaggcacgatggacaggcccgtgactgaccacgctgggctccagcctgccagccctggagatcatgaaacagatggccaaggtcaccctacaggtcatccagatctggctccgaggggtctgcatcgctgctgccctcccaacgccagtccaaatgggacagggacggcctcacagcaccatctgctgccatcaggccagcgatcccagaagcccctccctcaaggctgggccacatgtgtggacactgagagccctcatgtctgagtaggggcaccaggagggaggggctggccctgtgcactgtccctgcccctgtggtccctggcctgcctggccctgacacctgagcctctcctgggtcatttccaagacagaagacattcctggggacagccggagctgggcgtcgctcatcctgcccggccgtcctgagtcctgctcatttccagacctcaccggggaagccaacagaggactcgcctcccacattcagagacaaagaaccttccagaaatccctgcctctctccccagtggacaccctcttccaggacagtcctcagtggcatcacagcggcctgagatccccaggacgcagcaccgctgtcaataggggccccaaatgcctggaccagggcctgcgtgggaaaggtctctggccacactcgggctttttgtgaagggccctcctgctgtgtgactacagtaactaccatagtgatgaacccagtggcaaaaactggctggaaacccaggggctgtgtgcacgcctcagcttggagctctccaggagcacaagagccgggcccaaggatttgtgcccagaccctcagcctctagggacacctgggccatctcagcctgggctggtgccctgcacaccatcttcctccaaataggggcttcagagggctctgaggtgacctcactcatgaccacaggtgacctggcccttccctgccagctataccagaccctgtcttgacagatgccccgattccaacagccaattcctgggaccctgaatagctgtagacaccagcctcattccagtacctcctgccaattgcctggattcccatcctggctggaatcaagaaggcagcatccgccaggctcccaacaggcaggactcccgcacaccctcctctgagaggccgctgtgttccgcagggccaggccctggacagttcccctcacctgccactagagaaacacctgccattgtcgtccccacctggaaaagaccactcgtggagcccccagccccaggtacagctgtagagagagtcctcgaggcccctaagaaggagccatgcccagttctgccgggaccctcggccaggccgacaggagtggacgctggagctgggcccacactgggccacataggagctcaccagtgagggcaggagagcacatgccggggagcacccagcctcctgctgaccagaggcctgccccagagcccaggaggctgcagaggcctctccagggagacactgtgcatgtctggtacctaagcagccccccacgtccccagtcctgggggcccctggctcagctgtctggaccctccctgttccctgggaagctcctcctgacagccccgcctccagttccaggtgtggttattgtcaggcgatgtcagactgtggtggatatagtggctacgattaccacagtggtgccgcccatagcagcaaccaggccaagtagacaggcccctgctgcgcagccccaggcatccacttcacctgcttctcctggggctctcaaggctgctgtctgtcctctggccctctgtggggagggttccctcagtgggaggtctgtgctccagggcagggatgattgagatagaaatcaaaggctggcagggaaaggcagcttcccgccctgagaggtgcaggcagcaccacggagccacggagtcacagagccacggagcccccattgtgggcatttgagagtgctgtgcccccggcaggcccagccctgatggggaagcctgtcccatcccacagcccgggtcccacgggcagcgggcacagaagctgccaggttgtcctctatgatcctcatccctccagcagcatcccctccacagtggggaaactgaggcttggagcaccacccggccccctggaaatgaggctgtgagcccagacagtgggcccagagcactgtgagtaccccggcagtacctggctgcagggatcagccagagatgccaaaccctgagtgaccagcctacaggaggatccggccccacccaggccactcgattaatgctcaaccccctgccctggagacctcttccagtaccaccagcagctcagcttctcagggcctcatccctgcaaggaaggtcaagggctgggcctgccagaaacacagcaccctccctagccctggctaagacagggtgggcagacggctgtggacgggacatattgctggggcatttctcactgtcacttctgggtggtagctctgacaaaaacgcagaccctgccaaaatccccactgcctcccgctaggggctggcctggaatcctgctgtcctaggaggctgctgacctccaggatggctccgtccccagttccagggcgagagcagatcccaggcaggctgtaggctgggaggccacccctgcccttgccggggttgaatgcaggtgcccaaggcaggaaatggcatgagcacagggatgaccgggacatgccccaccagagtgcgccccttcctgctctgcaccctgcaccccccaggccagcccacgacgtccaacaactgggcctgggtggcagccccacccagacaggacagacccagcaccctgaggaggtcctgccagggggagctaagagccatgaaggagcaagatatggggcccccgatacaggcacagatgtcagctccatccaggaccacccagcccacaccctgagaggaacgtctgtctccagcctctgcaggtcgggaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagctggtaccacagtgacactcacccagccagaaaccccattccaagtcagcggaagcagagagagcagggaggacacgtttaggatctgagactgcacctgacacccaggccagcagacgtctcccctccagggcaccccaccctgtcctgcatttctgcaagatcaggggcggcctgagggggggtctagggtgaggagatgggtcccctgtacaccaaggaggagttaggcaggtcccgagcactctccccattgaggctgacctgcccagagagtcctgggcccaccccacacaccggggcggaatgtgtgcaggcctcggtctctgtgggtgttccgctagctggggctcacagtgctcaccccacacctaaaatgagccacagcctccggagcccccgcaggagaccccgcccacaagcccagcccccacccaggaggccccagagctcagggcgccccgtcggattccgaacagccccgagtcacagcgggtataaccggaaccaccactgtcagaatagctacgtcaaaaactgtccagtggccactgccggaggccccgccagagagggcagcagccactctgatcccatgtcctgccggctcccatgacccccagcacgcggagccccacagtgtccccactggatgggaggacaagagctggggattccggcgggtcggggcaggggcttgatcgcatccttctgccgtggctccagtgcccctggctggagttgacccttctgacaagtgtcctcagagagacaggcatcaccggcgcctcccaacatcaaccccaggcagcacaggcacaaaccccacatccagagccaactccaggagcagagacaccccaataccctgggggaccccgaccctgatgacttcccactggaattcgccgtagagtccaccaggaccaaagaccctgcctctgcctctgtccctcactcaggacctgctgccgggcgaggccttgggagcagacttgggcttaggggacaccagtgtgaccccgaccttgaccaggacgcagacctttccttcctttcctggggcagcacagactttggggtctgggccaggaggaacttctggcaggtcgccaagcacagaggccacaggctgaggtggccctggaaagacctccaggaggtggccactccccttcctcccagctggaccccatgtcctccccaagataagggtgccatccaaggcaggtgctccttggagccccattcagactcctccctggaccccactgggcctcagtcccagctctggggatgaagccaccacaagcacaccaggcagcccaggcccagccaccctgcagtgcccaagcacacactctggagcagagcagggtgcctctgggaggggctgagctccccaccccacccccacctgcacaccccacccacccctgcccagcggctctgcaggagggtcagagccccacatggggtatggacttagggtctcactcacgtggctcccatcatgagtgaaggggcctcaagcccaggttcccacagcagcgcctgtcgcaagtggaggcagaggcccgagggccaccctgacctggtccctgaggttcctgcagcccaggctgccctgctgtccctgggaggcctgggctccaccagaccacaggtccagggcaccgggtgcaggagccacccacacacagctcacaggaagaagataagctccagacccccagggccagaacctgccttcctgctactgcttcctgccccagacctgggcgccctcccccgtccacttacacacaggccaggaagctgttcccacacagaacaaccccaaaccaggaccgcctggcactcaggtggctgccatttccttctccatttgctcccagcgcctctgtcctccctggttcctccttcgggggaacagcctgtgcagccagtccctgcagcccacaccctggggagacccaaccctgcctggggcccttccaaccctgctgctcttactgcccacccagaaaactctggggtcctgtccctgcagtccctaccctggtctccacccagacccctgtgtatcactccagacacccctcccaggccaaccctgcacctgcaggccctgtcctcttctgtcgctagagcctcagtttctcccccctgtgcccacaccctacctcctcctgcccacaactctaactcttcttctcctggagcccctgagccatggcattgaccctgccctcccaccacccacagcccatgccctcaccttcctcctggccactccgaccccgccccctctcaggccaagccctggtatttccaggacaaaggctcacccaagtctttcccaggcaggcctgggctcttgccctcacttcccggttacacgggagcctcctgtgcacagaagcagggagctcagcccttccacaggcagaaggcactgaaagaaatcggcctccagcaccttgacacacgtccgcccgtgtctctcactgcccgcacctgcagggaggctccgcactccctctaaagacaagggatccaggcagcagcatcacgggagaatgcagggctcccagacatcccagtcctctcacaggcctctcctgggaagagacctgcagccaccaccaaacagccacagaggctgctggatagtaactgagtcaatgaccgacctggagggcaggggagcagtgagccggagcccataccatagggacagagaccagccgctgacatcccgagctcctcaatggtggccccataacacacctaggaaacataacacacccacagccccacctggaacagggcagagactgctgagcccccagcaccagccccaagaaacaccaggcaacagtatcagagggggctcccgagaaagagaggaggggagatctccttcaccatcaaatgcttcccttgaccaaaaacagggtccacgcaactcccccaggacaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgctactcccacagtgacacagacccattcccaaagccctactgcaaacacacccactcctggggctgaggggctgggggagcgtctgggaagtagggtccaggggtgtctatcaatgtccaaaatgcaccagactccccgccaaacaccaccccaccagccagcgagcagggtaaacagaaaatgagaggctctgggaagcttgcacaggccccaaggaaagagctttggcaggtgtgcaagaggggatgcaggcagagcctgagcagggccttttgctgtttctgctttcctgtgcagagagttccataaactggtgttcaagatcagtggctgggaatgagcccaggagggcagtctgtgggaagagcacagggaaggaggagcagccgctatcctacactgtcatctttcaaaagtttgccttgtgaccacactattgcatcatgggatgcttaagagctgatgtagacacagctaaagagagaatcagtgagatgaatttgcagcatagatctgaataaactctccagaatgtggagcagtacagaagcaaacacacagaaagtgcctgatgcaaggacaaagttcagtgggcaccttcaggcattgctgctgggcacagacactctgaaaagccctggcaggatctccctgcgacaaagcagaaccctcaggcaatgccagccccagagccctccctgagagcgtcatggggaaagatgtgcagaacagctgattatcatagactcaaactgagaacagagcaaacgtccatctgaagaacagtcaaataagcaatggtaggttcatgcaatgcaaacccagacagccaggggacaacagtagagggctacaggcggctttgcggttgagttcatgacaatgctgagtaattggagtaacagaggaaagcccaaaaaatacttttaatgtgatttcttctaaataaaatttacaccaggcaaaatgaactgtcttcttaagggataaactttcccctggaaaaactacaaggaaaattaagaaaacgatgatcacataaacacagttgtggttacttctactggggaaggaagagggtatgagctgagacacacagagtcggcaagtctccaagcaagcacagaacgaatacattacagtaccttgaatacagcagttaaacttctaaatcgcaagaagaggaaaatgcacacagctgtgtttagaaaattctcagtccagcactattcataatagcaaagacattaacccaggttggataaataaatgatgacacaggcaattgcacaatgatacagacatacatttagtacatgagacatcgatgatgtatccccaaagaaatgactttaaagagaaaaggcctgatgtgtggtggcactcacctccctgggatccccggacaggttgcaggcacactgtgtggcagggcaggctggtacatgctggcagctcctggggcctgatgtggagcaagcgcagggctgtatacccccaaggatggcacagtcagtgaattccagagagaagcagctcagccacactgcccaggcagagcccgagagggacgcccacgcacagggaggcagagcccagctcctccacagccaccaccacctgtgcacgggccaccaccttgcaggcacagagtgggtgctgagaggaggggcagggacaccaggcagggtgagcacccagagaaaactgcagaagcctcacacatccacctcagcctcccctgacctggacctcacctggtctggacctcacctggcctgggcctcacctgacctggacctcacctggcctgggcttcacctgacctggacctcacctggcctccggcctcacctgcacctgctccaggtcttgctggaacctgagtagcactgaggctgcagaagctcatccagggttggggaatgactctggaactctcccacatctgacctttctgggtggaggcatctggtggccctgggaatataaaaagccccagaatggtgcctgcgtgatttgggggcaatttatgaacccgaaaggacatggccatggggtgggtagggacatagggacagatgccagcctgaggtggagcctcaggacacagttggacgcggacactatccacataagcgagggacagacccgagtgttcctgcagtagacctgagagcgctgggcccacagcctcccctcggtgccctgctgcctcctcaggtcagccctggacatcccgggtttccccaggcctggcggtaggtttgaagtgaggtctgtgtcactgtggtattatgattacgtttgggggagttatcgttatacccacagcatcacacggtccatcagaaacccatgccacagccctccccgcaggggaccgccgcgtgccatgttacaattttgatcgaggacacagcgccatgggtatggtggctaccacagcagtgcagcccatgacccaaacacacagggcagcaggcacaatggacaggcctgtgagtgaccatgctgggctccagcccgccagccccggagaccatgaaacagatggccaaggtcaccccacagttcagccagacatggctccgtggggtctgcatcgctgctgccctctaacaccagcccagatggggacaaggccaaccccacattaccatctcctgctgtccacccagtggtcccagaagcccctccctcatggctgagccacatgtgtgaaccctgagagcaccccatgtcagagtaggggcagcagaagggcggggctggccctgtgcactgtccctgcacccatggtccctcgcctgcctggccctgacacctgagcctcttctgagtcatttctaagatagaagacattcccggggacagccggagctgggcgtcgctcatcctgcccggccgtcctgagtcctgcttgtttccagacctcaccagggaagccaacagaggactcacctcacacagtcagagacaaagaaccttccagaaatccctgtctcactccccagtgggcaccttcttccaggacattcctcggtcgcatcacagcaggcacccacatctggatcaggacggcccccagaacacaagatggcccatggggacagccccacaacccaggccttcccagacccctaaaaggcgtcccaccccctgcacctgccccagggctaaaaatccaggaggcttgactcccgcataccctccagccagacatcacctcagccccctcctggaggggacaggagcccgggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgactaccacagtgatgaaactagcagcaaaaactggccggacacccagggaccatgcacacttctcagcttggagctctccaggaccagaagagtcaggtctgagggtttgtagccagaccctcggcctctagggacaccctggccatcacagcggatgggctggtgccccacatgccatctgctccaaacaggggcttcagagggctctgaggtgacttcactcatgaccacaggtgccctggccccttccccgccagctacaccgaaccctgtcccaacagctgccccagttccaacagccaattcctggggcccagaattgctgtagacaccagcctcgttccagcacctcctgccaattgcctggattcacatcctggctggaatcaagagggcagcatccgccaggctcccaacaggcaggactcccgcacaccctcctctgagaggccgctgtgttccgcagggccaggccctggacagttcccctcacctgccactagagaaacacctgccattgtcgtccccacctggaaaagaccactcgtggagcccccagccccaggtacagctgtagagagactccccgagggatctaagaaggagccatgcgcagttctgccgggaccctcggccaggccgacaggagtggacactggagctgggcccacactgggccacataggagctcaccagtgagggcaggagagcacatgccggggagcacccagcctcctgctgaccagaggcctgccccagagcccaggaggctgcagaggcctctccagggggacactgtgcatgtctggtccctgagcagccccccatgtccccagtcctgggggcccctggcacagctgtctggaccctccctgttccctgggaagctcctcctgacagccccgcctccagttccaggtgtggttattgtcagggggtgtcagactgtggtggatacagctatggttaccacagtggtgctgcccatagcagcaaccaggccaagtagacaggcccctgctgtgcagccccaggcctccagctcacctgcttctcctggggctctcaaggtcactgttgtctgtactctgccctctgtggggagggttctctcagtgggaggtctgttctcaacatcccagggcctcatgtctgcacggaaggccaatggatgggcaacctcacatgccgcggctaagatagggtgggcagcctggcgggggacagtacatactgctggggtgtctgtcactgtgcctagtggggcactggctcccaaacaacgcagtcctcaccaaaatccccacagcctcccctgctaggggctggcctgatctcctgcagtcctaggaggctgctgacctccagaatgtctccgtccccagttccagggcgagagcagatcccaggccggctgcagactgggaggccaccccctccttcccagggttcactggaggtgaccaaggtaggaaatggccttaacacagggatgactgcgccatcccccaacagagtcagccccctcctgctctgtaccccgcaccccccaggccagtccacgaaaaccagggccccacatcagagtcactgcctggcccggccctggggcggacccctcagcccccaccctgtctagaggacttggggggacaggacacaggccctctccttatggttcccccacctgcctccggccgggacccttggggtgtggacagaaaggacacctgcctaattggcccccaggaacacagaacttctctccagggaccccagcccgagcacccccttacccaggacccagccctgcccctcctcccctctgctctcctctcatcaccccatgggaatccggtatccccaggaagccatcaggaagggctgaaggaggaagcggggccgtgcaccaccgggcagcaggctccgtcttcgtgaacccagggaagtgccagcctcctagagggtatggtccaccctgcctggggctcccaccgtggcaggctgcggggaaggaccagggacggtgtgggggagggctcagggccctgcgggtgctcctccatcttcggtgagcctcccccttcacccaccgtcccgcccacctcctctccaccctggctgcacgtcttccacaccatcctgagtcctacctacaccagagccagcaaagccagtgcagacaaaggctggggtgcaggggggctgccagggcagcttcggggagggaaggatggagggaggggaggtcagtgaagaggcccccttcccctgggtccaggatcctcctctgggacccccggctcccatcccctcctggctctgggaggagaagcaggatgggagaatctgtgcgggaccctctcacagtggaatatccccacagcggctcaggccagacccaaaagcccctcagtgagccctccactgcagtcctgggcctgggtagcagcccctcccacagaggacagacccagcaccccgaagaagtcctgccagggggagctcagagccatgaaagagcaggatatggggtccccgatacaggcacagacctcagctccatccaggcccaccgggacccaccatgggaggaacacctgtctccgggttgtgaggtggctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctggtaccacagtgacactcgccaggccagaaaccccgtcccaagtcagcggaagcagagagagcagggaggacacgtttaggatctgaggccgcacctgacacccagggcagcagacgtctcccctccagggcaccctccaccgtcctgcgtttcttcaagaataggggcggcctgagggggtccagggccaggcgataggtcccctctaccccaaggaggagccaggcaggacccgagcaccgtccccattgaggctgacctgcccagacgggcctgggcccaccccacacaccggggcggaatgtgtgcaggccccagtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggaacgaccaccgtgagaaaaactgtgtccaaaactgactcctggcagcagtcggaggccccgccagagaggggagcagccgccctgaacccatgtcctgccggttcccatgacccccagcacccagagccccacggtgtccccgttggataatgaggacaagggctgggggctccggtggtttgcggcagggacttgatcacatccttctgctgtggccccattgcctctggctggagttgacccttctgacaagtgtcctcagaaagacagggatcaccggcacctcccaatatcaaccccaggcagcacagacacaaaccccacatccagagccaactccaggagcagagacaccccaacactctgggggaccccaaccgtgataactccccactggaatccgccccagagtctaccaggaccaaaggccctgccctgtctctgtccctcactcagggcctcctgcagggcgagcgcttgggagcagactcggtcttaggggacaccactgtgggccccaactttgatgaggccactgacccttccttcctttcctggggcagcacagactttggggtctgggcagggaagaactactggctggtggccaatcacagagcccccaggccgaggtggccccaagaaggccctcaggaggtggccactccacttcctcccagctggaccccaggtcctccccaagataggggtgccatccaaggcaggtcctccatggagcccccttcagactcctcccgggaccccactggacctcagtccctgctctgggaatgcagccaccacaagcacaccaggaagcccaggcccagccaccctgcagtgggcaagcccacactctggagcagagcagggtgcgtctgggaggggctaacctccccaccccccaccccccatctgcacacagccacctaccactgcccagaccctctgcaggagggccaagccaccatggggtatggacttagggtctcactcacgtgcctcccctcctgggagaaggggcctcatgccgagatccctgcagcactagacacagctggaggcagtggccccagggccaccctgacctggcatctaaggctgctccagcccagacagcactgccgttcctgggaagcctgggctccaccagaccacaggtccagggcacagcccacaggagccacccacacacagctcacaggaagaagataagctccagaccccagggcgggacctgccttcctgccaccacttacacacaggccagggagctgttcccacacagatcaaccccaaaccgggactgcctggcactagggtcactgccatttccctctccattccctcccagtgcctctgtgctccctccttctggggaacaccctgtgcagcccctccctgcagcccacacgctggggagaccccaccctgcctcgggccttttctacctgctgcacttgccgcccacccaaacaaccctgggtacgtgaccctgcagtcctcaccctgatctgcaaccagacccctgtccctccctctaaacacccctcccaggccaactctgcacctgcaggccctccgctcttctgccacaagagcctcaggttttcctacctgtgcccaccccctaacccctcctgcccacaacttgagttcttcctctcctggagcccttgagccatggcactgaccctacactcccacccacacactgcccatgccatcaccttcctcctggacactctgaccacgctcccctccctctcagacccggccctggtatttccaggacaaaggctcacccaagtcttccccatgcaggcccttgccctcactgcctggttacacgggagcctcctgtgcgcagaagcagggagctcagctcttccacaggcagaaggcactgaaagaaatcggcctccagtgccttgacacacgtccgcctgtgtctctcactgcctgcacctgcagggaggctccgcactccctctaaagatgagggatccaggcagcaacatcacgggagaatgcagggctcccagacagcccagccctctcgcaggcctctcctgggaagagacctgcagccaccactgaacagccacggaggtcgctggatagtaaccgagtcagtgaccgacctggagggcaggggagcagtgaaccggagcccagaccatagggacagagaccagccgctaacatcccgagcccctcactggcggccccagaacaccccgtggaaacagaacagacccacagtcccacctggaacagggcagacactgctgagcccccagcaccagccccaagaaacactaggcaacagcatcagagggggctcctgagaaagagaggaggggaggtctccttcaccatcaaatgcttcccttgaccaaaaacagggtccacgcaactcccccaggacaaaggaggagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctattcccacagtgacacaaccccattcctaaagccctactgcaaacgcacccactcctggggctgaggggctgggggagcatctgggaagtatggcctaggggtgtccatcaatgcccaaaatgcaccagactctccccaagacatcaccccaccagccagtgagcagagtaaacagaaaatgagaagcagctgggaagcttgcacaggccccaaggaaagagctttggcaggtgtgcaagaggggatgtgggcagagcctgagcagggccttttgctgtttctgctttcctgtgcagagagttccataaactggtattcaggatcaatggctgggagtgagcccaggaggacagtgtgggaagagcacagggaaggaggagcagccgctatcctacactgtcatcttttgaaagtttgccctgtgcccacaatgctgcatcatgggatgcttaacagctgatgtagacacagctaaagagagaatcagtgaaatgcatttgcagcacagatctgaataaatcctccagaatgtggagcagcacagaagcaagcacacagaaagtgcctgatgccaaggcaaagttcagtgggcaccttcaggcattgctgctgggcacagacactctgaaaagcactggcaggaactgcctgtgacaaagcagaaccctcaggcaatgccagccctagagcccttcctgagaacctcatgggcaaagatgtgcagaacagctgtttgtcatagccccaaactatggggctggacaaagcaaacgtccatctgaaggacaacagacaaataaacgatggcaggttcatgaaatgcaaactaggacagccagaggacaacagtagagagctacaggcggctttgcggttgagttcatgacaatgctgagtaattggagtaacagaggaaagcccaaaaaatacttttaatgtgatttcttctaaataaaatttacacccggcaaaatgaactatcttcttaagggataaactttcccctggaaaaactataaggaaaatcaagaaaacgatgatcacataaacacagtggtggttacttctactggggaaggaagagggtatgagctgagacacacagagtcggcaagtctcctaacaagaacagaacaaatacattacagtaccttgaaaacagcagttaaacttctaaatcgcaagaagaggaaaatgcacacacctgtgtttagaaaattctcagtccagcactgttcataatagcaaagacattaacccaggttggataaataagcgatgacacaggcaattgcacaatgatacagacatacattcagtatatgagacatcgatgatgtatccccaaagaaatgactttaaagagaaaaggcctgatgtgtggtggcaatcacctccctgggcatccccggacaggctgcaggctcactgtgtggcagggcaggcaggcacctgctggcagctcctggggcctgatgtggagcaggcacagagctgtatatccccaaggaaggtacagtcagtgcattccagagagaagcaactcagccacactccctggccagaacccaagatgcacacccatgcacagggaggcagagcccagcacctccgcagccaccaccacctgcgcacgggccaccaccttgcaggcacagagtgggtgctgagaggaggggcagggacaccaggcagggtgagcacccagagaaaactgcagaagcctcacacatccacctcagcctcccctgacctggacctcacctggcctgggcctcacctgacctggacctcacctggcctgggcttcacctggcctgggcttcacctgacctggacctcacctggcctcgggcctcacctggcctgggcttcacctggcctgggcttcacctgacctggacctcacctggcctgggcctcacctgacctggacctcacctggcctgggcttcacctggcctgggcttcacctggcctgggcttcacctgacctggacctcacctggcctgggcttcacctgacctggacctcacctggcctcgggcctcacctgcacctgctccaggtcttgctggagcctgagtagcactgaggctgtagggactcatccagggttggggaatgactctgcaactctcccacatctgacctttctgggtggaggcacctggtggcccagggaatataaaaagccccagaatgatgcctgtgtgatttgggggcaatttatgaacccgaaaggacatggccatggggtgggtagggacagtagggacagatgtcagcctgaggtgaagcctcaggacacaggtgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattactaccacagtgtcacagagtccatcaaaaactcatgcctgggagcctcccaccacagccctccctgcgggggaccgctgcatgccgtgttaggattttgatcgaggacacggcgccatgggtatggtggctaccacagcagtgcagcccatgacccaaacacacggggcagcagaaacaatggacaggcccacaagtgaccatgatgggctccagcccaccagccccagagaccatgaaacagatggccaaggtcaccctacaggtcatccagatctggctccaaggggtctgcatcgctgctgccctcccaacgccaaaccagatggagacagggccggccccatagcaccatctgctgccgtccacccagcagtcccggaagcccctccctgaacgctgggccacgtgtgtgaaccctgcgagccccccatgtcagagtaggggcagcaggagggcggggctggccctgtgcactgtcactgcccctgtggtccctggcctgcctggccctgacacctgagcctctcctgggtcatttccaagacattcccagggacagccggagctgggagtcgctcatcctgcctggctgtcctgagtcctgctcatttccagacctcaccagggaagccaacagaggactcacctcacacagtcagagacaacgaaccttccagaaatccctgtttctctccccagtgagagaaaccctcttccagggtttctcttctctcccaccctcttccaggacagtcctcagcagcatcacagcgggaacgcacatctggatcaggacggcccccagaacacgcgatggcccatggggacagcccagcccttcccagacccctaaaaggtatccccaccttgcacctgccccagggctcaaactccaggaggcctgactcctgcacaccctcctgccagatatcacctcagccccctcctggaggggacaggagcccgggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaactcccacagtgatgaaaccagcagcaaaaactgactggactcgcagggtttatgcacacttctcggctcggagctctccaggagcacaagagccaggcccgagggtttctgcccagaccctcggcctctagggacacccgggccatcttagccgatgggctggtgccctgcacaccgtgtgctgccaaacaggggcttcagagggctctgaggtgacttcactcatgaccacaggtgccctggtcccttcactgccagctgcaccagaccctgttccgagagatgccccagttccaaaagccaattcctggggccgggaattactgtagacaccagcctcattccagtacctcctgccaattgcctggattcccatcctggctggaatcaagagggcagcatccgccaggctcccaacaggcaggactcccacacaccctcctctgagaggccgctgtgttccgcagggccaggccgcagacagttcccctcacctgcccatgtagaaacacctgccattgtcgtccccacctggcaaagaccacttgtggagcccccagccccaggtacagctgtagagagagtcctcgaggcccctaagaaggagccatgcccagttctgccgggaccctcggccaggccgacaggagtggacgctggagctgggcccacactgggccacataggagctcaccagtgagggcaggagagcacatgccggggagcacccagcctcctgctgaccagagacccgtcccagagcccaggaggctgcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacaattaccacagtggtgccgcccatagcagcaaccaggccaagtagacagacccctgccacgcagccccaggcctccagctcacctgcttctcctggggctctcaaggctgctgtctgccctctggccctctgtggggagggttccctcagtgggaggtctgtgctccagggcagggatgactgagatagaaatcaaaggctggcagggaaaggcagcttcccgccctgagaggtgcaggcagcaccacagagccatggagtcacagagccacggagcccccagtgtgggcgtgtgagggtgctgggctcccggcaggcccagccctgatggggaagcctgccccgtcccacagcccaggtccccaggggcagcaggcacagaagctgccaagctgtgctctacgatcctcatccctccagcagcatccactccacagtggggaaactgagccttggagaaccacccagccccctggaaacaaggcggggagcccagacagtgggcccagagcactgtgtgtatcctggcactaggtgcagggaccacccggagatccccatcactgagtggccagcctgcagaaggacccaaccccaaccaggccgcttgattaagctccatccccctgtcctgggaacctcttcccagcgccaccaacagctcggcttcccaggccctcatccctccaaggaaggccaaaggctgggcctgccaggggcacagtaccctctcttgccctggctaagacagggtgggcagacggctgcagataggacatattgctggggcatcttgctctgtgactactgggtactggctctcaacgcagaccctaccaaaatccccactgcctcccctgctaggggctggcctggtctcctcctgctgtcctaggaggctgctgacctccaggatggcttctgtccccagttctagggccagagcagatcccaggcaggctgtaggctgggaggccacccctgtccttgccgaggttcagtgcaggcacccaggacaggaaatggcctgaacacagggatgactgtgccatgccctacctaagtccgcccctttctactctgcaacccccactccccaggtcagcccatgacgaccaacaacccaacaccagagtcactgcctggccctgccctggggaggacccctcagcccccaccctgtctagaggagttggggggacaggacacaggccctctccttatggttcccccacctggctcctgccgggacccttggggtgtggacagaaaggacgcctgcctaattgtcccccaggaacccagaacttctctccagggaccccagcccgagcacccccttacccaggacccagccctgcccctcctcccctctgctctcctctcatcactccatgggaatccagaatccccaggaagccatcaggaagggctgaaggaggaagcggggccactgcaccaccgggcaggaggctccgtcttcgtgaacccagggaagtgccagcctcctagagggtatggtccaccctgcctggggctcccaccgtggcaggctgcggggaaggaccagggacggtgtgggggagggctcagggccctgcaggtgctccatcttggatgagcccatccctctcatccaccgacccgcccacctcctctccaccctggccacacgtcgtccacaccatcctgagtcccacctacaccagagccggcagagccagtgcagacagaggctggggtgcaggggggccgccagggcagctttggggagggaggaatggaggaaggggaggtcagtgaagaggcccccctcccctgggtctaggatccacctttgggacccccggatcccatcccctccaggctctgggaggagaagcaggatgggagaatctgtgcgggaccctctcacagtggaatacctccacagcggctcaggccagatacaaaagcccctcagtgagccctccactgcagtgctgggcctgggggcagcccctcccacagaggacagacccagcaccccgaagaagtcctgccagggggagctcagagccatgaaggagcaagatatggggaccccaatactggcacagacctcagctccatccaggcccaccaggacccaccatgggtggaacacctgtctccggcccctgctggctgtgaggcagctggcctctgtctcggacccccattccagacaccagacagagggacaggccccccagaaccagtgttgagggacacccctgtccagggcagccaagtccaagaggcgcgctgagcccagcaatggaaggcccccaaacaaaccaggaggtttctgaagctgtctgtgtcacagtcgggtatagcagcggctaccacaatgacactgggcaggacagaaaccccatcccaagtcagccgaaggcagagagagcaggcaggacacatttaggatctgaggccacacctgacactcaagccaacagatgtctcccctccagggcgccctgccctgttcagtgttcctgagaaaacaggggcagcctgaggggatccagggccaggagatgggtcccctctaccccgaggaggagccaggcgggaatcccagccccctccccattgaggccatcctgcccagaggggcccggacccaccccacacacccaggcagaatgtgtgcaggcttcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctactaccactgtgagaaaagctatgtccaaaactgtctcccggccactgctggaggcccagccagagaagggaccagccgcccgaacatacgaccttcccagccctcatgacccccagcacttggagctccacagtgtccccattggatggtgaggatgggggccggggccatctgcacctcccaacatcacccccaggcagcacaggcacaaaccccaaatccagagccgacaccaggaacacagacaccccaataccctgggggaccctggccctggtgacttcccactgggatccacccccgtgtccacctggatcaaagaccccaccgctgtctctgtccctcactcagggcctgctgaggggcgggtgctttggagcagactcaggtttaggggccaccattgtggggcccaacctcgaccaggacacagatttttctttcctgccctggggcaacacagactttggggtctgtgcagggaggaccttctggaaagtcaccaagcacagagccctgactgaggtggtctcaggaagacccccaggagggggcttgtgccccttcctctcatgtggaccccatgccccccaagataggggcatcatgcagggcaggtcctccatgcagccaccactaggcaactccctggcgccggtccccactgcgcctccatcccggctctggggatgcagccaccatggccacaccaggcagcccgggtccagcaaccctgcagtgcccaagcccttggcaggattcccagaggctggagcccacccctcctcatccccccacacctgcacacacacacctaccccctgcccagtccccctccaggagggttggagccgcccatagggtgggggctccaggtctcactcactcgcttcccttcctgggcaaaggagcctcgtgccccggtcccccctgacggcgctgggcacaggtgtgggtactgggccccagggctcctccagccccagctgccctgctctccctgggaggcctgggcaccaccagaccaccagtccagggcacagccccagggagccgcccactgccagctcacaggaagaagataagcttcagaccctcagggccgggagctgccttcctgccaccccttcctgccccagacctccatgccctcccccaaccacttacacacaagccagggagctgtttccacacagttcaaccccaaaccaggacggcctggcactcgggtcactgccatttctgtctgcattcgctcccagcgcccctgtgttccctccctcctccctccttcctttcttcctgcattgggttcatgccgcagagtgccaggtgcaggtcagccctgagcttggggtcacctcctcactgaaggcagcctcagggtgcccaggggcaggcagggtgggggtgaggcttccagctccaaccgctccactagccgagactaaggaagtgagaggcagccagaaatccagaccattccatagcaaatggatttcattaaagttaccagacttcagtgtaagtaacatgagccccatgcacaacaatcccttatgaaggggaagtcagtgtcgcctcggatttcttgaaaaacacaaaaacttatcaatgcctgtaaaagtctgttggaaagaaaatatgattcaagaatgttatgcccaacaaagctggcatattttctacccggacacactcagggaatgtggtcgcttgagtgcttctctcactgcgtaaatcctacgtggtgtttaagcatattcataaatgtgtatgtctatttttatgtgtaagatggttcatttttattttatttattcaatatgtacaataaagaatattgacaaataggctggacatggtggctcccacctgtaatcccagccctttgggaggccgaggcgggcagatcacctgaggtctggagttcgagaccagcctggccaacatgatgaaaacccatctctactaaaaatacaaagattagccaggcatggtggtgcatgcctgtaatcccagccactcaggaggctgagacaggagaaatgcgtgaacccggaaggcggaggttgcagtgagccgagatcacaccactgcactccagcctggcgacagagcaagattccatctcaaaaaaaaaagacaaagaaatttgtttttttgaataaagacaaatttcatcacacgaagataaagatgcaaagctccagacaggaaggcacggacagcacagtgaagcctggagcgggcgctggggggccaggggcatggcgggggtgccagcgtctctcagtgcctaccatggccactccagcctgtgttctcacgaggatggctgtgcaatgctaggagcgtgttcgaagctctagggcaaccactggaagtgaggctgaggagcagagcccagaggcccgtggagctgatgaaaagaaagctggagaaagtgtttgctgcctcccaacatggtaagaaaagatagaaagagagagcacacggcaaagggagcttgctgagggactctttacaatggcttgcacagagctcagggggtctgggaggctagggccctgcgcagggcagtcaccccagcctgctgaccaaggtttgctgcaggcagctctgggggtggttgaggcgcggtccctggagccacccctcaagggaacgaggcagcagagtgggccaaggcccaggtcggctgcaaggctgcccaggacttggggtccttacatcagcagccactgatgcagctggcccagagagaggcgccgagcaggttgcctccaggggacaaaccaggtcggagagggtgaggcagtggatggagccacaacaaccccgggcacgggtgacacgcacgttcatgcacatctgacccttcctccctcaccaaacaggtccccctgccttccccatggttgcgaaaaagcaaaatgtagacgttttttcttttttaattcatgttttaattgacaaatgaagccgtatatatttattgtgtacaacatgatgctttaaaatatgtatacatcgtggaacagcaacgtcgagctaatttaacacgcattacttcacatacttgtcatcttttgtggcgagaatgcttaaaatccactctcttagtattttttaagaatgcaatacattgttgtcaactgtggtcaccgtcatgcatagccaagctcccgacctcaccctcctgccagctcaggctgtgcatcctttcaccagcatcccccaccccggcccctggccctggtaactaccactctatactctacgtatgagttcagctttttaagattccacagatgaatgagatcatacagtatttgctttctatgcctggcttattttagttaacacactgtcctccagatccatccgttgttgcaaatgacagggtttcattctttttaaagtctaaagagtattccattgtgtcaatggacctcatttgctttatccatgcatcaactatggacatttaggttgattccatttcttagctgttgtggatggtgctgcagtaaacatggggctgcagatgtctcttcaacatactgacatcatgtcctttggataaatacccagtagtgggatcgctggatcacaatgtacagttttttttttaatggaaactttcattttttggtgaaattaggaaaacagataaaacccacagaatccaaaatatatgtgaagatgccaaaaacagttgacattgggcagaggtcacatggaaggaagtgaatacatgacggggtgtgagggcccagaggcagctgaaatacgctttctaaacacaaggacctcttctgagagggcagaagttttatcctgcacatgcaatgaccagcacagctaaaatacactttctaaacatgaggacctcttctgagagggcagctttatcctgcaaatgcaatgaccagcacaggacccagaataaagagagttgccagcggacgcctggtgtccatgtgtccaggtgagttcgagatgcggacggcgctggccagccagtcacaccctaagtcaatctgctgcatgcatttgtccttgccacagcagaaaacgagaaagcctttgggctgcaaagcttcacaggctcctcttctcccgactccatggaaacagctacaaagagcaggcccagtagagcttaattcatgaaaatgagtaataaacttgaactggaacagtatcgactttttagaaacggcagcaaagtgtataaaaaatattcaccagaacaatatttccaaacgatgagatgagaatttcagccaagtaatcctccatggatagaaaataatgaagggattggatttatgaaggaaaatcatggagctcaaatacaagagaagagaatcaaaaatgaacaggaggagataaaatatggtttggccaaagttacaaaataaattttttaaaaacccttcatcatggcaagtagaaagagcgagaggaaaaacagatcccgtggaagacacaaataggacatggggagaaaaatgaatgagatgaaacagagcagaaataaaattttacggaactaaagacaagtgatctgaacctgcctggggcctgggggacctcgccaccctgaagggaaagaacatgcctggctggctttgccacctgctcattgcagagccccacagcttgcaacaaacataggcggtagccagggagtggttacagcaggccttgagcaagacccagtgttgtgctgacttcaggtctgacccagcactgtcatagtggtggtgtccatagtggtagtgggggtgcttgtgtcactccacccccatctccaggaggctcagaacagacagagagagactccatttgtttgggagaaagtaagggatgagaacaagagtctctgcctggtaatccagagaattattctagatcttggccaagattatcaaagcagtacctctatgagtcttttgggcttggagtccccctaaagcagatatagctaagatcacaacacccaagtccttttgaatatgtgggaagacttcccaaggacaggagcaaacaaacaagcccagactgcaaaaaaacaagcccagactgcaataaacacctcactcttcaatgcccaggcactgaagaacatctcctagcagcaacaccatccaggaaaacatggcctcaaccagtgaactaaataaggcaccagggaccagtctcggagaaatagaggtatgttatctttcagagaattcaaagtagctttgttgaggaaactcaaagaaattcaagataacacagtgaaggaattcagaatcctatccgataaatttaacagagattgaagcaattaaaaagaattaagcagaaattatggagctgaaaaatgcaattggcatactgaaaaatgcatcagagtattttcatagcctcatatatcaagtagaagaaagaattagtgagcttgaaaacaggctatttggaaaagcacgataaaaggagacaaaagagaaaagaataaataacaatgaagcatatctacaggatctagaaaatagcctcaaaaggccaaatctaagaattattagccttaaagaggaggtagagaaagagggatggagagtttattcaaagggataataacagaaaacttcccaaacctagagaaagatatcaatatccaaatgcaagaaggatgtagtacaccaaggagatttaatgcaaagaagactacctcaaggcattcaatactcaaactcccatatgacaaggactttaaaaagatcctaaaagcagcaaaagaaaagaaatgaataaaatactatggagctccaatatgtctggcagcagacttttcagtgaagactttatatgccaggagagagtgtcataatggatttaaagtgctgaaggaaaaaacttttaccctcgaacagtatagctggtgaaattatccttcaaacatgaaggagaaataatttgtttccagacaaatgttgagggatttcatgaacaccagacctgtcttttaagaaatgctaaagggagtacttcaatcagaaagaaacacgttagtgaacaataagaaatcatctgaaggcacaaaactcaccggtaatagtaagtacacagaaaaacacagaatattataacactgtaactgtggtgtgtaaactccttttgtttgtttgtttgtttgtttgtttgtttgtttttgtttttagacggagttttgctccagcccaggctggagtgcaatggcacaatctcagctcactgcaacttccacctcctgggttcaagcaattctcctgcctcagcctcccaagtagctgggattacaggcatgtgctaccatgtccagctaattttgtattttagtagagacggtgtttcaccatgttggtcaggctagccttatcttgagtagaaaaactaaatgatgaagcaatgaaaaataataactacaacttttcaagacatagtacaataagatataaatcataacaaaaagttaaaaggtggagggatgaagttaaggcatagagtctttattagttttctttttacttgtctgtttatgcaaacagtgttaagttgtcatcagtttaaaataatgggtcataagatactatttgcaagcctcatggtaacgtcaaaccaaaagcaatacaacagatacacaaaaaacaaaaagcaagaagctaaattacgtcatcagagaaaatcaccttcactaaaaggaagacggagaaaagaatgaagagagagaagaccaaaagcaaatagcaatatggcaggagtaagtccttacttatcaataataccattgaatgtaaatggactaaactctccaatcaaaagacatagagtggctgaatcaattaaagaaaaaacaagacccattgatctgttgtccacaagaaacacactttatctataaagacacacatagactgaaaacaaagggatggaaaaagatactccacgccaatggaaaccaaagaaagagcaggagtagctacacttatatcaggcaaaatagatttcaagacaaaaactataagaagagacaaggtcactaatgataaacaggtcaattcagcaagaggatataacaattgtaaatatatatgcacccaatgctggagcacccagatatataaagcaagtatttactagagctaaagagagaaatagactccaatgcaataatagctggagatttcaacatcccactttcaacattgaacagatcctccagatagaaaatcaacaaagaaatattggacttaatctgcactatcgaccaaatggatctaacagatatttacagaacatttcatccaacagctgcagaacacacattcttttcctcagcacatagatcattctcaaggatagaccatatgttgggtcacaaaacaagttttaaaatattcaaatacattgaaataatatcaagcatcttctgtgaccacaatggactaaaactagaaatcaataacaagaggaattttggaaactatataaatatatggaaattaatgaatgctgagtgggtcaatgaagcaattaagaaggaaactgaaatttttcttggaacgaatgatcatggaaacagaaaataccaaaacctatgggatacagcaaaagcagtactaagagggaagtttacagctacaaatgcttacattaaaaaagaagaaaaacttcaataaaaaaacctaacaatgcatcttaaagaactagaaaagcaagaggaaatcaaatccaaaattagtagaagaaaacagtaaaggtcagagcagaaataagtaaaattgaaatgaagaaaacaatacaaaagatcaataaaacaacaggttgttttcttgaaaagttaaacaaaattgacaaacctttagccagactaagaaaaaaagacagaagatccaaataaataaaatcagagatgaaaaaggtgacattacaacttacaccacagaaattcaaaggatcattagtggctactataagcaactatatgccaataaattggaaaatctagaagaaatgcagaaattcctagacacatacaacctcccaagattaaaccaagaagaaattcaaaacctgaacagactgataacaagtaatgagatcaaagccgtaataaaaagcctcccagtaaagagaagcccaggacccgacggcttcactgctgaattctaccaaacatttaaagtagaactaataccaatcctactcaaactattccaaaaaatagaggtggaaggaatacttcaaaactcattatacgaggccagtattaacctgacaccaaaactagacaaagacacatgaaaaaaagaaaactacaggccaatatgtctgatgaatattgacacaaaaatcctcaacaaaatactagcaaaccaaattcaactacacattagaaagttcactcatcatgaccaagtggaatttatctaacttgggatgcaaagatggttcaacatatgcaaatcaatcaatgtgatacatcatatcaacagaatgaacaacaaaaaccatttgatcatttaattgatactgaaaaagcatttgataaaattcaacattccttcataataaaaattctcttctatactaggtacaaaagaaacttacctcaacataataaagccatatatgacagtcccacagtatgatactaaatgaggaaaaactgagagcctttcctctacgatctggaacatgacaaagatgcccactttcatcactgttattcaacatagtactggaagtcctagctggagcgatcagacaagagaaagatataaaaggcatccaaattggaaaggaataagtcaaattatcctcatttgcatatggtatgatcttctatttagagctaactaaagactccaccaaaaaaagttattagaactgacgaacaaattcagtaaagctgcaggatacaaaatcaacatacaaaaatcagtagcatttctatatgccaacaatgaccaatgtgaaaaagaaattaaaaagtaaccctatttacaataaccacaaataaacacctaggaattaaccaaagaggtaaaagatttctgtaatgaaaactataaaacactgatgaaagaaattgaagagtacaccaaaaaatggaaagcaattgcatgttcatggattagaagaatcagtgttgttataatgtccatactatccaaagcaatctacagattcaatgcaatccttatcaaaataccaatgacatcattcacagaaatagaaaaaaaaaatcctaaaatttacgtggaaccacaaagacccagaatagccaaagctctcctaagcaaaaagaacgaaactgtaggaatgacattgcctgtcttcaaattctactacagagctatagatagtaaccaaaacagcgtggtactagcataaaaacagacacagagacaaacagaacaaaatttaaaaacccagaaataaatccacacacctacagcaaattcatttttgacaaagttgccaagaacatactctggggaatagataatgatatctcttcaataaataatgtggggaaaactggatatccatatacataacagtgaaactagacccctctctctctcactatatacaaaaatcaaatcaaaattgtttaaggacttaaatctaagacctcatactatgaaaccactgcaagacaaccttggcggaaactctccaagacatcagtccaggcaaagatttcttgagtaatatcccacaagcacagacaaccaaagcaaaaatggacaaatgggatcacatcaagttaaaaagcttctgcacagtaagggaaacaaccaacaaaatgaagagacaacccacagaatgggagaaaatatttgaaaaatacccatctggcaagggattaaaaaccagaatatatgcagaatatataaggagctcaaacagtgctatagaaaaaaaaatctaataatctgatttaaaaatgggaaaaatgttagaatagacatttcttaaaataagacatacagatggcaaaccgacatggaacggtgctcaacatcatggattatcacagaaacacaatcaatcaaaactaaaactaaaatgtgctatcatctcaccccagttaaaatggctgatatccagaagacaggcaataacaaatgctggcaaggatgtggggaaaagggagcccccatacactgttgctgggattgtaaattagtacaaccactgtggagagcagcatgaaagttcctcaaaaaactgaaagaaagctaccataggatccagcaatcccactgctgtgtatatactacaaaagaaaggaagtcagtatatgaagaggtatctgcactcccatgtttgttgcagccctgttcacaacagccaagatttggaagcaacctaagtgtccatcagcagttgaatgtataaagaaaatgtggtgcatatacacaatggagtattattcaataataaaaaggaatgagattgagtcatttgcaacaacatggatggaactggagatcattatgtgaagtgaaataagccaggcacagaaagacaaacattacaatgttcttacttattaatgagatctaaaaatcaaaacaattgcacccatgttcataaagagtaaaaggatggttaccagatgctgagaacggtggtggggggatagggaaaggtggcagtggttaacgggtacaaaaaaatagaaagaatgaataagacttactacttgatagcacagcaaggtggctatagtcagtaatttagttgtatatttttaataatgaaaggtgtataattggattgtttctaacacaaaggataatgcttaagaggatggataccccattttccatgatgtgattatttcacattgcacgcctagatcaaaacatccaatgtaccccataaatatatacatcttctatgtacccataaaaattctgtaaaataaaatatataaaaagaggtgacagatatggaagacaggcaaagaagagacgacatccacataatccgagtacctaagaaagaatggagtccagtgcatctcaggagccaccattctaagccaattttctctggttctctcagtcaccctaccaatacgtgggcaatcttgttttatttcaggatagagtttttgaaattatagatttaagtatgctttctgttctattacttttggtaattaattttagaaagaactaatttgggcacaaatttgaaaaaattctaaatccaaaaaaaaaaagaaaaaaacacacacacaatcatctataagggggatgatgaccagtcctagatttctcaccagccacattcaagatcagtaaatggtaggacaaaacctgtagggtccttaagggggaaagaagtagtggatagtccagagtctatatacagccaactgttcttgaagaaaaaaggctgctgaaaaggagttccaaacattctataatccataatctcatgatgaaactactagaggaagaccaccagccatcaaaaggtgcttggagaacccagggccaagaaccaaaagtaaatattaagtgtccttaactgcgagactaagatagaaatgactgtgggggaccatgtggcctcaacagaggtgaaatggtgtctgcctgacaaagtggacattttacaatgatcaaaacacagaatatgagatagagagcacttctgaattactgcctcactccaaataactctcagccaaaggacttcagtaaaaccaaattgggcatattagacagtacaaacaaattctaagaaaataatattactgattacaatcacatgatgctagagatggaggggaaaaggaagaggaaaccaggtaatttcatactcgtatatagtaaagaactaaagtacattgtccaaagaagaacaaagaatattttggaaagttataaaggtagccactacacatagaagatagcaaagaacaagaaaacttaagatggaaaactttttggaagcataaaaatagaaaatataaactactaagataagattgaagccaaacagatctatgaaaacaacaaacatcaatggccttaacttgcctattaaaaggaagagactttcaaattggaccacaagataaaacccaactctatatagcatatgagtattacacacaaaatgggaaaagctgaaaaaacttgggcaaaattcaccccaagcaaattccactgtttcctttgggacaaaatgccaagctccatgccagggaagatgattctcctcagaccttctcctcactctcccagtcctcttagggaaggaattgggtgttagaggagggagactctgtcgattatcagctgaagcagtggtgtgctcctgcgttgcttctgacctgggaaatgaagcagcaagactctttctgctgtgtctttgcccagaagggccatccccccagagcagagtacccaggccggcaggagcagtggtggaagcgtggaaaccacgtctcctacagcagagaccatcagaagcggagcctcgggtataagggaaacaacgcgttctccctaacctgggagtgacagacagcgtcattcctcacagtgataccctgtgttctagccatctggcccatgacagagccagcccagagccagcccagagccagcccctcaccaacctggagcctggccagctcgccaagctgcaccataggcctggaaggcgtggagacctgcggcagtgccctgtcctcccgtgaggcctgccatccctgccaggggtcgcctctggcttctccttctccaggaccgcacggtccagaggctcagtgcctggagtaggtgttgcccccctgcttctaggcccagaccctcccttgttcctgaccccgggcctttccctctggcttggacatccagggccctgtctcagctggggagctgctcctgctcaaggactgtcttccgcgggatcgaaaggccgcgtcctgaacaatgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagcgcgtgggccacgtgagcggagcaggctctaaaggccgcgtcctaaacagtgcgtgggccacgggagcggagcagactctaaaggccgcgtcctaaacagtgtgtgggccacgtgagcggagcgccctctccactgccctcggggccgcagctcccagctcagctcccagccctgctcagggcagccaggccaggaggtaccatccaggctaagtgaccctcaggggggacaggtgccccaggagatgccagctgttgggagaggctgggggaccaactcgacctggcctgtgggccctgccctggccacccattgtaggatccagccgccacgcctgtgacactcgtgtgctttccctggtgtgtgcttgtggcaggtgggggcagagggtcctcaggccagagagccactcccccagcgccagaccaccctcttcctcactcccccacctcaccccctcacaggtgcctcccaggccatcagggcccaaccacccctaaacaaatgggttctcggcccctcgtggctggaggtgggttctctcaccattcccagcctaagactccatccccatgctggcagctgttcaaccatgtctagagagatccactgtcccagacagcacctcagggtcccccgtcctgcctggaaccctgtaggaaactccacaaaccgccgccattctgtccacacccctacaggagccccaaccctctccccacatccaggcttccctcccagacccctcatccctgcccgcacggtgcctgagggggccttcttgggcagcgcctaagcaagcccccagcacccttcggccccttcaaggcacacaggccccctttccacccagcctcaggaaaccacctgtgtcctccaacgacaggtcccagcctcccagcctttgccttgcctgttcctctccctggaactctgccccgacacagaccctccccagcaagcccgcagggcacctcccctgcccccagacaccctgtgcccatcagttcatccccagcagaggccctcaccaggcacacccccatgctcacacctggccgcaggcctcagcctccctgagggccccacccagcccgcgtctggccagtggtgcgtgcaaagcccctcacccagactcggcggaaggcagccagtgcaggcctggggaggggctctccttagaccaccttgcaccttccctggcacccaccatgggaagagctgagactcactgaggaccagctgaggctcagagaagggacccagcactggtggacacgcagggagcccacgccagggcgccgtggtgagtgaggcccagtgccacccactgaggcctcccgttcagtgggacgacggtgaacaggtggaaccaaccaggcaacccccgccgggccccacagacgggatcagagcaggaaaggcttcctgcccctgcaggccagcgaggagccctggcgggggccgtggccctccaggcgaggaggctcccctggccaccgccacccgggcctctctgctgctgggaaaacaagtcagaaagcaagtggatgagaggtggcgtgacagacccagcttcagatctgctctaatttacaaaagaaaaggaaaaacacacttggcagccttcagcactctaatgattcttaacagcagcaaattattggcacaagactccagagtgactggcagggttgagggctggggtctcccacgtgttttggggctaacagcggaagggagagcactggcaaaggtgctgggggcccctggacccgacccgccctggagaccgcagccacatcagcccccagccccacaggccccctaccagccgcagggttttggctgagctgagaaccactgtgctaactggggacacagtgattggcagctctacaaaaaccatgctcccccgggaccccgggctgtgggtttctgtagcccctggctcagggctgactcaccgtggctgaatacttccagcactggggccagggcaccctggtcaccgtctcctcaggtgagtctgctgtctggggatagcggggagccaggtgtactgggccaggcaagggctttggcttcagacttggggacaggtgctcagcaaaggaggtcggcaggagggcggagggtgtgtttttgtatgggagaagcaggagggcagaggctgtgctactggtacttcgatctctggggccgtggcaccctggtcactgtctcctcaggtgagtcccactgcagccccctcccagtcttctctgtccaggcaccaggccaggtatctggggtctgcagccggcctgggtctggcctgaggccacaccagctgccatccctggggtctccgccatgggctgcatgccagagccctgctgtcacttagccctggggccagctggagcccccaaggacaggcagggaccccgctgggcttcagccccgtcagggaccctccacaggtagcaagcaggccgagggcagggacgggaaggagaagttgtgggcagagcctgggctggggctgggcgctggctgttcatgtgccggggaccaggcctgcgctttagtgtggctacaagtgcttggagcactggggccagggcagcccggccaccgtctccctgggaacgtcacccctccctgcctgggtctcagcccgggggtctgtgtggctggggacagggacgccggctgcctctgctctgtgcttgggccatgtgacccattcgagtgtcctgcacgggcacaggtttgtgtctgggcaggaacagggactgtgtccctgtgtgatgcttttgatatctggggccaagggacaatggtcaccgtctcttcaggtaagatggctttccttctgcctcctttctctgggcccagcgtcctctgtcctggagctgggagataatgtccgggggctccttggtctgcgctgggccatgtggggccctccggggctccttctccggctgtttgggaccacgttcagcagaaggcctttctttgggaactgggactctgctgctggggcaaagggtgggcagagtcatgcttgtgctggggacaaaatgaccttgggacacggggctggctgccacggccggcccgggacagtcggagagtcaggtttttgtgcaccccttaatggggcctcccacaatgtgactactttgactactggggccagggaaccctggtcaccgtctcctcaggtgagtcctcacaacctctctcctgctttaactctgaagggttttgctgcatttctggggggaaataagggtgctgggtctcctgccaagagagccccggagcatcctggggggctcaggaggatgccctgaggcaacagcggccacacagacgaggggcaagggctccagatgctccttcctcctgagcccagcagcacgggtctctctgtggccagggccaccctaggcctctggggtccaatgcccaacaacccccgggccctccccgggctcagtctgagagggtcccagggacgtagcggggcgccagttcttgcctggggtcctggcattgttgtcacaatgtgacaactggttcgacccctggggccagggaaccctggtcaccgtctcctcaggtgagtcctcaccaccccctctctgagtccacttagggagactcagcttgccagggtctcagggtcagagtcttggaggcattttggaggtcaggaaagaaagccggggagagggacccttcgaatgggaacccagcctgtcctccccaagtccggccacagatgtcggcagctggggggctccttcggctggtctggggtgacctctctccgcttcacctggagcattctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccacggacagtcagcttccatgtgacgcccggagacagaaggtctctgggtggctgggtttttgtggggtgaggatggacattctgccattgtgattactactactactactacatggacgtctggggcaaagggaccacggtcaccgtctcctcaggtaagaatggccactctagggcctttgttttctgctactgcctgtggggtttcctgagcattgcaggttggtcctcggggcatgttccgaggggacctgggcggactggccaggaggggacgggcactggggtgccttgaggatctgggagcctctgtggattttccgatgcctttggaaaatgggactcaggttgggtgcgtctgatggagtaactgagcctgggggcttggggagccacatttggacgagatgcctgaacaaaccaggggtcttagtgatggctgaggaatgtgtctcaggagcggtgtctgtaggactgcaagatcgctgcacagcagcgaatcgtgaaatattttctttagaattatgaggtgcgctgtgtgtcaacctgcatcttaaattctttattggctggaaagagaactgtcggagtgggtgaatccagccaggagggacgcgtagccccggtcttgatgagagcagggttgggggcaggggtagcccagaaacggtggctgccgtcctgacaggggcttagggaggctccaggacctcagtgccttgaagctggtttccaagagaaaaggattgtttatcttaggaggcatgcttactgttaaaagacaggatatgtttgaagtggcttctgagaaaaatggttaagaaaattatgacttaaaaatgtgagagattttcaagtatattaatttttttaactgtccaagtatttgaaattcttatcatttgattaacacccatgagtgatatgtgtctggaattgaggccaaagcaagctcagctaagaaatactagcacagtgctgtcggccccgatgcgggactgcgttttgaccatcataaatcaagtttatttttttaattaattgagcgaagctggaagcagatgatgaattagagtcaagatggctgcatgggggtctccggcacccacagcaggtggcaggaagcaggtcaccgcgagagtctattttaggaagcaaaaaaacacaattggtaaatttatcacttctggttgtgaagaggtggttttgcccaggcccagatctgaaagtgctctactgagcaaaacaacacctggacaatttgcgtttctaaaataaggcgaggctgaccgaaactgaaaaggctttttttaactatctgaatttcatttccaatcttagcttatcaactgctagtttgtgcaaacagcatatcaacttctaaactgcattcatttttaaagtaagatgtttaagaaattaaacagtcttagggagagtttatgactgtattcaaaaagttttttaaattagcttgttatcccttcatgtgataactaatctcaaatactttttcgatacctcagagcattattttcataatgactgtgttcacaatctttttaggttaactcgttttctctttgtgattaaggagaaacactttgatattctgatagagtggccttcattttagtatttttcaagaccacttttcaactactcactttaggataagttttaggtaaaatgtgcatcattatcctgaattatttcagttaagcatgttagttggtggcataagagaaaactcaatcagatagtgctgaagacaggactgtggagacaccttagaaggacagattctgttccgaatcaccgatgcggcgtcagcaggactggcctagcggaggctctgggagggtggctgccaggcccggcctgggctttgggtctccccggactacccagagctgggatgcgtggcttctgctgccgggccgactggctgctcaggccccagcccttgttaatggacttggaggaatgattccatgccaaagctttgcaaggctcgcagtgaccaggcgcccgacatggtaagagacaggcagccgccgctgctgcatttgcttctcttaaaactttgtatttgacgtcttatttccactagaaggggaactggtcttaattgcttgatgaagagcaggagactcatttatgtgagtcttttgagtgaccattgtctgggtcactcccatttaactttccctaaagcccatttgaaggagaggtcgcacgagctgctccacaacctctgaatggggatggcatgggtaatgatgcttgagaacataccaagccccactggcatcgcccttgtctaagtcattgactgtaggtcatcatcgcacccttgaaagtagcccatgccttccaaagcgatttatggtaaatggcagaattttaagtggcaaattcagataaaatgcatttcttggttgtttccaatgatgactgttatctagagggaatttaaaggcaggggtttactgcagactcagaagggaggggatgctccgggaaggtggaggctctgagcatctcaataccctcctcttggtgcagaagatatgctgccacttctagagcaaggggacctgctcatttttatcacagcacaggctcctaaattcttggtctcattctcaagatgttttaatgactttaaagcagcaaagaaatattccacccaggtagtggagggtggtaatgattggtaatgctttggaaccaaaacccaggtggcgctggggcaggactgcagggaactggggtatcaagtagagggagacaaaagatggaagccagcctggctgtgcaggaacctggcaatgagatggctttagctgagacaagcaggtctggtgggctgaccatttctggccatgacaactccatccagctttcagaaatggactcagatgggcaaaactgacctaagctgacctagactaaacaaggctgaactgggctgagctgagctgaactgggctgagttgaactgggttgagctgagctgagctgagctgggctaagttgcaccaggtgagctgagctgagctgggcttggctgcactaagctgggctgagctgggcagggctgggctgagctgagctgggctgggctgagctgggctgggctgggctgggctgagcgggtctgagcggggctgagctgagctaggctgggctgggctgagctgggctgagctgggctgagctgggctgagcaaggctaggctgagctgggctgagctgagctgggccgagcaaggctaggctgagctgagctgagctgggctgcgctgagctgggctgggctgcgctgagctgggctgggctgagctgggctaggctgggctgagctgggctgagctaggctgggctgggctgggctgagcggggctgagcggggctgagctgagctaggctgggctgagcggggctgagctgagctaggctgggctgggctgggctgagccaagctgaaccgggttgagcgtgctgtgctgggctgagccaagctaggctgagctgagccaagttgagcttagctgggctgagctaacctgggcaaggctgagctgggctgagctaacctggactggggctgagctaacctgggcagagctgagctgggctgagctaacctggactggggctgagctaacctgggcagagctgagctgggctgagctaacctgggctggggctgagctaacctgggctgggctcagctgagctgagctacgctgggctgggctgggctgagccgagctgaactgggctgagcaggctgtgtcgggctgagccaagctgggccgagctcagcagagctgagccgagctgagcttagctgggctgagctaaccagggctgggctgagctgggctgagctgagctgagctgaactgggctgaacgggctgaggcgagcagggccgagctgagcagagctaagccgaggctgggctgggctaacctgggctgggccgagctgagcagagctaagccgaggctgggctgggctaacctgggctgggctgagctgagctgggttgggcagggctgggctgggctgagctaagctgaactagggtgagctgggccgagccaggctggtttgggctgagttgagctgacctggactggggctgagctaacctgggctgggctcagctgagctgagctacgctgggctgggctgggctgagccgagctgaactgggctgagcaggttgtatcaggctaagccaagctgggccaagctcagcagagccaagccgagctgagcttagctgggctgagctaaccagggctgggctgagctgggctgagctgagctgagctgaactgggctgaacgggctgaggcgagcagggccgagctgagcagagctaagccgaggctgggctgggctaacctgggctgggctgagctgagctgggttgggcaaggctgggctgggttgagttgggctgagctaagctgagctagggtgagctgggctgagccaggctggattgggctgagttgagctgacctcaactgagctgacctaggctgagctgagctgagctgaagtaggctgtgctgggctgagctgggatgacctgggctgggctgagctgatttgggctgggttgagcagacctgggctgagccgggttgagctgagctgaaccaggatgagctgggctgagctgagctgggctgggtggtccaggctgggctgacctggaccaggctgggccaggttgagctgggctaagccgagctgagctgagctgagctgggatgatctgggctgggctgggctgggctgagctgacctgggctgggctgggctgagctgagctgagctgagttaagctgagctgagctgaactgggctgtgctgagctaggctgggctgggctgagctgggctgggctgggctgagccagattgtgcctggctgaactgagctgggctaagctgagctgggctgagctgggctgagctgagctgggctgagtggggcggggctgagctgagccggactgggctgggctgggctcagctgagctgagctgaactgggctgggctgaactgggctgggctgagctgagctgaactgggctgggctgaactgggctgggctgagctgagcttggatgagctgggctgaactgggctgggttgagctgggctgggctgagttgagccaggctgatctgggctgagccgagctgggttaagccgagctgggttgggctgggctgggttgggctgggctgagccggactgggttgggctgagctgagctggactgggctgagctgagctggtctgggctggctgagctgagctgtgttgagccaagctaggctgggctgggctgagctgggctgaactgggctgagcggagctgagctgagctgggctgggttgagcagagctgggggctgagctgggctgggctgggctgagttaagctgggctgacctgggctgagttaagctgggctgacctgggctgagctaagctgggttgagccgatccgggctgggctgggctgggctgagccaggctaggttgagctgggctgggctgggctctgctgtgctgtgctgaacagggctgagctgaactgagctgagctgggctgagctgggctctgctgtgctgtgctgagcagggctgagctgaactgagctgagctgggttgagctaagctaggctgggctgggctgagctgggatgagctgggctgggctgggctgggctctgctgtgctgtgctgaacagggctgagctgaactgagctgagctgggctgagctgggctctgctgtgctgtgctgagcagggctgagctgaactgggctgagctgggctgagctgggctgagttgagcagagctgggttgagcagagctgggctgggctgggctgagttgagccaggctgacctgggctgagccaagctgggttgagccaaactgggctgggctgggctgagccaggctggattgagctgggctgggctgggctaagctgagccgagcaaggttgagcgagctgggctgggttgggctgagctgagctgggctgggctgagctgggctgtgctgcactgagctgggctgagctgggttgaactgtgctgagctgagctgggctgtgctgaactatgcttagctgggctgggctatactgggcttagctgggctgggctaaactgggcttagctgggctgggctatactgggcttagctgggctgggctaaactgggcttagctgggctgggctatactgggcttagctgggctgggctgagctgagatggtcttaggtggtctgagctcagctaggctgggctgagctggtctgagctcatctgagttgggctgagctgagcttggctttgctgagctggggtggggtgggctgggctggattgagctggcctgggctgggatgaactggattgagctggcctgggctgggatgaactggaggacatggcactgggccaatcttcatgatcttgttggacatagatggatagcctcagctgagtctacactgcgttccccatcacacccaccctccctatactcactcccaggcctgggttgtctgcctggggagacttcagggtagctggagtgtgactgagctgggggcagcagaagctgggctggagggactctattggctgcctgcggggtgtgtggctccaggcttcacattcaggtatgcaacctgggccctccagctgcatgtgctgggagctgagtgtgtgcagcacctacgtgctgatgcctcgggggaaagcaggcctggtccacccaaacctgagccctcagccattctgagcagggagccaggggcagtcaggcctcagagtgcagcagggcagccagctgaatggtggcagggatggctcagcctgctccaggagaccccaggtctgtccaggtgttcagtgctgggccctgcagcaggatgggccgaggcctgcagccccagcagccttggacaaagacctgaggcctcaccacggccccgccacccctgatagccatgacagtctgggctttggaggcctgcaggtgggctcggccttggtggggcagccacagcgggacgcaagtagtgagggcactcagaacgccactcagccccgacaggcagggcacgaggaggcagctcctcaccctccctttctcttttgtcctgcgggtcctcagggagtgcatccgccccaacccttttccccctcgtctcctgtgagaattccccgtcggatacgagcagcgtggccgttggctgcctcgcacaggacttccttcccgactccatcactttctcctggaaatacaagaacaactctgacatcagcagcacccggggcttcccatcagtcctgagagggggcaagtacgcagccacctcacaggtgctgctgccttccaaggacgtcatgcagggcacagacgaacacgtggtgtgcaaagtccagcaccccaacggcaacaaagaaaagaacgtgcctcttccaggtgagggccgggcccagccaccgggacagagagggagccgaagggggcgggagtggcgggcaccgggctgacacgtgtccctcactgcagtgattgccgagctgcctcccaaagtgagcgtcttcgtcccaccccgcgacggcttcttcggcaacccccgcaagtccaagctcatctgccaggccacgggtttcagtccccggcagattcaggtgtcctggctgcgcgaggggaagcaggtggggtctggcgtcaccacggaccaggtgcaggctgaggccaaagagtctgggcccacgacctacaaggtgaccagcacactgaccatcaaagagagcgactggctcagccagagcatgttcacctgccgcgtggatcacaggggcctgaccttccagcagaatgcgtcctccatgtgtggccccggtgagtgacctgtccccaggggcagcacccaccgacacacaggggtccactcgggtctggcattcgccaccccggatgcagccatctactccctgagccttggcttcccagagcggccaagggcaggggctcgggcggcaggacccctgggctcggcagaggcagttgctactctttgggtgggaaccatgcctccgcccacatccacacctgccccacctctgactcccttctcttgactccagatcaagacacagccatccgggtcttcgccatccccccatcctttgccagcatcttcctcaccaagtccaccaagttgacctgcctggtcacagacctgaccacctatgacagcgtgaccatctcctggacccgccagaatggcgaagctgtgaaaacccacaccaacatctccgagagccaccccaatgccactttcagcgccgtgggtgaggccagcatctgcgaggatgactggaattccggggagaggttcacgtgcaccgtgacccacacagacctgccctcgccactgaagcagaccatctcccggcccaagggtaggccccactcttgcccctcttcctgcactccctgggacctcccttggcctctggggcatggtggaaagcacccctcactcccccgttgtctgggcaactggggaaaaggggactcaaccccagcccacaggctggtccccccactgccccgccctcaccaccatctctgttcacaggggtggccctgcacaggcccgatgtctacttgctgccaccagcccgggagcagctgaacctgcgggagtcggccaccatcacgtgcctggtgacgggcttctctcccgcggacgtcttcgtgcagtggatgcagagggggcagcccttgtccccggagaagtatgtgaccagcgccccaatgcctgagccccaggccccaggccggtacttcgcccacagcatcctgaccgtgtccgaagaggaatggaacacgggggagacctacacctgcgtggtggcccatgaggccctgcccaacagggtcaccgagaggaccgtggacaagtccaccggtaaacccaccctgtacaacgtgtccctggtcatgtccgacacagctggcacctgctactgaccctgctggcctgcccacaggctcggggcggctggccgctctgtgtgtgcatgcaaactaaccgtgtcaacggggtgagatgttgcatcttataaaattagaaataaaaagatccattcaaaagatactggtcctgagtgcacgatgctctggcctactggggtggcggctgtgctgcacccaccctgcgcctcccctgcagaacaccttcctccacagcccccacccctgcctcacccacctgcgtgcctcagtggcttctagaaacccctgaattccctgcagctgctcacagcaggctgacctcagacttgccattcctcctactgcttccagaaagaaagctgaaagcaaggccacacgtatacaggcagcacacaggcatgtgtggatacacatggacagacacggacacacacaaacacatggacacacagagacgtgctaacccatgggcacacacatacacagacatggacccacacacaaacatatgtggacacacatgtacaaacatgcacaggcacacaaagagaacactgactacaggcacacacacacacgggcacactacccacaggcacacaacagatggacacgcgtacacagacatgcacacacccacaggcacaacacgtgcgcatgccggccggcccccgcccacattctcccagggccctgccggatactctgtccctgcagcagtttgctccctgcgctgtgctggccccggggctttgggcccaggctctgcttgtccttctgtctctgcttggaggtgctgccatggcacccagcttgggctctgcctggggagcggaggccccagggatagcatgtgacccctgctgaggccaggctcctgatgaaggcagcagatagcccccacacccaccggtgagcagaaccagagcctgtgccatgtgctgagagcaggcagtgactaagcatatgggcccagagggcagagtggctgccctgggcagctgctcctcttagcaggaggcctcaggagatgagctagagcaagtctgcccctgcaaataccacctgctccccaacccacagcagggagcaggcgaggtcagacagcagcagcccgggaaggaccgagccccagcagggaaggcagggcccgagtgaggtctccacacccaacgcacagtgctgtctctaactggggccacctccgagtccccgccacactcttggccctttggagtcctgggctccaggtgtctcccaagggcccatctgtgcaggggatgcaaccccccgaatgtcctcatcccactgtggagctcaggtctctgtctgctccctgggtcctggcagggtaggacaagtccgccaggatgtccccatgcagactctgctccaagagggagctggagagtcagggccttggtgagggagtcaggatcgggttccccccagctcagtcctcccacctgccagcccccacagcacagggcagggccacaccccctgcttccccctccaggagagtcaggacatgctggccgctgctccgctggggccccgccctccagcccccaccttggtctgtgtgctgcatcccccacgctctctctgccaccccaggactctgaggaaaagacctcagagtcccagccctgcccagcctcggcctgtgcccccgctgcatcaggctttcaggggcccagcccatgccctgggcagtgcccgagcccccctgcacttgctctccccacccctgggtgcagcacagcctaggggccaagggtgggcctagaggatgggccccgggggggctttgctgggtgccaccccagcctgaccctattcccccgtgctgtgtctcctgcagagggggaggtgagcgccgacgaggagggctttgagaacctgtgggccaccgcctccaccttcatcgtcctcttcctcctgagcctcttctacagtaccaccgtcaccttgttcaaggtagcacggctgtggcacagggaggagggcgcagggcgaatgtggggcccagggagcagcctgggctggacgtctagcccggaggcccccacaccaccccactgggtcatctctgccccggctcccttcccgaccacagggaaagcatttcacactgtctctgttgcctgtaggtgaaatgatcccaacagaagaacatcggagaccagagagaggaactcaaaggggcgctgcctccgggtctggggtcctggcctgcgtggcctgttggcacgtgtttctcttccccgcccggcctccagttgtgtgctctcacacaggcttccttctcgaccggcaggggctggctggcttgcaggccacgaggtgggctctaccccacactgctttgctgtgtatacgcttgttgccctgaaataaatatgcacattttatccatgaaactgctttctggtgagggtttttgtttctttttcaaaactttcatgctacatgggcatctcaagggggaccccagttccaaagggagctgtggaaaagagcgctgggtcagccagcgcagggggttcgaggaaagccacgtgcccaggaaaggggccgcagaagcaggtgggccagactcagactcggggcatgcccagcctgatggaaggaaggggactgagcaggagagggttccaggcctggtcctccaagcacagcctgaattgggagactggggctcaggcctcgggggcctctgtgtgtgctccacatgcctacaactgcccgggtcaccttgccacccttcccagcaagcccagacagttcttggccttgccccaaaccttcatgatgtgtggtgcacgccaccgggatccaggaggtgcaggctgagccctcgagagcatgtgggcctcaccgggatccaggaggtgcaggctgagccctcgagagcatgtgggcctgtctgcacagtgtgggggccttgcactccacaggagcacaggggtggggtagcagtcgcgcccgtggcaggggagtggaagttggagcaaaagtttcaggtgaacgagtgtcttagtctaattgggcagctatcacaaaacactatcggctgcaaagcttgagcaacagacatttgcctcccacagcgctggaggctgaaagtctaagatcaaggcgccggcaacttcaacgtctggcgagggccaattcccagctcagagacgcgcctcctcactgcatcctcgcgcagccgaagatggtgaaggagctctcagggtctctgtcatacaggcactaagcccgtcacgagggtctctgtcatacaggcactaagcccgtcacgagggtctctctcatacaggcactaagcccgtcacgagggtctctctcatacaggcactaagcccgtcacgagggtctctctcatacaggcactaagcccgtcacgagggtctctctcatacaggcactaagcccgtcacgagggtctctctcatacaggcactaagcccgtcacgagggtctctctcatacaggcactaagcccgtcacgagggtctctctcatacaggcactaagcccgtcacgagggtctctctcatacaggcactaagcccatcacgaggtcctcatcattgcccagatgctagggctcccagtgccatccccttgtggatgaggatggggggcgtgaccatgtcgtccttagaagccgttagggaatgcatagtggggaggacaagtctctgccatcaccctgaagatgggcaggtggtggccaggcttggggcagtgccgaaaaatgactccccaggtaggtgggagcaggatcaaagagcaggggattttttcagagatggcagccaagccaaagttgggggctcatgccaggaggctcacttggccatggtgcagtcacccaggggtgacccacagtccgtggcaaagtcaaggacagcagtggctgtgagaccagggtggaggcaggtggctggggggagaggaccaggctggaaggactgggcagaccccaaggccatagaagtgtcctagaggaagcatccaggatggcgtcttgggagggctcataagctgggggcccagaaggaggccatttcaggttctgaggagcagcctggcacttgctctgagccagctgtcatgggtatctgggggctgctgggtacaagttgtgtccctcccactaaatgtgctctccacatggacccggcccgcccttctgtccctgctggatccctgagctggcaccagccctgccctcagagacaatgtccaggagacaggtggaggtgcacgtgtgggtccctggggaaatccatcctccaaccgtgggctccgagtcgcctcccagcctctcgctccagcttcaccccatgtagctcatcacaggctcaacctcccagcctgggggaggatggagtgaggagccccacactgcccagggcacacccagggggctggggagtctgcactgggctggggcagggaggcctcgtgcagcctgtggggctggcagctcaggacaacactcgtatccgttaactgtggccctggcaacactgcaccccagactgcgtggcttaaacaacagacgtttattccgtcctggttctggaggccgggcatctgggatggaggcctcggcggggctggctcctctgtgtcacgggagactctgttccaggctctctccctgctgctgggctttgccggccgtctctggtgctcttggcttatggaagcagcaccatcttcacagggcgttctccccacgtgctgtctgtgcccagattcccccttttcatgaggacagcagtcatattggatcagaggcttgccctactccagggtgacctcatctgaacttgattgcagctgcaaagactgtttccagacaaggtcacattctgtggtcctgggggttaggacttcgacacattaatttacaggggacacattttaacccatgacagtttgccctccgttccccccataatcatgtccttctcacatgcaaaatccctgcatcccatagcaacatctccagaacggctgaccccttccagcaccaactcttagtccacaatctcagcgaaatatcacctgcatcaagtgtgggagaaacccagggtgagattcattctgggtgaaattcctctccatctgtggacctttgtaacttgacaagaagttatctgcttccaaagtacaatgatggggcaggcataggatggacattcctattctaaaagggatacatagaaagggagagaggagccatgggtcccaagcaagcccaaacccagcagggaaagctgcattagatttaaggctcaaggctcatcctcctgggtccgtgctccatcttccaggcccactggggtgaccccatgctcttcgcccatggtggccagagcccccacagcctcctcatctttggctctgatctcaaagtcacccttccttcattttttctggtcttctttcccttccatccaattggcattgtttcttctgttttacaattcacaaaatccttgtcagcttcccatgaaattcatgggggtttgagtcatcagacaagagagccctgcacagttatatcctcaataaccttatctctactcctggtttctgctgagatggttgattggatccataagtcatgattccaatctctttaacaaatggttgcccagacacatccttggccttgtttccagagcatgctattggacaggctgagaattttccagctgttcaagttgtgggtcctgtttactgaacactttctctcactttttactataagcagtcaggagaaatcaggttgtgccttcaacacttttcttagaaatatcctcagctaaaatccaggttcatcacttgtaagtcctacttaccataaatagaatgcaattcagccaagtgctttgccactttctaacaaaggtcacctttcctccaattttcaataacatcttcctcatttctgtctggggcctcaccagaggcatctttaacattcacatttctagcaacattctgtttgtgacaatttatgtattctctaagatgacaggagttttctctatagctctcctctttctttctgagcccccaccaggatcaccttcaatgtccaaatttctaccatagtcttcaaggaaatctaggctttttctaacatgcacctgaaaactcttctcacctctacacattaccctatcccaaattcatttccacagttttaggtatcaattaaatcagataaataaatcattaccctgaattatttcagttaagcatgttagttggtggcataagagaaaactcagtcagatagtgctgaagacaggactgtggagacaccttagaaggacagattctgttcagaatcactgatgcggcgtcagcaggactggcctagtggaggctctgggagggtggctgccaggcccggcctgggctttgggtctccccggactacctggagctgggatgcgtggcttctgccgccgggccgactggctgctcaggccccagcccttgttaatggacttggaggaatgattccatgccaaagcttttgcaaggttcgcagtgaccaggcacccgacatggtaagagacaggcagccgccgctgctgcattcacttctcttaaaactttgtatttgatgtcttatttccactagaaggcgaattggtcttaattgcttctcttaagccaccacttctaaagccaaaatctgttttagtttcttatgagctattgtaacaaagtaccacaactgcatggctgaaacaacagaagtgtattctgtctcatttctggaggccaggtgtctgagatcaagctgtgggcagggttggctcccctgggttggcagggagaatctgttccaggtgtctgtcctggcttttgttggtttgctggaaagctttggtgttccttggcttttggaaacagctcctccgcctccatctttaccttcacatggcattctgcctgcgtgcatgtctgtgtctaaatttccactttgcataaggacaccagccatattgggtcagaggctcacctgcctccagcgtgacctcatcttaacttgattgcatctgcaaaactctgcttccaaagaagggcacattctgaggccctacgggtcagagcttcaacacgtccatttatttggagacacaactcaacccataacaagacccatccctagtgtctcaccagtggtgctgtagagggaggcctggcagggctgacatcccagaacctcagggaaaaatgaaaacagcccagaggggtccaagaggtggctcgaggaagggaattaggaacacactgttcaggtggaagattctgagatgggccgtgaatactgcctaggatgtggagggttgacaatgggttgacaatcctgctcagaaaatcccaggataaaggatgtaaatggggagaagaggagggtcatccagaatttgggaaagcagggcgacagtttctgccccaagggagaagggaaggaggatggggccaccgccacaccagatgaccttgcgtaccaggccaaagaacgggaacacctggccccacctgagcagcaatagtcagtgtggtggtgggcagacatgggtggaggcagggggtgagtagaaggttagactaagacggagcacctggggcctccagggacccaggcaagaaccctgcacttgctcagctgccctgggtacccaggtctccaggaaagtgaggctgagagccaagcccagcaggcagccacacattctgggacctgccaccctacagcctgctgtccatgagtaacaccccttacaaggggccaggtcagctcatgggtttatcccaggcagcagagcccctggggccaggaatcagggagaggagcatccaatcccaccagctcctctggagccactcagagggccagacgcatggccctccacagggaccccatggcccctgcagggcagctgaggacccgtggctgggagcctgggcaggagggtcatacagccctaggcccgttgctcccaggcttgagtgcccctcctcccctcaggggcccaagggaagtgggttccagagaggttgggggcagcagggaaggtggaggtcccaggaatgcccagaggggcaccaaagcctctggagggaagacccctcccttccaggagctctcggcaacaagagcccagggtccacaaagccacaggtcccactcggttattctgactcacaacacaggagcggcagcaggggcattcgtgttcacgggccacttggtcagccccgctcaccctgggcactcctcctgggccccttttccctgccttccctgtcaccctgctgccagggtcctctgccctgccctgccccttgtcctcagagcctccagcctcagactcccactgtgtctgtcttccagcacccaccaaggctccggatgtgttccccatcatatcagggtgcagacacccaaaggataacagccctgtggtcctggcatgcttgataactgggtaccacccaacgtccgtgactgtcacctggtacatggggacacagagccagccccagagaaccttccctgagatacaaagacgggacagctactacatgacaagcagccagctctccacccccctccagcagtggcgccaaggcgagtacaaatgcgtggtccagcacaccgccagcaagagtaagaaggagatcttccgctggccaggtaggtcgcaccggagatcacccagaagggccccccaggacccccagcaccttccactcagggcctgaccacaaagacagaagcaagggctgggctgtgaggcaacccccacctccccctcagagcacgttcctcccccttcaccctgtatccacccctccggaccctccccatctcagtccctccgctccctctctctgaggcccatctcccaatacccagatcactttccttccagacccttccctcagtgtgcacggaggcagcttgcccagcaaaggtgactgtctagtgggcttcccacagccaagctcccaccccatgctgcggcccttcccttcttcctgcttggctgcctgtgccccccacctgcctgtccacaacccagcctctggtacatccatgccctctgccctcagcctcacctgcacttttccttggatttcagagtctccaaaggcacaggcctcctcagtgcccactgcacaaccccaagcagagggcagcctcgccaaggcaaccacagccccagccaccacccgtaacacaggtgagaagccccttccctgcacactccacccccacccacctgctcattcctcagccgcctcctccaggcagcccttcataactccttgtctgagtctccaagtcacactttggtaaggagagggacactgaacggacctctaacaaacacctactgccagccagccccagtctgggggccagcagatgccaaacagccagcagactcccagagcagacctgggccggctccctggcccatggacccagctctgcctcgctgagctgaggcatgggctctcagcgcagcctcacatagagccaccctgccgaggcagtccggcttgcagactcacaggtcacttgggccgcagcagcccctccccgtgaccctcgcctcccgcccgccccagcctggctctctccaagtgttggatcttggtggccagcctgcttctcaccctcaccctgcctgccacctcagaatggcaggggaaagagggccctcaccaagaactttatctgaggagtctgaggcttgtgactctgacctgcctgagatgtccatgtggccggggggacgggttcagtgttcgggagaactcgggtacgtgcctgactttctctgagtagggcaggaagctgttaggagaagcagcagtgaggtgggctggaccaacaggcagaatgactgtccctcagccaccctctgggatgtgggtcaagctctgacaaaggcatggcacagccatggtggcccctgcttggatgagtggccacggtgccctcaccctgggccagaatctgcctccactctgcaggtgcagaaacacgacattcccgtctctaaacacacctagctcctaggcttggggtgggcctatcaaatgcagggagatggacacagcacaagggccagagcttcccatgagaaaggtgagggcagctgctccctgacccgggcatctgcacttgtccctctccaccctcctcatgggcagtggagactcagcaacaaaacaagttgagtgcattagcagccagctctggagccaagtcactcaccccacggccttggctgctggtggaggggccttcccctgggcagcctccaagaagacggccaagtgctcttactcagaccacggcgctgcttcctggcacctcgatttcccacaacaacatggggtgcagacaggctagggccccctgccctggggcctggacggcatccagttaaagatgacccttcacgggcggtgcctgaggtgtgctgacctcagcagctaagccctcaggtctggtctgcactgccccacctggaggacccaactgacccagacacagccagggttatggcatgaccccgtggacggtgacccacaggccagatgcagccaggggctgttttgtgtggcctagaaatgtctttacagttgtagtgggatggaggaggaagaggaagagaggaggggagagaaaagcagggaaggggaaaaagaggagttcaatgcaaccccaaaagccagaacagttttgagctgaaagaacaaggcaggaaacatcccagtacctgacttcaaaacatactataaagcagttgtaatcaaaacaggatcataaaaacagacacacagacccatggaacagaaaagcgagcccagaaataaatctacatgcttgcagtccattgattttcaacaaaggcaccaggaaaacacaatggggagaggacagtttcctcaataaatagtgctggggaaactggatatccatgtgcagactaatgaaactacacaaaaatcaattgaaaacagtctaggccaggcgcggtggctcatgccggtaatcccagcactttgggaggccgagacaggcggatcacctgaggtcaggagttcgagaccagcttggccaacatggcgaaacccggtctccactaaaaatacaaaaattagcacatggtggcctacgtctgttatcccagcttttcaggaggctgaggcaggagaatcgcttgaatccgggaggtgaaggttgcagggagccaagattgcgccactgcattccagcctgggcaatggagcgagactgtctcaaaaaaaaaaaaaaaaagaaaagaaaacagtctaaaggtttaactgaacagataaagctactagaagaaaacatagggggaaaactccatgacattagtctgagcaacgatttttggatatgatcccaaaagctcaggcagcactagtcacaaaagccaagatacagaaccaacctaagcacccctcagcagatgcacaggtaaagaaaatgtggtacgtatggggcacaatggaatacgattcagcctttaaaaacagtgaaattctgtcattggcaacaatgtagatgaacctgaaggacacttatgctaagtgaaataagccaggcacagaaggagcaatactgcatgattgcacttacatctggcaggttaaaaaggcaaactcttagaggcagacagtagagaggtggtgccagggagcgggcactggtggctggggagatgttggtcaaagggcacaaaactgcagttgggaggaattagttcaggacatcccttgtacatggggacagtggttagtaacaacggattgtatccttgaaaaccgctaagaaaatagtttttaagtgttcttgacacaaaaagtgacacgtatgtgagatactgcatggtcattagctggatttagccattccacaatgtacacatatttcaaacattgtgttgtatatgataaacatgtataatttttgtcaattaaaaatttttaggaagaggaggagaagagaagaagaaggagaaggagaaagaggaacaagaagagagagagacaaagacaccaggttttttctgacccctgggctatcaaaacacctattgcccaataactagttggccgttggtgccctaaactattgaagcgattgctgttatgtggatgggccccggacacttagaaactcgtgacccctgaggacccccacgaggacagtcagggtccccccgaactcagggagcactgaggaaggagctcttagaggcgtggggcccctcaggcccctcagagggctctgccacatgggtcaggggcaggctgagggggagtcccaggctccatgcccagcctctgtgcctctgaccagggtgtcccccacaccgcctcctccccagtgccctccactggccacacctggccagaagctggggagaggagagcacagtggttaagtcagtccctgcagggagacggcaccagaaaaacctggcctgtggatgagtcccggcctggcagccacagagcagagagctctagaagcaacgaaggcccgagtctgctcagggaagagcgggcagcagccccagggccggacagtgaccaagagtggcaccgcccatggctcaacgggtctttgcccacagatcccccagcccctggagacagggtctgtgtgcctggccgtgcaggcaggcaccacactcagggggaggccactgtggagctctgtgcagagccccgggcgggagcctactgctcccgaaggtccggccacagctgctctcgtttgctctcccctgcagagtgtccgagccacacccagcctcttggcgtctacctgctaacccctgcagtgcaggacctgtggctccgggacaaagccaccttcacctgcttcgtggtgggcagtgacctgaaggatgctcacctgacctgggaggtggccgggaaggtccccacagggggcgtggaggaagggctgctggagcggcacagcaacggctcccagagccagcacagccgtctgaccctgcccaggtccttgtggaacgcggggacctccgtcacctgcacactgaaccatcccagcctcccaccccagaggttgatggcgctgagagaacccggtgagcctggctcccaggtggggagacgagggtgcccacagcctgctgacccctacgcctgccccagggccatgaccccagctgggccccagcagcaccggtcatcctccacaggaaaggagaagggaggcaccagcaccctggccggccccacttctctcccagtgcccccgtggccagaggctgacagcctcccccacctccccgcagctgcgcaggcacccgtcaagctttccctgaacctgctggcctcgtctgaccctcccgaggcggcctcgtggctcctgtgtgaggtgtctggcttctcgccccccaacatcctcctgatgtggctggaggaccagcgtgaggtgaacacttctgggtttgcccccgcacgcccccctccacagcccgggagcaccacgttctgggcctggagtgtgctgcgtgtcccagccccgcccagccctcagccagccacctacacgtgtgtggtcagccacgaggactcccggactctgctcaacgccagccggagcctagaagtcagctgtgagtcacccccaggcccagggttgggacggggactctgaggggggccataaggagctggaatccatactaggcaggggtgggcactgggcaggggcggggctaggctgtcctgggcacacaggccccttctcggtgtccggcaggagcacagacttcccagtactcctgggccatggatgtcccagcgtccatccttgctgtccacaccacgtgctggcccaggctggctggcacagtgtaagaggtggatacaacccctcgccgtgccctgaggagtggcggtttcctcccaagacattccccacggctgggtgctgggcacaggccttccctggtgtgaccgtgaatgtggtcaccctgaacagctgccctctctggggacatctgactgtccaagaccacagtcagcacctctgggagccagaggggtctccagagacccccagatgtcaggcttgggctcagtgcccagcgaaaggtcagccccacacatgcccataatgggcgcccacccagagtgacagcccccagcctcctgccaggcccacccttttccgcccccttgaggcatggcacacagaccagtgcgcccactgcccgagcatggccccagtgggatgtggtggccacgaggggctgtacacacagcaggaggctgtccgccctgctcagggcctgctgcctatgccccagctgtccaaccaagggaggcatggaagggcccctggtgtaagctggagccaggcacccaggcccccggccaccctgcagagccaaggaaaggaagacacccaagtcaacaaggggcagggctgagggctgtcccaggctcttttggcccgaggggctgccagcagccctgacccggcatgggccttccccaaaagcgaccctgtgaggtggcctcacagagaaccccctctgaggacagtgtctgaccctgcctgcctcacacagatgggccccacagcagtgggcaacctggggggcagcagcccaacctgaccctgcagggactgccccctgcagcagcagctgcttctcagtcccccaacctccctgtccccgccagagggtcttccccgaagctgcagccccaacccatggctgcccacctggaaccgggactccctgtccactgccccctccccttcggggccccatctgtgctggggcccaggttcggcctacagattcccatcattgccatggcctcctgaccttgcctatccacccccaaccaccggctccatgctgaccctcccccaggctcccacgcccagctggccggccatccccaggcacagacagtctgggatctcacaggttagcctggaccatccacctggccagacctgggagaggctggaagctgccctgccaccatgctccagggccccaggttgcagtactatggggtgagggtgtgtgtgcacacctgtgtgtacctaggatatccgagtgtacccttgtgcccccaagcacaagtctccctcccaggcagtgaggcccagatggtgcagtggttagagctgaggcttatcccacagagaaccctggcgccttggtcaaggaagcccctatgcctttcttgcctcgatttcccctcttgtctgctgagccagcaggggccacgtcctgggctgctgtgaggaggaagcaagttggtgctaggaggggctcctgtgtgtgcatgggcgggaggggtgcaggtatctgagcaccccggtctccacttgagagagcagggcaggagctccctgacccacccagactacacacgctgtgtccacgtgtctcccattatctgtggcagaggatccggcttctttctcaatttccagttcttcacaaagcaatgcctttgtaaaatgcaataagaaatactagaaaaatgatatgaacagaaagacacgccgattttttgttattagatgtaacagaccatggccccatgaaatgatcccggaccagatccgtccacacccgccactcagcagctctggccgagctcacagtacaaccacaataaactcttgttgaatgaactctaggaagtctgtgacgtggctggttcttgtcaatgcttcctgcctgcccacaggctcttcctcgtggatggggctgtgcttgccacggaagcgcgtttttcccggcctaggcttgccttgggccccactgccgtctccagctggagatgaccttctatacacacatttgctcatgacagacccttgcttagcccccttccatggctccctcctgctgctgggataaaatcaccttgcctggatatcccctcctgggcccctttccaccctccttagtcagcacccccagttcagggcacctgctttccccgctgcggagaagccactctctccttgctgcccggctgtgtcttgccttccacaccttgtcacagtggccacttcctaaggaaggcctccctgtgtgcaggtgtgcagaagtgccccagcctcccgtcacctttgtcacgggagcccaatccatgagagtctatggttctgtctgtctgccccactcagggcagcgacaagtccaggcggggaggacacagtaggcagagatttgtcgaggggacatatgagcaagagggtgaggctgggagctccctggagataaccacgcctcctgggaagactcgccgtcatttcagctccacgctgtgcgggggtgggtggaggggtagcctggccctcatgaccagggagcttctcactcagcccctgttcctccccagacctggccatgacccccctgatccctcagagcaaggatgagaacagcgatgactacacgacctttgatgatgtgggcagcctgtggaccgccctgtccacgtttgtggccctcttcatcctcaccctcctctacagcggcattgtcactttcatcaaggtcaggggagcggccaggctctcagtgaccctcggggtgggtgtggggcaaggtgcccttccaggggacatgccagagctggtccagggatcctggaccaggcagaggcagggctgagggagcctggaggacatgcaggccctctgtggcctgtggacactgtcgaaggccctcttgaccctgtggataaaggacaacaccccctcccctgctcctctgtctcccctgcccctccacccctcaggcttctagccccctgtctgaccccaggggctgtctttcaggtgaagtagccccagaagagcaggacgccctgtacctgcagagaagggaagcagcctctgtacctcatctgtggctaccagagagcagaaaggacccaccctggactcttctgtgtgcaggaagatgcgccagcccctgcccccggctcccctctgtccgccacagaatccagtcttctagaccagggggacgggcacccatcactccgcaggcgaatcagagcccccctgccccggccctaacccctgtgcctccttcccgtgcttcccccagagccagctacacccctgccccggccctaacccccatgcctccttcctgtgcttcccccagagccagctagtcccacctgcagcccgctggcctccccataaacacgctttggttcatttcacctgcctcctgttctttgtcccagtggtctggattcacctcaagttaaaggacacagggagctaacggcaacggggagggagtttggggtgtcagcagcaacagggaacgcaatagccaaagctgtcacagcaagaactgagcggagaccttgctctgaagttcatgggttaagaaacgcccctccccacaccaaacacaaacatttcacgctcactcgtacatgcacacacatgcacacaagcatctatgcacacatgcacatgtgcacagctcacgaataaacatatatgcacacacatgcagtacactcacatgcaaacaggcagatgcacaggcatgggcacacatgcacaaggcatgcatgtgcaggtctgcagacacacacatctgcatgcacatacacggacgtgcacctgcacacacacaagtgcacataggcatcaaagacacacatgctcgtgcacgcgcatacacacagacatgcacacttatgcatgcacacgccatgacaggatggcacgggaacaaccttgcacatggagcctgttctgtgtgtatcgagagcctgcacctcttactgtctgcatgactgtgggcaagagcctgaactccgtacctccatttcctcatcagaatggggtgaaaatacacctgtcaagtagagtgaggtgagaagtgagtaaaatcctatctgaaaggggctcagcaaggacccaggtattggtcggacctcctgttatcatctgctgtgggctgaacatttgtgtcctcctgaaattcatacattcgtatattcatacctttccccctgaaatcctaacctccaatgtaatggtattagaagatggggcttttgggggtgctgaggtcataaaaggggggccctcatgaagaggattagcacccttatgagaggggccccagagagctccctcaccctttctcccctgtgaggagatgccgtctatgagctgggatgcaggcctcaccagacacccatctgctggagccttggtctgggacattcagcctccagaatggtgggaaataagtttctgttgtttctcagccaccacgtctgtagtatgtggaagtcatcagaatcaaaattgagtcacctgtggttttttttttttctaaatccctgacaaatagagcctaggaaggccaagaagagaagagggttctcatccataaacacttgataacaaaaactatcaccaaggactctacaaaaactgcaactggcacaaagaccatcacaaccttacacagaaagtacttctgtgaggacatcttcccagcaacgggctgtccaacctcagactggcattgcctttgttattggtccttgtagagagggtaattatctcaaagcaatcatgtaatcctcctcatttttcctttgaaagccttggtctccctttgcctccctgaatacgcacatagctgatcatggcaggtgtatcccactgcagtgctctacctccaaatagatatctttttcttttagacggcatttctcttgttatttagattgagatacatggagtcagaagtgggatgtggagaaggatcactgctggaaggagtcagtaattcttgggccggtgtgcagtattcacttgagccctttgagctctcagctttttctgagctactccgtcttctctcaggccaaccctccctctttttggaagatgcttttttaatattatgtggggtttgtttattagactgccttaataaaggaccttatgtccctcctgggatgataaaaggcttttcgtgctttctggcaagtcctgtttagcataaagacattccagcctgagtactctggtttccacagagtttgcattctgtctctgagggatgtcttctctggtgaggtgcctcctttaatactttgttggatatgcatgcctgggtgaacatatttgtgagcacccttatcttgccttcttttgctgtggttatgtgtatctgtaaatgacctggctcttttcctctgcttgcttctaaaaatctttggagagcaaaataaacattctaaatggtgggcacaggctgtctcattagaagctgctacagcagtcaccaccgtctaaagcaccagtccaaactgccggcgtggcctcatagtatctgtagaatgttctttactgtaaaaagattaataagaagggggatggtttttaaatattaaggcacagtaagttttctggaactcccgctggctacgtctttgtgcacatttttaaactaatgggcaaattacgtcaaggaaaatttagagttccaatggttatttttcgaactctaacaaaaaccctgcaacagtagtcatcatgcagtgcctcctaagtcctctatctctctattttgtttttctgcctactttaaatctgctgacttttttactcatgttgcaataaaactcactggttacagcattccagccaagatatttttggttttttgtttgtttgttttttgttttttgtttttttagatggagtctcgctctgtcacccaggctggaatgcagtggcgctatcttgggtcgctgcaacctctgcctctcgggttcaagtgattctcctgcctcagcctcctgagtagctgattacaggtgcccgccaccatgcccagctaatttttgtattttagtagagacaggctttcactgtgttggccaagctcgtcttgaactcctgacctcaagtgatccacctgccttggcctcccaaagtgctaaaactataggcgtgtgccaccgtgcctggcccaagattttttaaagtttcctaaaggttttaaattagtggctttacaaattacaacagctctatggtaaccaatgacctagatgtaagagtcatttcttttgaaaatgtagattagctttgcttggctaacaactgcttaggctgatggaatagctaactgaaggactgatggtctcaaagaacagaactaggtaaatatttacagaaattgggctttcagatcgaacaggccaaaatcttgagcttagagcagtaatataaggtatctctgtctgccataaaaattttgctttgccacaggtgccagaaaaaggaaaaacactgctaaatgcttccctgcatgcattgtctagtccagaaaatcagaccagcaaccaaaaaatagatttgttactagtatagacgagttgaagattttgtttttcatatacaattcagccagtcctagctaaaacgcaatcactggaaatttaaccttaaattcatttaaaactgaaaaaggtcttttgaaatcaaactaatgcagaaactgctttacccaaaattctgatccatggccctcattagacgacccatcaggacaaataaagtttagcttgtgaacaagtcccagttttgtcaaaaatataatttggattgaagtgtcttttagaaactgacacatttgtgttattatctcatgaccaaaattctaaaatgaaagctacagtgtctttatttgtgtgcgtatgtggttaagtgtgtttatgcatatgtatgtgtattatgttgtatgttgttatctacatggtaaaatctggcatcatcaacaaaaaatctattaagggattctatttagattggcttagataaataagcattcataaaaaatatgtactaattaacccaaatgccttttagttcatgtgacttaggtatatctttaataaacaaatcagttttaaaattgttggtaaaataaaaatacaaatgttctcagaattgtcagcatatatttttccctgagtttactcgtcagacagctttatatttgtctctgatagatgttttaagatgtcagggtttgacacaaagatgataaaactataaacccatcctaaaacagaataatctttgtatgatctttgataaataagactaatttggctgagtgcagtggttcatgcctgtaattccagcactttgggaggccaaggtgggcagatgactagaggtcaggactttgagaccagcctggccaacacagcaaaaccccatccctactaaaagtacaaaattagccaggtgtggtggtgggcataatcccagctacttgggagcctgaggcaggaaagtcactggaacccgggaggcagaggttgcaatgagccaagagagcgccactgcactccagcctaggcaacagcgagactccatctcaaaaaaaaaaaaaaaggctaatttaatattgcaggcttaataaaaacagctgtatcttatgagctatcgacaaaatacccatacacttcactaagtttcttactaagtgaacatctaataatcacaggctataaaaatggttaaaagggaaataactttaagtaatggctagctttgtctaatatctcaattttcataagtaatctaggtaaattattaaaaataaattaattaagcctggtgtcatggcacacgcctatagtcctagctactcaggaggctgaggtgggaggattgcttgagcccggaagttcagaccaccctgagcgatgcaacaagacccccatcactaaaataaataaataaataagataaatgtcaagaaaataaatgtttataaataagcttcttatgtaatttaagatcttaaaattatgttatcttcagttaaataatagatactcattaaatgtctgggtcatttccaaataagatttttaaaactaacacaaattactgaacataaatgtttgttcttggcttcttaaattttatagaaattttgtagaaagactaaatttatttgggtctattaatatatgtaaaaattatgtcatagaaatatgttttcaaaaattataaaatttttctcatctataaaatagtgatatgtgacaaatggttaaaatttgcttgctagaaaataaggttactaagagttaaaattctaattaatatatataattctgtctacaaagtataccacaaaaaataagatgtgtttttcatttttaaaaactataagacaggcatttataatttattttactgcaaaaaaaaatttatctaatttggagtttgtttaaaggttgtttcaaagcacagatttaggaaaaaagtaaaaacaagatggaaaagaaccactctcatctgcccccacgtaagacgtacctgctccccttccaccacgactgtgtttcccaaggcctctccagccatgtggaactgaatttaatctacaaatagagttgatcaagtaactttaaggtatatggacaataatatgctttgcagcataaagacctgaaaacaaactaaatgcccatcagtgggaaattgtttcaataaaccacagaacattccgtggaaaactccacagccattcaaaagaatgaagggggagagatcatcatggtggacaggagtcaggactagattgcagtccgactgggatggacagagcacatgtggaggctggcaccgtgaattttagctccagaacaactgcaggaataaatcaggaatcccaagaggatccacagaccatgtgaaggaagcagcctgctcctgcaggacccagagacaccccaaatactgtgagtgcccaaactgtggaagtgggaatgggagatcgtccatcctgcacacacaccctcactagagaaaccaaaggtctagttggtgggaaaaggttccaaccttacctggagctgagtcaatttagaaagctgagcgaaatacaggggtacagggagcagcgggaaaggccctgggagcttcctgggtccccaggcaggccattcctgcatggcaccatatgaatactttgggagggtggccagaggcacagggaaaatgtcacagggagaaggaagtctccagctgaacgcaggggagggcacgaatcctgcagaccccactggtagaggaacaaccaaagcccttcttcatagctgggaagtaggtagcctggggcaagttctctgcttgcccaatgcctggaaacagactcagtgctgttggcgaggggcatggtgtgagtgagacccaccttcagtttgcatgggagctgggtgacacctgtgactgccggctttccccacttccctgacaacctgcatgactcagcagaggcagtcataatcctcctaggttcacaactccattgacctgggaacctcacagccatcccccccagcagctgcagcaagaactgtccaaggagactctgtgagctcagacacacctagccctgcccgcatctgatggtccttccctacccccccttgtagttgaagacagagggcatatactcttgggagttctagggccctacccactgctggttcctctccatactaccaccactgatgctctctggaaaacgccatctcctggcaggaggccaaccagcacaaaaacagagcattaaaccaccaaagctaagaaccttcatggagtccatttcaccgccccaccacctccactgggacagttgctggtatgcacggcggagaaacccacagacagttcacatcacaggactctgtgcagacaacccccagtacaagcctggagcctggtagacttgctgggtggctagatccagaagagaaataacaatcaccacagctcggctctcaggaagccacatccacaggaaaagggggagagtgctacatcaagggaacaccccgtgggacaaaggaatctgagcaacagccttcagccccagaccttccctcagacagagcctactcaaatgagaaggaaccagaaaaccagctctggtaatatgacaaaacaaagctctttaacacccccaaaaaatcgcactagctcaccagcaatggatccaaaccaagaagaaatccctgatttacctgaaaaagaattcaggaggttggttattaagctaatcatggaggcaccagagaaaggcaaagcccgatgcaaggaaatccaaaaaaagatacaagaagtgaagggagaaatgttcaaggaaatagatagcataaagaaaaacaataaaaacttcaggaaacattggacacacttatagaaatgcaaaatgctctggaaagtctcagcaacagaactgaataagtagaagaaagaaattcagagctcgaagacaaggtctttgaattaacccaatccaacaaagacaaagaaaaaagaataagaaaatatgagcaaagcctccaagaagtctaggattatgttaaatgaacaaacctaagataattggtgtccctgaggacgaagagaaatctaaaagtttggaaaacatgtttgggggaacaattgagggaagcttccccagccttgccagagacatagacatctaaatacaagaggcacaaagaacacctgggaaattcatcacaaaaagatctttaaaactaaaactaaaacaagcaatctacaaaacctaggcacattgtcatctggttatctaaagttaagatgaaggaaagaatcttaagagctgtgagacaaaagcaccacatgcttagtttcactggatacaaaattcttggctgataattgttctgttggaggaggatgaagatagggctccaatctcttctagcttgtagtgtttctgctgagaaatctgctgttaatctgataggttttcgtttataggttacctggtgctttcggttcaaaaatttttttaatttccatcttgatttcgtttttgacccaataatcattcaagagcagtttatttaatttccatgtatttgcatggttttgaaggttccttttggagttgatttccagttttattccactgtggtctgagagagtgcttgatataatttcaattttcttaaatttattgaggcttgctttgtggcctatcatacggtctgtcttggagaatgttccatacgccgttgaatagaatgtgaccatatgataggaaataaactccaaaagaagccgaacaacaacagtgacacaacctgttgaaacctctgggatacagcaaaggcggtgccaagaggaaagttcacacccctaggcgcctacgtcaaaaagactgaaaaagcacaaattgacattctaaggtcacccctcagggaaccagagaaacaagaacaaaccaaatccaaacccagcagaagaaaggaattaatcaagatcagagcaaaactaaaggaaattgagacaaaaaaatacaaaagataaatgaaacaaaaagctggttctctgaaaagataaataaaattgatagaccattagcaagattaaccaagaaaagaagaaagtcccaataacctcaataggaaacgaaatgggaaatattacaactgacaccacagaaatacaaaagatcattcaaggctactatgaacgcctttacacacattaactagaaaacctagaagagatggataaattctcaggaaaatacaaccctcctagcttaaatcaggaagaattatataccctgaagagaccaataacaagcagcgagattgaaatggtaattttaaaattaccaagaacaaaaaaaagtccaggaccagattcacagtagaattctaccagacattcaaagaagaattggtcctattggtactattccacaagacagagaaagcgggaagcctccctaattcattctatgaagccagcatcaccctaataccaaaaccgggaaaggacgtaaccaaaaaagaaaactacagaccgatatccctgatgaagatagatgccagaaatccttaacaaaatgctagctaaccaagtccaacaacatatcaaaaagataatccaccccaatcaagtgggtttcataccagagatgcagggatggtttaacatacgcaagtcagttaatgtgatacaccacataaacagaattaaaaacaaaaatcacatgatcatctcaatagatgcagaaacagcatttgacaaaatccagcatcgctttatgattaaaactctcagcaaatcagcataccaagggacatacctcagtgtagaaaaagccatccatgacaacataattctgaatggggaaaagttgaaagcattccctctgagaattgaaacaagacaaggatgcccactgtcaccactcctcttcaacacagtattggaagtcctagccagagcaatcagacaagggaaagaaataaagggcatccatatcgataaagagaaagtcaaactgtcactactgatgatatgattgtttacctggaaaaccctaaagactcctccagaaagctcctaggactgaaaaaaaaattcagcaaagtttccagatagaagattaatgtacacaaatcagtagctactctatacaccaacagtaattaagcagagaatcaaatcaagaactcaaccccttttacaatagctgcaaaaaataaaataaaatacttagaaatataccttaccaaggaagggaaagacctctacaaggaaaactacaaaacgctgctgaaagaaatcatagatgacacaaacaaatggaaacacataccacgctcatggatgggtagaatcaatattgtgaaaattaccacactgccaaaagcaatctacaaattcaatgcaatccccatcaaaataccatcatcattcttcacagaattagaaaaagcaattctaaaattcatatggaggccaggcatggtggctcatgcctgtaatcctagcactttgggaggccaaggcagtaggatcacttgaggtcaggagttcaagaccagcctggccaacatggtgaaaccccatctctactaaaaatacaaaaactagccgggtgtggtggcatgtgcctgtaattccagctactactcaggaggctgaggcaggagaatcacttgaacctggaaggtttgcagtgagcccagattgtgccattgtactccagcctgggcaaaagaatgagaatctgtcacaaaaaaaaattcatatgaaaccaaaaaagagcctacatagccaaggcaagactaagcaaaaagaacaaatctggaggcaacacacggcctgattccaaactctactataaggccatagtcaccaaaacagcatggtactggtataaaaataggcacatagaccaatgtaacagaatagagaacccagaaataaacccaagtacttacagccaactgatctttgacaaagcaaacaaaaacgtaaagtggggaaaggacaccctattcaacaaatggtgctgggataactggcaagccacgtgtaggagaatgaaactggatcttcatctctcatcttatacaaaaatcaactcaagatggatcaaagacttaaatctaagacctgaaactgtaaaaattctagaaactataaaaatttccaataacattggaaaaacccttccaggcattggcttaggcgaggacttcatgaccagaacccaaaagcaaatgcaataaaaacaaagataaatagctgggacataattaagctaaagagcttctgcacagcaaaaggaacagtcagcagagtaaacagacaacccacagagtgagagaaaatcttcacaatctgtacatctgacaaaggactaatatccagaatctacaacaaactcaaacaaatcagcaagaaaaaaacagacaatcccatcaaaaagtggggtaaggacatgaatagacaattctcaaaagaagatatgcaaatggccaacaaatatatgaaaaaatgctcaacatcactaatgattagggaaatgcaaatcaaaaccacaatgcgataccaccttacccctgcaagaatggccataatcaaaaaatcaaaaaacattagatgttggtgtggatgcagtgatcaggggacacttctacactgctggtgggaatgtaaactagtacagccgctatggaaaacagtgcagagattccttaaaggactaaaagtagaactactatttgatcctgcaatcccactactgggtatctacccagaggaaaagacgtcattctacgaaaaagatacttgcacactcatgtttgtagcagtacaattttcaactgcaaacttgtggaaccaacccaaatgcccatcaatcaacaagtggataaaggaactgtagtatgtatatgtgatggaatactactcagccacaaaaaggaatgaattaatagcattcacagcgacctggatgaggctggaggctattattctaagtgaagtaactcaggaatggaaaaccaaacatcgtatgttctcactgacatgtgagagctaagatatgaggatgcaaaggcataagaatgatacaatagactttgggaacttgggggtgagggtgagagaggaaagagggagaaaagactacaaatatggtgcagcatatgctgctcgggtgatgggtgcaccaaaatctcacaaatcaccactaaagaacttattcatgtaaccaaacaccacctgtattccaataacctatggaaaaataaacattaaaaaaattaagaagactgaaagaattaaaaaatttaaaaaacagtaagtagaagagaggtatttgaaggaagttatgggtatgaagatgtatttttggtacggaaggttaaaaagaaaagagaatttttttaaaaaaggaagaatcttgcgtgataaatttttgtcataaagtaaaatgactgcttactttaaaaaaagaggtatcacacacaccagggcctgttgtggggtggggagaggggggagggataggattaggagatatacgtaatgtaaatgacgagttaatgggtgcagcacaccaacatggcacatgtatacatatgtaacaaacctgcacgttgtgcacatgtaccctagaacttagagtataataaatatatatatatataaagaaaattccacacctgaagccatgtgacaggctacagacaaaacacagttaaaactttgtttcatgtacaaagttatttaaaatattgtacaaaatcaccttcaggctgtctgtataaggtgtacatgaaatacaaatgaattttgtgtttagacttgggtctatccaagatatctcattatatatatgcaaatatcccaaaatccaaaaaatataaaatctgaaacacttctggtcccaagcatttcagacaggggatcgttagcctgtaatgagagggagtatgggtcaattatgacgttgaagattcaaaaaaaatttttttttaattttcagtcaagctctaccaactacactaactagaaaacactcaggcagattgctttttgctaggttaatatggcatgattacaactgtgcatatgaataacatgtatcagattccttttgtttgggaattatttcattacaacactaaacactgcttatgtacgctgggtctctttttcaaagactacaaataatgcttggttctttgctttcaaaatataccaaacatgaggtacaagaatgtacccatccatatttgaccaggggtagaattaaaaggtttgggttgaagaagatgacataacatcccaagagggttgcatccctaggggtcatgggaacaaatgtggccaagtccctttttaactggaaaggatttcagatccctgaacaagacaattcatcagtcttaagcgtagtaagtcatcagcaaataagagaatgataaacactagaaaaataatcaaatcattgtctaaattcattataaaactatatgagaaaactataaaactatatgagagagataaacagagacaagaagacaaggataaaataaaaaaagaggtatcaaacaaagcagaacgcctcaacatgtcataaaacatctgagtaagtcataataaggtttgcaaataatgaatttacgaaaggaattttgcgtgtgatcaagatggctataattagaagggaattatttataagtctttctaaagactgaggtttgctattaaaaatatgctaatataaaactaaagatttagtttcctgtgttagaacaacaaagttatcttgaagtattgatctgttcttaaaactacaagaagtttttatttttaattctaaaatctgtttctttaacagaccatttctattgcttcctgggatccatttactttccctagtttcaggttggaagtcctcttcatgtaaaacgagaatttcatttcttgacatagtcttttccccctaaagcttctcagttttagatttcagaacttcaacttctgttgtatttcacagcacatgatttatagatcatgtatataaatatggatttatagatcatgtatataaatacagacttatccatcagtgccttcagctcttcctccccatgagatggcctggggtgatagctctctctttcaactttttttttatcaactcctataacattttttctcccattacaactctgttgttatggctcgatgctgaaatgtttatcccgaaagtctagaaaacaaatgttctctccagtataattccagtataattgaattttcccttgtaaccaggaagtttctcatgctgttgctttttctatgtgttcccctgctcaggtactagttatcttgtttacatttctctactaatggtttacacttatagccttggacatactctttctctgcctaattaaactcagtgtctttttcatcagatttgacttccagtttatctacatgggcttcccaagaggagacacaatcacactgcaggaggcatttctttaacttttgggtaagtagcctaaaaaaaacaaagattttgtattttattaggataattttttgtgttgtctttatgaggtttttggttacttaggtaacttgagctttgaagaagttaggtccttttaatccatgtaactttccgtattactcttcaagtcttttgatgatcactggttgaatacatggctatatttaatagtgacctgagattctgctttgattagccatgttgaacctttgacatctttggcaggcttcctcaggatcaaaattctaaaataagtctttttttatctagaattgacttagggattttacagttagacccctggaaagcctcaaagaatttatctctcatcctatagagaaaataaatgattaggcttatttggtaaattatatgggaaacattgtcaaataataagtgatattagatcttctttcagttacatttgtgggtatgctattgatatgatgtttcaaagattatataaattcatatcagtctataacgttatcagccataattttggttatgctacatcttctttaaagctatatttgtatggagacgttactgatgtgagtatattctaaagattatgtgaaatttataaaaccctgatggttctgatgtgatgctatcagtcacagtcatgattctgtttgctaccttaaaacactatagtaatttttaaaaagtcaatttccttatcaattgctgattataatgaatttttatcagatgtttaaccatggccattttgtttttgtgacccagagttattgttttgatttttctccaaaagcatttgtaatcagctattgtccaaaattgcttttcatggaagagactcaaacaggaactcttaaatacggtttcccgataaaagatcaatggactcaataaaaaattttcagaactctaataaagaaactgagaaattcaaaaacctccaatcaagctcaagcagaaaagctgacttcatgatattgaagaagtgatgaggggaatatttttatgaattttatttgaagcatcgttcgttcttaaatgttttgtttgccagatttaaggaaattttctctcgtaagtcatctatagtttacagtaatttaatacagtatactttttgtgaacaaagatgaaagcaattattttcccccctacgtgactcctccaaaatttagaaactattcacaagtgttcttatgacgatgtggccatttgtataagtccagataaaaactagttgtctcctcactgcaggatgtaattggaaacatcaggtatattactaaggctttggctgaaataccatatttgaaaaatatacatagaatgcctagtttcagccgggcggggtggctcacccctgtaatcgcagcactttggaaggccaagccaggcggatcacccgaggtcaggagttcgagaccagcctggccaacatggcaaaaccccatctcaatcccgtctctactaaaaatacaaaaattagccaggtgtggtggtgggcacctataatcccagctgctcgggagactcaggcaggagactcttttgaacatggaaggcagaggttgcagtgtgccaagatcacgccactgcactccagcctcggcaacaaagtgagactccgtctcaaaaaaagaaaaaagaatgcctggtttccagggttccttataatgagtaaaaatcatcacttcctggcaagcccagaaaccttaaaactgtaagtaaaagctaaagcctgtcttggtttggcttaccagcataaagaggtattgaagtacgagattcctatgtgatcaatgtacagaggaaaacttatgcttccaaagaaaagctgtaacacacctgcttttagattgtagctctgtgcattattttcaagttcttgttttctacctatagactagatcctgaattcttctagattattccaatccaactttcttccatggagaaaaatgagaactgctctgttcctgaagccctataagctgaagctagataaatgctaagaaacaagtctcatgcttgatgtccgagccagacagaaagttcaccagactgcccaatgccacgactagagacattcaaactgcaaagcaagatgaggaatttcacattttcactctgtagacagcttctcccaagtcatgggaacaagactccatatcataatgggactcttacctgtcctagggcctacagtttttacttagcttcctattttatttattcaattaattgccttgaatcctggattcattatttattcaattaattgcctttaatcctagacattgcataatcctattatgcaaactaggattgtcatgttattactaattttactttttattttccctttttaaactttgtatctgttacttgctgaattttttcagaagtacaacttctaacagaataatgctagcccagcactttgagataatagcaaaagaccacaccacagacaaaattgaacttaatcatttactccaggtagacttagcctgaaagccactgtcttcaaacctcctttgttactcaaatgtggctaaaaggattttgacactgactcctagacatcaatcactccttcaaacatgtgaccagaccagacacctgggacaggcccatccaaatactgagggacatcagaacctaccacagcatggtccatcagtgaggcttccagagaaagaccttgaccaaagggagaaaatatgatgaaagtcgtcagaatcaaaatggagtcccttgtgttaaaaaacaaacaaacaaacgaaactctgacatataaagccagagaaggctgagaagcattctcatgcataaacacctactagcaaaaactatcacaaaagactataaaaaacacagccttgcacaaaggccattgcaaccttacacaaaaaaatacttctgtgaggacagctgcccagcaactgcctgtgcgcctcatactggcatcacccttgttattgatccttgtagccaaagattatttcaaaacgatcatgtaatcgtcctcatttttcctttaaaaacctttgtcgtcttttacctccctgaatatacacatagtttatgatggtacgtgtgctcccactgcagtgcttggggaccaagctccctccacacctcactgttcccaaataaatattttctgttagagcctctctctgttcattatttagctcgacaggtatttggtacagcagccaaaacaggccaagacattgcccggaatcttccagcagtagactgggggcccggatttgaccctggtcagttggacacgggcttctctcactccaccagatgaggaacaaatagtgaggtgtggcgggagcttggtccccaaacagctcctccggccatttgccctccccacccacggaccagagacaggacgagggtgagccccggtgtcagccatgtgccccaaccccggtgcctcatttgctcctaggatgcgtcctgtaggtcatcttcttgcagctgtcccgctcagtctcccctcaacccctgctcatgctcttggtgagcttatcaatattatggtttccaatagcttctgttcatagtttcaactcatatctgtccctaagtgtggacttttattccacgcgttggcactggcagtcagctatgtgcctcctactcaaggcatctgaaactgcaggtgggtagttggctaagtcaggccccaaaagtgtcttcatccagattcccagaactgtgactctgagatcttacatggcaaaagggactttgcagatgagattaagccaatgatcttgagatgaggagaggggcctggattacttgggtggctccgaatgtgggcacaggtgtcacaggagggaggcagagggagacgtgagaaggagaaggtgccatgactccgaagccagaggctcctgctgatcctccggccccacccccaccccacggaccatgtggtctttttaaaacatgaatctatcaggacggcccattcaaacccacagagaggttcccactgcaccaagaacaaagtcagaactctcaggcctgacccactgccctcggccaccctggagccccagtgcccccagacccggtcctggcctcagagtgtaacaggctcgctcccaccacccatctgcatggcaggcgccttgccatcgcctcccctctgagagcacagacagccacagctggcctccgggtgaaaggatggatgaacagtcaggccgggcgagtgctctcagagcctgctggccaacggaggcagccgctcaggcctctgcctgagccatgtgcgatcacagctgctgcccagctgtcccaaggaggcagctcttggcttttcccctgggagtcgaattcgcagggagtcccatccacaggcccctgggaggcgggaagacatctcggtctccaaagccagtaacctgtgattcccctgaggatggtgggaacctggtgtggggcagatgatctgtatttgagctttgtttctctctagcaattatacctaggaaataccctaaaatgcacgacgcaatgcacattgaccccagcaaactccccaccctgcgcctgtttctagtgccggggctgctccagcacagcctgtgcacttgaccgaatgtctacagccctggccctcagccacactgtgttgttttcatgcaccttcacccaacagaattgctccaacagagtgattcagggggctgccctccagcaccacttcccctttccatgttacataaatgtccattgagtcctgactgactacagaaatctgtcttctgggggcatgtgatgccccaggtggcccagggccccgcacaggaatgtgtttacagctttcccggcactgaagccacagtcgtaactcagcctcctgacatgggccagggccctcgcctccgcacgctctgcagctcacccgtgtcgccacagcctgctgggcctggacgccaccctctgaggtggcactcggggcagaaacatctgtttccagctggtaacaaacaggacatgtctgcctcccacacctaaatcaatgcttgacaagcctggcctgatctcggggcgctcaccaccagccacctgcctgggcccagccgacctcctctcccttggtattttgagggaagggtctgagccctttctgcccccctagacttgtggacagaggccccccaagacctggacagaaatcaggccatagtctccagccccaaagagacttccagaggcctgcacctctcctctccagccgaggccctgatgtctgtggctgtggccacagccggctctatacctgccaagtttattctagaaaacattggtttggacaagacctcaaaacggaattgggaaaatgaaagagaaaagagaaaggatttctgctctcattgtaaggacaaaaagcaaattgaagaccagcactgatacagatcaataatcacaccagaaaaaaatatggcaaaatatctatattctcttaaggtgaataagtgttctctcagaatgaggctaaggccaggaacagtgaaaagtaagactgataaatttgcccacaaggaaaaaaataaagtctctataaggacaaagccaccaaaaacaaagtaagcaccccaggaaagaaagtgaccaaagtatctaacatgaaagagagcctgtattcgcatgagctcccgagaaacagaacccatagatgtggatgtggatatcgacagaaataggtatcaacatagacacaggctatggccacaggtatggatagagggagagatgcgagagagagattttaaggaattggctcacacagttgtggagacgaatgtccaaaatctgcagggcaaaccagcaggctggtgacccagagaagagctgaggctgctgctcccgtccaaagttcagcctgctggcagaattctgtcctccttggggactgccgtctgttttctcttaaggcctccaactgcctggatgaggcccacccacattatggatgatgatctgccttacccaaagtccacaggttgaaatgttaataacatctaaaaatcacctgcactatctagactggtgtttggccaaatatctgggtagtatggcctgcccaagttaacacctaaaattaactatcagagtccaagtaagtgaatgtaaaaaacaaacaaacaaaaaaaaaaaaacatgatgaatgagacaagctcgaccttgaagaagttttcagtggaacgtggggaagaggagttctctttagccagctgcagacacaaatagccaatagaacacatggagagtgttaaaagtcacaaatcgtcaatggaaagcaacttacaatgtgatgttcattgaacatctactgtgtgccaggccaagggctaaggtggacacgtgcagtgtgtctgcactgcggcactaaggtcctggtggggaatggataatacaattaaaaacaaatcacaaagaaaccagaagaggaaaaaaagcaattaaaaacaaataaatgctccataaaggacaacagcgccagctgagggtgtggccatcaatgccaggcatccagaatatgtccttggggacatggaccactgggaggtgcatcccaggcaaaaggagcaggaggggaagggtccaggccagaaacatgcttgccaagttcaagagcggtgggaaggccagtgggcttgggaaggagtgggctggaaggacaggccagaggccagactgcatggggccagactggccctgattccagccttggacttcactctgtggtgataggagaccctcagagggacttggggaggggttgtgtgttttcctgggagccacagaaaagtgagtgacactgggctgaggaaggaagtcacaggacccaccagtgtctgcgcaggagtcccagtggaagagcagaaaaaatccaggagaagatacaaaagtattcaaaagtaattcaaaatagcaaaaatccaaaatattcaataatttaaatggtattacttaaaatagtattataaataataaaaatatattattaaaaataatagattactggctttaataccaatgtacagaaatccgttttatttctatagaccagcaacaaacggaaaatgtgattcttataaagatgccagatgtctgcttctattaagggcatacagggaactcggaccagttagcaaatctgaaagaagtattttaaaaatctgtttgaaggtaatggagagataccagagtggtgaataatagccaccaaagtagctgccatttgcagtcacttccccctgagcccctccccaaaagcatttgctgattctgggatagtcagtgagaagctgagcagaaatcctgacaatcttagagctagggagaaaaactcagaggccaggactcaccaggagaaaggcgcttgggaagtacatgcactttggattagaaacccatggactttccttataggagcaaaggtgaaggaaatcatccctcacaggaactgcaaccagatgcactttattcaggtccttagaaaagctcaacctctaccactgggttaagttgatctcagattttgaattccaccaggaaccagccagaagcatatgaaaaccgtctctggaaaattataacgtcattttaggttcagttgctcaacccaatacttctgaatacagtatccagcacacaatcacaaagaaccacacatacaagtagacgaagcaacatgagtaagaacagcaaaaacggaagatcaacagggactccagacctcagctatgggaattagcacatgaagactttcttaatattttttatttcaatagcttttgggatacaagtagtttttggttacacggatgaattctatagtggttaattctgagattttagggcacccatcatccaagtagtgtacactgtacccaatatgtagttttttatccctcacctcccccacccacttgtaatcccagtgctttgagatgccaggaggtttgggaccagcctgggcaacatggcaagaccctatctctacaaaaaatgtttaataattacctgggcatagtggtacttgtctgtagcccccactatctgagaggttaggtgggataatcacttgagccagaagtttggggctacagggagctgtgattgaatcactgcactccagcttgggtgacagagtgaggccccatctctgaaaaaaaataaaaataagtaaaattttaaaactgataaaataacagtgctactaggtttgaagagtttaaacacaatctgaaaatttcatcataaattgaaaactataaaacacacatagcagatcttttttaattcagaattttagaacagaagtatacaatgaagagctcaaatgatgggtttaagagcagacttaacacagctgaagaaagaattagtgaatcagaagttggatcagaagaaaatatctagaatgaaggatagacaaaaacacagcatggaactggagggttaaaagaagagagtatccaccgataaggtctaacatataggtagttagagtcccagaaggagaagtgagaaggaagagaagaaacatttttaaagaggcaattgcagaaatcttcccaaacttaaggaaatatcctaccccatcattcatatggaataaaatacgtagaaaatctcatctaggccaggcgtggtggctcatgcctgcaatctcagcaactttgggaggctgaggcaggcagatcacttgaggccaggagcttcagaccaacctggccaacatggtgaaaccctgtctctagtaaaaatacaaaaattagctgggtgtggtagtactcatctgtaattccagctgcttgggaagctgaggcaggagaatctcttgaacccgggaggtggaggttgcagtgagccaagatcgcaccactgcactccagcctgggtgacagagcaagactctgaagaaaataaaataaaataaaaccacatctatccataacattataaaactcctgaagactaaaaaaaaaaaagaggctatcttaagagtagccaaggtcggggaagctcacaatacctttaaaggaggaccagtgaggctggcagctaatgtcgtaacagaaacaagaacagaatgagatgctgtcttaggctggcagctaatgtcgtaacagaaacaagaacagaatgagatgctgtctttacagtgctaaaagaaatacctgctaagccagggaaactatctttggaaaataaagatgacttttctttttctcttcttttcaattttcattccctagggctatcctaacaaggaccgtaaagaacagaagtgtattcttgcacagctctggaagctggaagtctaaactcaaggtgtcaggagggctgggctctctctaaagcctctagggtaggatgcttcttgccccttctagcttctttttttttttttttttatttctaaaacgactttattgctaagaaccatgattattacttaaaatagatttttcagttactgatataaaatatgttccttttgagaacacatggacacatagaggggaatgacacacactggggcctattggagggtggaggccgggaggagggagagggtcaggaaaaataactaaggggcactaggcttaatacctgggtgatgaaatcatctgtacgacagatccccatggcacacgtttacctgcgtaacaaacctgcacgtgtacccctgaactcaaaataaaaggttttttaaaaaatgttctttgtgcttctaaaaatgtctaaataatcctatatgcatttttcttatttgcctcttatgcgtagcttacagatttaaaagtacaatgttgcttgttttgtattcatcttggtggatctaataatttacaaataggacataggcatgctgatacagtcagcagttaattcctccttctgacagtggggtttggacatacaaccagcaatgcgtgcaggtggagagacatagaggatctttttttttttttttttttttgagatggaattttgctcttgttgcctaggctggagtgcaatggttcgatctcggttcactgcaacctccgtctcctgggttcaagcgattctcctgcctcagcctcctgagtagctgggattacaggcatgcgccaccacgcccagctaattttgtatttttagtagagatggggtttcaccatgatggtcaggctggtctccaactcccaatctcaggtgatccacccgcctcggcctcccaaagtgctgggattacaggcgtgagccaccacgccctgtacgaagttttaggtcatctgtgattcacaaacgaccggcttcgagaagctctggaacgtgccaaacaaggcactgtggagtagtttggctccatgtgacctaagagaggaaaatctgttgtctttgggaacattacacaattcaggtaagatatgtgcatattctcaagggaaatttaaggtgctcatactcaataaataaacacaagagcagcgttacagataatattcaaagagacagaggcttcttcatacctgatgtggtgggaagaccactggatgactggacactgagatacgtggttgacagtctcgtctctgaaacacatgatttgagttttgagcttagacaaacttgtttttctccagcatcagttttttcatcagtaaacaataataataatactgtgtttatgccaacatcattaggaagatcactttaaatggtgtatataaaaggatccatcaactttaaagccagtacccaatatacactcatagatatcagcgtattacagaaaaatagtatttattttgtggtcaagcatatctggattctaatcccaattctactaattgctcccttatcttttgtgtcccgtgatcatcaatgtttttatcattagaatcttgataatatctagctcaccatgtttttctggaaattatatgagataacatatgcaaaggacttagtgcagcaccagatgtgactcttccagctcctgtggttgccgactgccctgggtgttcccgggcctgcagacgcatcgctccagcctctgcctctgtcttcatgcagtgttctccctgtatctgtgtctaaatgtttctcttcttataatggcactggccatagtggatctaggacccactctactgtagagtggcctcatgttatcgtgattatatctgccaagtccctctttccaaataaggccacattctcaagttcttggtggacataaatttgggggtgactctattcaacccagtatactttctcttcctgagaagagcagtttggactcaaagctgttcggtgggcagatcaagggttggggggtgtctgcatggtgggggtaggaggagagatgcaggggcccagagcgggaagccagtgtggagtccaggctcggagcacccacatgagcagaggtgggcagcctgatatagaaagtcagatcttaagtggggtgagaagggttccagatggggaggagtgcacactagaatggagggggagccagaatggcagaggggaagggagtactggcagagagggcaggttggtcacacaaggggattggtcaagtaagtaaatacaccgaaaagaatagaaaagagagaaggcagttccaaataccaaaagggagtgatatggtttggatctgtgtccccacccaaatctcatgtcgaattgggtttcaatctgtgtccccacccaaatctcatgtcgaattgggtttggatctgtgtccccacccaaatctcatgtcgaattgtaatccccggtgttggaggtggggcctggtgggaggtggttggatcacgggggtgggttctcatgaatggtttagcaccatccccctagtgctgttttccttatagagtcctcccgagatctggctgtttaaaagcacgtggcacctccctggtctccttttctcctgctccgggaatgtaagacatgcctgcttcccttcaccttcaccttccaccatgattttaagttcctgaggcctccccagaagccaagcagaagccactatgcttcccggacagcctgcagaaccgtgagtcaattaaacctcttttccttataaattacccagcctcaggtatttctttatagcagttcaagaacagactacagggagaaactggaatgaatcctatggtactggattggaatttgatccgtaagtttgaattcatggtttctaacataaatagccattatataggagttgtcctgatttgtagaaaacacactaaaatattcatgaaggaggaggtgtcaggtcaaaaaaatactctcttgaatgattcagataaaaattgtttgtacttttcttgcaacttccaatttttggctgaagctaaagaaatattttcagacaaaacagaatatttgttgccagaagacacacactaaaggaactgcttaaagataggtttaagaaagaaggaaaatgatcccagaggaagcctcagagatgaaaaaaagaatttaagagtgtaaagtacacaggtgagtacattttaagagttattaactaataacaatgatgatgtgatggatagtgaggatagaaaattaaaacaattcagatgcatagcaataacatataagtaatgaagggctaataacactgcatcatcatatctgaaaagaagatcaaagaattagtgacaaatttcttgataaatttaactaatagaaaaaaatgcaactgtaagaaagtccatccaaagggaagcaaggaaaaagggataaaagaagaccaacaaggacagcattatctcacttatttgtggaatcttaaaagagttgagctcataaaagtagatattagaatggtggttaccagaggctagaggcagagagggagagaatggagcgtggttggtcaaagggtacaaagtctcaggtagacaggaggaataagttctgagatctattgcatgacagagtgactatattcagtaataatgtatattttgagataactaagagagtaaattgaaagggtctctccacaaaaaaataagtaaatgaggtaacagatatattaattagcttgattcaatcattccacgttgtttacatgtatgaaaatattgtggctgggcacagtggctcacacctgtaatcccagcactttgggaggccaaggcgggtggatcacttgatgtcaggaatttgagaccagcctggccaacatggtgaaacctagtctccactaaaaatacaaaaatcagctgggcgtggtggcacatgcctgtaatcctagctacttgggaggctgaggcatgagaatcacttgaacccaggagacagaggttgtagtgagctgagatcatgccactgcactccagcttgggtgacagagccagactctgtctcgaagaaacaaacaaacaaacaaaaaacattgcattgaactccataaatgtatctaattatgatttgtcaattagaaattatattaattttaaaaccacattgctagataggagatttaggctcaaatatatcagtatttacattaaatgtaaatgggctgggagtaatgtcactgaaaatggcagctccaaaaatgtgtcccttcacgaaagcaacaattaagctggcaaaaaactgacagaattcattttttcataactctagaatataaccaaaaacttaaaacaaagggtgcttaatgaagaaagaaactgctaaatttgggtaagagagaattgtggaattttcttacctgcctataaagccctcattttccagctcagaagtagccagggcaacagcagcccatcttcccggtgtggtttgctggtgccagagggagtaaaaaagccgttgtcatcaaagaattgtgcttgcgaatctcaacctatctgacagctctctgagggatcagctcaggatcttgcctttgttttgctcaccctgctcctgcccttcctcccctgtgtcctacccccaacaaacacacacagaattctctacaggatggaacagcctcctgggcagcatacatggaaagtatttaaaggtatatacttgtcacaaccatctaggtcaacagataatagaaagggaaaacagtagacaggctaaaacgcctaggaagaaaaaggctaaggaaggaaacgtggggaaatgagaactttaaaaaactcccacatatactaaggaattcaaacagccacatgtatttctagatgtatgctcagataagacctgagaagaccctaagcttttacctctggctggtcattaggcttcacatgagcaggaagtaaaggctaaggcagagttgtaaatgacctggttaagtgttgcagcagtgctctaacccagagccagcctgcaaagaacaggagggtcttcttcctctttctttctttctttcttcttttggcttaagaaatttaagaagatctgtgaaaacactagctgaccactaaactaacataacaaagatttcagtggccacatatgacaaaagtcttcacaaaagtagtttagacaagtcactaaacaactataacacaaaacaagcagcaataacaaaccctagggagaagaaagaatctagtttcccatattataatatttattcaaattttccagtttttaacaaagaagtatgagacatgcagaaaaacaagaaatatgaccctttcacaggaaaaggtaaattaacggaaacttcccctgaggaagcccaggctgtgaacttactagaaaaaggccttaaatcaactgtcttaaatattctcaaagagctaaaggaaaccaggagaacaatgcctcagaactagtgattatcagtaaagagatagaaattataaaatagcgccaaatagaattcttgaaatgcaaagtactgtaactaaagtgaaaaactcactacaggttcaagaggaaacttgagcaggtagaagaatcagtgaacttgaaggtaggccaattaaaattctcccaactaaagagcagaaaaaagataaggaaaatgagcttaatttgaacaatatgatcaataaatttgatctactaggcatatacagaccttagaaagagcagctacagaatgcaccttcattttgagccaggtggaatattcacacattataccatttatgaccacaaaggaagatttaacacattttgaaaggctaaaagtatttagttatgatgtgatcacagtgctaagtcagaaataaataacaaagaggtaagttaaaatacacatatgcttggaaaataagataaaaactgctaaataaccctgaagctaaagaagaaatcataatggaaacattaaaattttaaaaagtttaaaatatttttaactgaataataagggaaatactacatatcaaaacatggtgagatgcagcctaaacagtgcttagaggaaaacttatagccttagaagcatgtattatgaaagataaaatcctgaaagttgatgaactaaaaattcacccgaagaagttaaaaaagaatgtaaaaccaactgaaaatagaaggaaagagatcattaaaataatataagaaaatgattgaactgaggataataaagcaaagaaatgatcaaccaagtgaattaacaaaattgataaatctctgataacacttgttggggaagaaaagagaaaatgcaaataactaatgtcagaaataaaaagggacgacacacacatcctgcagatgtttaaaatgtaaaaaagaatatttgggaaagctttaagctactaagtgtgaacaattggatgaaatctaactggataaatgtaagtatttaaaaagtttaatctacaatttataaccttaccccagagaaaactgtgaaccagacatgatttcataggggatttctgatcaatatttagggaaatatcaacactcttagacaaactcttccagggatctgaagaagagtccatgccctgtaagctactgtatgaagccagtgtaatctgagttccgttgggactgcaaccgataaagtaattcatcacagaaatgacctcaggaaactggccttcagaacgggcttctgggaagttgtctcacatatttgaggaccacaggcataattcattgcccgcaggaaatggggcagccatacatgacatgtggtggcaccatgatgtctcagactgtcactgacaggagtgcatccaaagtacaaggagagaaaaaggcatgggcaggtcaagatgcagtagcactttgttgtcatggcaacaagagggctgctaaagattatggagtcaccaactttttctcatgaccatagagagtgtacacaggggaaaagaaacagtgaaagctatgaacatagcaaaaagaacatatacagagagccatggacgcttgaaggagtcccttacctcctggtcatgggtcagatagagctgatacccaaccaattcactacagatgaaagtcttagaaattgtggggctacaacatgcaaaggtttatcatcatcccacataacactaaacaggaggctctaactgcattcttgttggacatgtatccaatttcagaatagtgttccaagaatctgcctcctaggaccacttttgttggtgtcagggatccccagaagctgatcttgagagaatattttaagtggacagtttgtttgagaggtgatgccaggaaacactggtggaagagttggggatgaaaggaagccaataaaaagtgcactaataagcatgttaccatggaaataactgtaactgaaattcaccagggccctcaggaagccagtgtcaaacaaacaccttctcagtacgtccccccaacacacaccagcagcaagggagtttggggtatttatatgctaacttattagtcattggttgatggcagtttgtgcagagcaaaatcctgtgcaacttcaggcctgttgtgcacagaaaccctgactaccagagaaaaccctcaggcaagaagatgcagatgctagcagtttgaggttacaccagtatacactaaagtgtaaaggcccaaggcacctggagtgcaccaaaaactattgccacaggtgtacaaatgttcaaattaacaagaaaatgccatgtcatcctccaaagtcatggcaccaattcacattcccatcagcaaatctgagaccttatccaataccaatatcctgacctgaaactagatcatcatttatttgcatctgtgtttccttcttttatgtatccttttgtctcttgatcagagttagccacactctttattttgtatgcatcattccctccctttccataaaaaaaatttatcaaatatggccgggcgcagtggctcccatctgtaatcccagcacgttgggaggccgaggcaggcagatcaccagaggtcaggagttcaagaccagcctggccaacatggagaaaccccgtctctactaaaaatacaaaaattagctgggtgtcatggcacacacctgtagtcccagctactcaggaggctgatgcaggacaatctcttgaaccttggatgtggaggttgcagtaagccaagatggcaccactgcactccagcctggatgacagaggcagactgtctcaaaaaaaaaaaattatcaaatatgtatgtatatctgaacttgtctgattctgtttgcccttgagctatgtaaaattatatcatactatatgcagttgtctgcattggcattttttaccaatttttttacatcttgtttccaagattcatctatgttgttgtggggagttgtaatttattcacttttactgctgtataggtttccagaatttattttccttggataattgtttcaaaatttttctattattagctgccttactattgcattcttgttcctgtctgttgagatcctgttataggctgaatatgtcctcacctctccccaaattcatatatggaagccctaatcctcaatgtgatggatttggagatggggcctttgggaagtgattagtttttgatgaagtcaggagggtgggcgcccacggtggtggtggtcatgagggtggtcctcataggaagaggaagaaacggaagagcctcactctctctgccatgtgaatgcaccatgagaaggtggccatcttcaagccaggaagacagccctcatcagaacccagccacgctggcacccagattctggacttccaacctccagaacaaagaaaactaaatttttgttgtttaagccacccagtctatggtatttttgtcaggacagcccacactaagatggatactagtgggagagtttctctatgaaatatgcacaggagtggaagtactgaggtatagaatattatccctatttagttttctggaaagtgttttatcaagcatgttaccatgacaattaactagagtctaacacctctggggaattttgattatcgttgtagaatatatgccttagaattatcaccagggacaagtgacctcaggcatttacacacacaagctcccatcagccatgggttaagagctgctccaatgagtactaattcctggcacttctgttctgtattcatttaggctctggaagccacaggaagcaatcagacaaaaagtttcaggtgtcgtggctgggcatagtggcttatgcttgtaataccagcactttgggaggctgaagcaggaggatcacttcagcccaggagttcagaaccagcctgggcaatatagtgagaccacatttctacaaaaaatttaaaaattagctgagtgtggtgatgcatgcctatagtccctgttactcagtaggctaaggcagaaggatcgcctgagcccaggaagttgaggttgcagtgagccgtggtctcaccactgtgtgcattccagcctaggtgacagagcaagactctctctctctctctctctctctctctctctctctatatatatatatatatatatatatatatatatatatatatatatatatatggctgggtgcagtggctcatgcctaataatcccagcactttgggaggccaaggcgggcagatccctgaggtcaggagttcaagaccagcctggccaacgtggtgaaaccccacctctactaaaaatacaaaaattagccaagcatggtggcgcatgcctgtagtcccagctatttgggaggctggagtaggggaatcattgaacccagaaggcggaggttgcagtgagccaaggtcatgccaccacactccagcttgggcaacagagcgagactctgtaaaaaaaaaaaaaaaaaagaaaagaaaagaaaagaaaaaagaaaaaaaaaggaacacagaaggcacaaacagcatccactacagtcacccctcgcatgtctaaggtgcacttgcaccccacagtgatgtcaccacttcctattatttcctctgaaaatgaacccattttgagatgggcttgggccagaattacccttacccactgatccctgtaaacactcactctaacaggtgaggagtgaagagaatagggaggcttctatggtattctggtccctcaattcattatctgggttcgtggaacaactacagattctgctgttgcaactgatcccgaggccttcattggcctttgtcatctcccttttggagataggtttctaagggtttcccttgaccatggcaagaacttctgctgggctatgctctatgcctggtgggatgatccaaacctccattttctgcagaattacagaccccaacaaaaatgtccttattccaggtcttgaggtcccactccttcattattggggtgctttccttagtggaagagaactttgagctcctggattcagccttctttgtaatcccactactcttacaatcaggttctgggcccaattttcagtagtttcttctccagctgcaggagatggagttttttctaatgctgtgatgaaggttttctgaaatttgcaccatttcctgagttgaaaggggttcaactgagcctgttgttatatttcttcagtgattcaatttcactaaacaacaaccaaactattccaccattcttatgatcctgtctttctcaaaggccagagaaattacataaggagcacatcccccaacactgtaacactttctatctatgtcccattatcataatgccaggagaagttatttacaaagggttatttacaaaagtgcaagtgagatgtaagagaaccactagggatagtgcagtaagccaggttaggtaacaggagggctgttgctgcccacaaaaccaaatctcaaggtgttttagacaagacacaaactgtaaaagacttattggtaaatttaactatacaaaaattaaaaagtcatgtccatcaaaagataaagaaagtgaaagacaagtcacaacccgggaaaatacatatgcaacacctaaacttaacaaaggaatattatcaaaaatgtgtaaactcctacaaataaagaagaaaaggataaatatcccaatagaaaataaaggccaacagcttaggcaacatggcaaaaccccatctctacaaaaaatacaaaaattagctgggcatggtggcacacacctatagtcctagctacttgggaagctgaggtgggaggatcgcttgaccccaggaggtcgaggctgcagtcagccatgattgtgccactgcactccagcctgggagacagagtcagaccctgtctcaatcaatcaaccaatcaatcaagtaaaataaagaccaaaagacacgaacaggtatttcagagaataaaaaaaatacataaggccaataaacagtttagaaggtgtcagcttcactagcaatcagaaaaaaagtcaaatcaagagaagaatattcaagaaatcatgttagcaaaatgatgttggcaaaaattaagaagttgaaccataatcattaagacatagattcacagcctccaagtacgaatgatcctccgacctcagccccccaagtaactgggactacaggtgcatgccaacatgcccagctaattttttttcttttttgtttttttcatttatttgtagagactgggttttgccatgttgcccaggctagtctcgaactcctgtgctcaagcaatccgccccatcttggcctcccaaagtgctgggattacaggcgtaagccaccccaccgggcccagaatgctttcttaatctaaaaactcccctaagtggccaggcgcagtggctcacgcctgtaatcccagcactttgggaggccaaggcgggtggatcacgaggtcaagagatggagaccatcctggcaaacatggcgaaaccccgtctctactaaaaatacaaaaattagctgggcatggtggcgcgtgcctgtattcccagctactcaggagactgaggcaggagaactgcttgaacccaggaagcagaggttgcagtgagccgagatcacaccactgcactccagcctgggcgacagagcgagactccgtctcaaaacaaaaacaaaaaccaaactcccctaagtagggctattttcctgtccctgatgccaccttgacaacataagtcaaccactgttccacatttgtcttttaggaacgccccaggactgttggctgctgtccatggtgctgccttggtcagacacgtggtgtccaagctgctgtccgtggttttgctttcatttttctgtgtagcataatgatttttttgtttatttctttgtttaattaattgattttctctttttagaacagcgctaggtttgcaaacaaattgaacaaaaagtccatagactttttacatacccagcgcctctctatacatatacagtgtcacctactgtcattgtgcatctgtatggcacatttgttacaaatgatgagtcgatattgatacattatcattaactgaaatccgtagtttaccttagggttcactacttgtgttgtatagttcatgagttttgacaaatgtgcaatgtcacgtatccaccatggcagtgttatgcagaatagtatcccctatatttcactattcattcctgacccctcaccccaaaccctggcaactgctgatctttctactctctctgtagttttgcctttccaaatatatagtttggaaacgtacattatttagccttctccaactggctgctttcacttagcaatatgtatttaagattcctccatgcgttctgtggtttaatagttttttgtttttgttttttgtttttgatagggtcttcctctgtcacccaggctggagtgcagtggtgcaatcatatttcactatagcttcagcctcccaggctcaagcgatcctcttgccttagcctccaacacagctgggattacaggcaccaccatcatgcccattttttaatttttcatagagatggtatctggctatattgcccaggctgatctagaactcttgggctcaagtgatcctcctgtctcaacctcccaaagtgctgggatcacagtgtgagccaccatgcctgcccttgatagctcactttttattgctgaataatattccactgtccggatgtaccacggttaactgaaccattcacctgtgaatggtatcttagttacttccaagtttggcaattgcgaggaaagctgctataaaagctcacgtgcagatttttgtgtggacataagttttcaactcatttgaataaatacctaggagtgtgattgtatggtaagataagatttagcttttaaaactgtcaaactgtcttccaaagtggctgcaccatttgtattcccaccagcaatgaaagagagttctttatgcctcacatcctccacagcatttggcgttgagagctttttgtttcatttgttttctttgggattttctccattctagtagctggtcgtggtagctcattgttgttttcatttgccatcccaatggcacaccacgtggagcatattttcatgtgcttatttgccatccgcaagccttctttgctgaggtgtctgttcagatcttttgcccatgttttaattgggttgcttgttttcttattgtttaaatttaataatggttctttaagtgttttagatacaagtcttttatcagatatatattttctcctcccagtctgtggcctgcctttttcattctcttgacaatgtctttcacatgtagacattttttcattttaataaacctcagttaactaatttttctttttatacaaattgtgatttttgtgttatatctaaaaactcattgccaagcccaagatcatctggattttctcctgttatcttctaaaatttcatagttttaggctttacatttgggcctatgatccactttgagttgatttttgtgaaaagcataaggcctgcgtctagattcttttttttttttttttttttttttttgctttggtgccatgtagtgaaaagatgacgctttctccattgaactgcctttgctcctttgttgaagatcagttgactatgtttatgggcgtctattatcagaaaattttgttctatggatttatttgtctatcctttcaccaattccacactcctgattattgtggcttcacagtaagtcttgcataaaagttgggaagagtcagtcctctaactttgttcttcttcaatattgtgttgtctcttctgagtactttcccttcccatataaactgtagaatcagtttgccaacatccataaaataatgtggtgggaatttgattaggattgtgttaaatctatatataaagttgggaagaactgacatcttaagaatattgtttttcttttcatgaacgtggaatatctctcgactgatttagatcttctttcatttcttttatcacagttttatagttttcctagtatatatcttgtatatgttttattagatttatacccaagtatttcagtttctggtgctaatttaaatggtattcggttttccactttaaatcccaattgttcattgctggtatatagggaaaaaatggcttttgcccattaaacttaacgtccttcaaatttgcttttaggccattcttgcgttgctataaagaaatacttgaggttgggtaattttttttttttttaaaagaggtttaattggctcacggttctacaggctgtacagaaagcatggcagcctctgcttctggggaggcctcaggaagcttccaatcatggcaaacagcaaagggagagaagccatatcacatggccgaagcagaagcaagaaagagactctgtggagggggaggtggcacacacttctaacgactagatctcgtctgaactctgagcgagagctcactcatcaccaaagggctggcacaaaccattcatgaggatctgcccccatgatttaaacacctcccagcaggccccacctccagcattggggattacatttcaacatgagatttgggtaggaacaaatacccaaactatatcattgctataatcacttattagttccaggaggttttttgtcgattatttgggattttctgcagagatatcatgtcatctgatgacaaacgcagcttcatttcttctcctccaatctgtatatcttatacttgcttttcatgttttaatgcattagctaagacttccagcatggtgttaattgggactggtaaggggacctactcacctgttgcttctcaccatgaagtacaatgttagcagtaggttttttgtagatgtcctttataaatttgagagtattcccctttattcaaagtttgctgagagtttttatgataaattgagttgtattttgtcagacacttttttgttatctattgatatgaccacatgagttttcttaatcttttgaagagatggattatattaattgacttttaggtggaaagcttatattaattgattttgaatgtccaatcagccttgtttctattactgagagttctccagattaacagaaccaatagaatagggtgtgtgtgtgtgtgtgtgtgtgtgtgtgtgagagagagagagagagagagagacagagagagagagagaattttaaggaattggctcacatgggtgtggaggcctgcaggtccaaaatcatcaaatcggtagtgtggaacctgacctagggaagagatgatgttccagcttgagtccaaagatcttctggaggcaaaattccatcttcctcaggggacctcaatctgtcttttttaatagtcttcaactgattggatgaggcccacccacattttggaggatgatctgctttacttaaagtctaacaacttaaatgttaatcctgtctaaaaaaataccttcacaacatccagactgatgtttgaccaaatattgggttccaagacctagccaagttgacaagtaaaatcagccatcatatttgcatacctgggataaatctcaatgggtatattattttttatacatggttggatttcatttgctagtatttcattaacattagattttacactgtcgatattgaaggtaagcaatctttgaaaaagactactagaactcacccatagctgtttttctccttcctttgactcctgctagactgtgtttcccagtgccatcacatgtggatggagacctgttaccagttctgttcaatgagtaatgtgaataagtcagacagtactttgaagagttgtgatgctgtaacaaaaaataatattatgtggctcatgcctgtaatcccagcacttcgggaagctgaggcaagaggatgatttgaactgagtaattcaagatcagcctgggcaacatagcaatactccatctctagaaaaaaaattaaaaattagccaagcatggaggcacatgcctgtagtcccagccaccagggaggctgaggtggaaggatcacctgagcctgcagaagcagagggtgcagtgagctgagatcataccactgcaccccagcataggtgacaaagtgagactctatctcaaaaaaataaaataaaaaacttgccttagaatatgagaagcagttagcaaggaagctggtgtcaggctggaggactgcagatccttgtcatgccttaataaatcagttgttaacatttggaaggcagagtccctgcctattcagcctgcagctctagggtaagagattgcaaaatcaagtattaagagtttgttggctactattagctcccttcattaattaactagagaaaagaggttaggtcagagaattggtggctttgtaagcaaaaattttaaaagaatagagaaaatccaaaacttacaaggagggagtggaaaagctggcttcttctagaacccaaacaagacaggacaccaagaaaggttttagatgacgaggatggccaaggtgtgatttgcagtgtggccttcccatccatggcctctttcacagataatctaatttttaatttattatttttgtggatacataataattatatattaatgtatttatggggtacacatgatattttgatacatgcctagaatgtgtaatgatcaaatcggggtagttaaaatatctatcacctcaaaatttatcatttctttgtgttggaaacatttcaaatcttctcttctagctattttgaaatatacaataaattattgttaactatagtcaccacactgtgctgttaaacactagaacttattccttctaaccaactgttttgtgtgtgtgtgcgtgtgtgtttttttttgagacagagtcttgctctatcatccaggctgaagtgcaatggtgcaatctcgactcactgcagcctccgtctcccgggttcaagcgattctcctgcctcagcctcccaagtaggtgggattacaggcacatgccatatgccctgctattttttgtacttttactagaaacagggtttcaccatgttgtccagattggtctcgaactcctgacctcaggtgatccacccacttcagcctcaaagtgctgggattacaggcgtgagccacaacacccaacctacccaattgtatttttgtatccattataccaacctctcttatctcctccccacagcagtgatccttcccagcctctggtaaccaccattctcctctctacctctatgagatccacatttttagctcccacatatgaaagaggacacatgatatttgactttctgtgcctggcttatttctctttaacataatgacctccctttccatccatgttgctggaaattataggatttcattcttttttatggctgaatagtattccattatgtatatataccacattttctttatccatttatccattgatggacacttaggttgataccctatcttagctattgtgaacagtgctgcaataaatatgggagtgtagatatatctccaaaatattgatttcctttcttttggatatatatgcatcagtgaaattgctgaattatatggtagttctatttttaattttttgaagaacttctacactgttttcaataatggctgtactaatttacattccaactagcagtgaatgagcattctcctttctccacatcctcatcagcatctgttcctttttgtctttggtaataactattctaaatggggtaagataatatctcattgtgatttcgatttgcatttcctagatcattagtaatgttgagcattttttcatgtacatgttggtcacacttgcatgtcttcttttgagatatgcatattcatgtcttttgtccattttaatgggatttttcttgttgtggagttgaattccttgtatattctgaatattagtcccttgttggatgaattttatcccatcaaaaagttgactcttcactctgttgactgtttccttgctgtgcagaagctttttagtttaatatagtcccatttgtctatttctgtttctgttgccagtcattttgaggtgttagccataaaatatttgcttatgacaatgtcctgtagtgttttccctgttttcttctagtagttttataatttttagtcttatgtttaagtctttaatacattttagttgtttttttaattcagtgagagattgggacctagttttattcttctgcatatgaatatccagttttcctagcatcatttattgaagaggctgtcctttcccagcactttcattgaaaatcagtaggctataaatatgtggttgttttgtttctaggttctcaattctgttccattggtctgtgtctatttttataccaatgtcatgctgttttgtttcctatatcctcatgatatattttgaagtcaggtagtatgatgcttccagctttattctttttcctaagggttgctttggctatacaagctcttttttggtttcataataattttgggattgtttttccatttctttgaaaaaatgacattgatattttaatagcgattacattgaatctgtagattgctttggatagtatggtcattttaacaatattaattctcccaattcatgagcatggaaggtctttccatttgtttgtgtcctcttcaatttctttcatcagtgccttgtagttttccttgcagaagtctttcacctccttggtgaaatttatttatatggatttttgtagctattgtacatgggattgccttcttggtttctttttcagctagttcattatcagggtatagaaatactactgactttcatatattgatttgtatcttgcaactttactaaatttatttatcagacctaagagtttttggtggagtctttgggttttttcctttcagccagtatatatcttttaagtggaaaattctatctgtttacattcaaggttattattgatacgtggggacttatttctgccattttgttggttgttttcttgttgttttgtctatcctgtgttcctttctttctctcttattgtttatcattgtggcttggtggttcctgtagtggtaacatttgtgtcttttctcttcctctttttttgtatttgccgtgcggctgtaagttttatacatttatgtgttttcacgatggtagagatcatccttttgcttccaagtatagaactcccttaagcatttcttgtaaggccaatatagtggtgatgaatttccccaggctccagtggctcacataggtgctggctgtggtgggcaggatgggatgatcctttgccccacccagtaacagtagcagtgtgacgggagagcctgtcctcagggcatgtgaagtgcacagtggccctgctatggggtcactgcccgtggcatgtacttcagccctggaagcagcagcagcttcatcatagcttatttaattcagcggaccaagagcataaacacctgagcttcctctttttatctgctcattctgcttcccaagttctcaaggacttatgtggacagtcttcccgcacttgccaaaaactcagttcattctgttataaatctcagtgcctctacctgctacagacacggagctcaccccgtcagtggcaccccttctgacccagaagtgtccctaggtgtcttcgtggcctctgccatgggtgctggtatgccattgtgggaggtggggggcagtgggagtcaggaggttgctcctctgggtggagctgcctgccaatcaagatcctgactctacctccaccccatgtgaccaggctgcaggggcaggccttagtgggcaccggtggtgccctggtcacaagacaccctggaggtgaagggggccttccaattctaaagctgtagctgcagacttgggcagtgcaaatcctgtcaggaccaaacaccaaattctatcacccactcaagcttgaagttaagtgggagggagagagtccctgcaggacccttgctatagttggatgtttgtcccccaagacttcatgttgaaattcgacccccagtgttggaggtggagcctggtagaaggtgtttggattttgggtgcagatcccaaaatgctctcctttgagggtgagttctcactcttattcctgctagagctggctggtgaaaggagcctggcatctcccctctttcttgcttcctctctccccatgtgatctctgcacataccatggttcttgtacagcctgcagaaccatgagccaaataaacctcttttctttataaattacccagcttcaggaattcccttatagcaatttaatggacaaagacaacacctgacagccactctcccacatgcctccagcaatgctctgtgggtttgcacctccaactaagtcatttaggcaggatttaatggaaggacaccttgctgacacagatctgggctcagtgcaagagcccctgggacactgaggactccagagctggctccggcagagtgaagagtagcagaatatgccactttcaaacaagaataattttgagccgaagacaattaaaaagaagcatacccaagaaaaaaatccctgcccactccctttctaccaggaaaagcagaggattcttagtccttggagacaactctagatgcttatcagcccagagaaggcactagaggaatctacacaacaaactagcaagctatcttctgttagcttcccctatatatttacttcccagaatttgctgccctacaggttgaaagcccctttcctttgtcttgccaattctgtaaaaatgattgcccatttgctaagatgctccgtaagctcacgttccaaccgcccctttgaattcctcatctctgacggctcccacatagaggcataatgcacatgttagtaaacttctgtttgtttttctcatgttagtatcttgttaatctaattgacaagaccccagctaatgaacctaagatgggtagaagggggaaaaatgtttcttcccctacaagagcaagcacctccccacacactggaggaggagagagagccgctccgagatctgcaggaacagaggctccttgggctgtctgttgaggaaggcaataaggtccaggcaaccctgcaaggagagagccagggtcaccacttagcatcagcatccccttcctctgatctcctgcaggcagccagcccacccaaagagctgacccatccagcacccaaggagtgaggcaggccagagtccactccaagggcagaggctgtggggcaggtggggagccagcctggaggatgttagcagagccaggtgggtcatggcacccacagcctcggggatccagcttgagagagaccctgagggccaggcttgtcagagctgataacagatgagttgtgatgacagggctcattgtcagacactgtaggctgtcaggctgtcaacctgagcagactaccaagtcttcccatccgcaaaacagctcaccccagctatcaggggtgggcacccagaggagagaccattctcatctccacctgaactcttttggtgctcccagaacattctgatgctgaaaaggagtgtagaatcagatagaaacaattcctcttgtagcttccatgatggttggatggtaaagtacaactggctttgttagttcattttgcattgctgtagaggaatacctgaggctcagtaacttataaagaaaagaggtttatttggctcagggttttgcaggccataaaagaaccctggtgccagcatctgcttctggtgagggcatcaaggagcttacaaccatggcagaagttgaagggggagagagcatgtaacatggtgagagagagagcaagagagggaaagaggaggtgccaagctcttttaaacaaccagctcttgtgtgaaccagtagagcaaaactcactcatcaccaagaggatggcagcaaggccattcatagggatccatggcatgacccaaacatttccactaggccccacctccaacattggggatcacatttcaacaggagatttggaggggacaaatatccaaaccatgtcactccacactgtccccccaaatctcatgtccctctcacattgcaaaatataatcatcccttcccaatagtgcccaaaaaatctcaacttgttctaggatctactcaatcaaaactccgaagtttcatctgagactcaaggcatgccccttccacctatgaggctgtaagatccaaaacaagttgctacttccaagatacagtgatggtacaggcattgggtaaacatttcccttccttccaaaaggaataaattggccaaaagaaggagggggaagaagcaacaggccccacacaattctgagagaaagacattaaactttaaagctccaaaataatccttgactccatgtcctgcatccagggcacactggtgtgaggagcgggttcccaaggccttgggctggtctgcccccatggctttgcagagtgcagcccacatggctgctctcatgggttgtagttgagtgcctgaatcttttccaggctctgggcgcaagctgctggtggctctaccattcttgggtatggagggcagcagccccattcccagagctccactaggcagtaccccactggggactctgtgaaggggctccaaccctacattttccctccacactgccctactggaggctctgtgggagaactccacccctgtggcaggtttctgtctgggctcccaggctttcttttttgtctctctctttttttatttttatttcaatagttttaggtttttggttacatagataagttctttcatggtaatttctgagatcttggcacacttgtcacccaagcagtgtacgctgtacccaatatgtaatcttttatccctcacctccatcccccacttgccctcaagtatccaaagtccattatatcattcttatgcctttgcatccttatagtttagctcccacttataagtgagaacatatgatgtttgtttttccattcctgagttatttcacttagaataatggcctccaactccatccagtttgctgcaaatgccactattttattcctttttatggctgagtagtatcccatggtgtatatataccacattttttatccactcattggtcaatgggcatttaggctggctccatatttttgcaattacaaggagttgcaattgcactgctctaaatatgtgtgtgcaagtgtctttttcatataatgacttatttttttctggatatcgaatagtgggactgctggatcaaatggtgattctacttttagttatttaaggaatctccatactgttttccaaagtggttgtactagtttacattcccaaccaggagtgtaaaactgttcccttttcaccatatccatgacaacatctgttagtttttaatttttaattatggtcattcttacagaagtgaggtggtatctcattgcagttttaatttgcatttccccaaaaattagtgatattgagcatttctttatatgtttgttggccatttgtatatcttcttttgagaattgtctattcatgtcgttcgcccactttttgatggtattttttttattgatgatttgtttgaattccttgtagattctggatattagtcctttatcagatgcatagtttgcaaatattttctcttattctgtgggctgtctgtttactctctgattatttcttttgctgtgcagaagttttttttgtctaattaggtcacatttatttatttatttatttatttttggttttgttgcacttgcttttgggttcttgatcatgaactctttgcctaagccaatgtctagaagagttttaccaatgttatcttctagaattttcatggtttcaggtcttagatttaagcctttcatccatcttgagttgatttttatataaagtgagagatgaggatccagcttcattcttctacatgtggcttgccaattatcccagcaccatttgttgaataggacatcttttccccactttacatttttgtttgctttgtcaaagatcagttggatataagtatttgacttcatttctggattctctgttctgttccattggtctaatgcctatttttatacaagtaccgtgctattttggtaactatagccttgtagtatagtatgaatttgggtaatgtaatgcctccagatttgttcaccttgcttagtcttgctttggctatgtggggtcttttttggttccaaatgaattttagaattgttttttatatttctgtgaagaatgatggtggcactttgatgggaattgcattaaatctgtagattgtttttggcagtatggtcattttcacaatattgattctacccatccaagagcatgggatgtgtctccatttgtttgcgtcattgatgattgctttcagcagtgttttgtagtttttcttgtacagatcttttacctccttggttaggtatgttcctaagtattttattttttgcaggtgttgtaaaagggattgagttcttgatttgtttctcagcttggtcattgttggtgtatagcagtgctgctaatttatgtacattgattttgtatcctgaaattttactgaattaatttaacagatctagaagctttttggatgagctttagggttttctaggtatgtgatcatatcatcagtgaacagcaacagtctgacttcctttttactgatttggatgggcacccagactttcctatacaccctctgaaatgtaggtaggagctgccatgcctccttcactcttgtattctgcccacctgtgggcttagcaccatgtggaagctaccaaggcttccagcttgcaccttctggagtggcagcctgagctgcacctgggactctttgagccttggctgaacctggagcagcaacctcccaagataccacagggaagcaaggccccagccctgacccccataacaatttcatcctcctaggcctctgggcctgtgatgggagagactgtcccaaagacttctgaaatgcctttaagacctttttctcattgtctttgctattagcatttagttgccttttagttatgctaatctctctagcaagtggttgctccataaggcatttgggttccttgcctgaaaaggctcttttcttctcaacctcatggccagcctgcaaattttccaaatgtttatgttctgcttaccttttaattataaattctaattttaagtcattttttttgctcccatatttgatttaggccattcaaagcagccaggttacttcttggatgctctgctgctttgaaatttcttccaccagataccttaggtcatcactgtcaatctcagcctttcagaaagccctggaacatggacacaatacagccaagctccttgctgggggcataacaagcatcacctttactccagttcctaataaattcctcatttctacctgagacctcatcggcctggcctttactgtccatatttctatcagcactttgatcacaactatgtaaccagtctctaaaaagttccaaatttcccctcatcttcctgtcttcttcctgggccctccaaactcttccaacctctgcccattacccagttccaaagccacttccacattttcaggtatctttatagcaacaccgcactccttgctaccaattttctgttttcatccattttgcattgctataaaagaatacctgaggctggataatttgtaaagaaaaggaagtttatttggctcactacaagctgtacaagaagcataatgccagtatctgcttctggtgaggcctctggaagtttacaatcaaggcagaaggcaaaaaaggagccagcataggacaggcatggtggctcatgcctgtaatcccagcactttgggaggccaaggcaggtggatcacttgaggtcaggagttcgagaccagcctgaccaacatggtgaaaccccatctctactaaaaatacaaaattatccgggtatggtggtgcacacctgtagtcccagctactagggaggctgaggcaggagaattgcttgaacccaggagacagaggttgcagtgagtgagccgagatcacaccattgcactccagcctgggcaacaagagtgaaactccatctcaaaaaaaaaaaaaaaaaaggagccagcatgtcacatggtgagaatggtgagagggagaaagagagataagaaggaagtgtcaggtttttttaaacaaccagctcttgtgtgaactaatagagtgagaaatcacccatcaccaaggggatggcaccaaaccattcatgagagatctggccttatgaccccaatacctcccaccaggcctcacctccaacactggggatcatatttcaatgtgaaatttggaggggacaaacatctaaatcatatcaggaactccatggtactgctaacccccaaatctctaggggtgatattgagtgacatgcatggtactgaacgatacttggtcaggttctcccagtgaagcccaagcaccctcagggtacagggctgggaggcccaatcacaccagctcagcccaggacttggctgagtctgccctggtattagaaggtagcagacctagaactgggttgaacaagatcaggccactttgtgcatgttgccaaaggagaaactgaaggatcagaagtgggcagtaagttttcagtgagcccaggggtcataagtagcaaaatgtggaattcagtaaggggtagaggctggaagagttttgaggtgtgtgttagaaaaagcctaggtttccttgaagactatgttagaaatttggacattaaaggtgatcctggtgggggctcagaaagaaagaggagagctatagagaaaactcctgtcatcttggagaatacataaattgtcacgaacagaatgttgctagaaacgtgaatgttaaagatgcctctgctgaggctccagacagaaataaggaaggtgttattgaaaacgaaggtgacccttgtcatacagtggcaaagcacttggctgaactgtgttccgttttgtggaaagtagaaattatacatgatgaacttggatgtttagctgacgaagttcctaagaaaattgttgaaggcattcttgatttctccttgctgcttacagtaaaatatgagaagagagagatcagctgaagagggaagtgctgaggtggctgggtcagctgacccaagggcccttcaagctgatttaggctgctcaccttggtctcagaatcaccacggccatggccggtcagtcacaggtgatccagcagctgctgcaggccgagaagcaggatgccaagaaggtgtctggggcccacaagcaaaagaaccagaggctgaagcagcccaaaggagcagcttaggctgaaattgaacagcactgcctgcagaaggagaaagagttcaaggccaaggaagctgcagcactaggatctcgcagacccaggataaccatcctccagacctacttccagcagaacagggaagaagtcttagataaccttttggcctttgtctgcagcatccagccagaaatccctgaaaactatcgcataagtagatattaaaagagagaagcacctgttaaatggactggcactttagatgccctcatggaataagaagctctagttatattcttataagaagacattaacttatctctgtatattatagagtaggcccattcacttttcggagagaagcaaatccagtttctttgtacagacttagaatttatctaggctgggcatggtggttcacgcctgtaatcccagcattttcgggggccaaggcgggcagatggcttgagctcaggagtttgagacctgcctgaacaacacagtgagactgtgtctctacaaggaaatataaaaattagccagatatggtggtacatgcttatagtcctacctacttggaagagtgaggcaggaggatcacttgggcccggaaggcagaggttatagtgagccaagattgtgccactgcactccagcctgggtgctagagtgagaccctgtctcaaaaaaaaaaaacttaaagatttcatctttttacctcatgtttcttaggaatataatgggtaaatattgtctattttattatgccttttggctcaagcaatatatatacatatatatatatcactgttgatgttttctttcttgtatcaagtttaaaagaaaaagcaaaacaatcctttgaaaaaaggaaggaattaaatcattttttccttaatgcttttttgaaggtcaggggctttatctatgaaaaagtagtagtttctgtaacctgtgtgaagcatcagccagccttaaagtagtccattgctgctaataattagaacagtgaatattactagtataattgtttcagcttcttaatcaaaataactagatgatagaattcaagaacttgttacatgttattactcggtgtactactaatcatttaaaagtaaagcctatcatgcaaataaataaataaataaataaataaatacatgagaccagataaaatgaaggaagaatgactttgagatcagagccacaggtgaggaggctgttggggctgctgttgccaccttgggcccagagtgtggggccaccccagtgggcctggaagatggagcattaaccgaggaggatgaatcttgagacttaaatctaataaagggccaactagaagcccctagtgctcatcatcctcataaagaaagccagaaaagtcaatagacaactatattttaacgaaaataactgagggagagcactgagtgcatcagaggagtaacagaaaccctgataagcacagaaatgtgggctggccacatagaaaacagaaggaaacacacggcctccaccactccatcccccaaccaggattatctgggaatcaggaggaatttctgacatgaggaggtaagcaagaggatcccagtggcacccactaacacctcggacacctgcagacctcgccactggggtcccctgcagtttgcactggagggagttgcctggaggccacatagctgtgctctccaaaaaaggtgctgacaccgtaccccactcccacatggctagtgcttcaccacactggaataggaactatggctggagtgtgtcttacccaaggagtgagtagtcacagctccccttcatctctgaggctaagctgccactgaacaacccagactagtggtcccacgtccccaagtcaagctatgggcatctattaaacccttccccacagagccaagtggatcagctctacccactcctccccctgaccctttgagtccaagctaaagcagtttcttgcctcctagcaaaacaggactttggccatgcctttctagtgtctacgttgaagcagcaccctgcattccaggaactaatgccttggccacccagaaggtcacacactgcagtgcttaggctgaagcagcaacctgtatcctacagaaatggtgcctgggccactcagaacaatcacaccctctgatacataaatgcaggactttccttacagcagagaaggcctgagctgaagcaacacatcaccttctagggaatcagtgccctggcttaagctgagcagcagcacatcccaaggctgagctgatatagtaccctatgccccaggaaaacagagcagtggctaagctgagacatctcagcctacaggccaaacaactgtagtgccctgcttccctggagcttgcctaggcccctagggtctgagctgctgaggcaccctctccctgggaagtagaatcagcactgtgctgttccctgcctactccccaccaaggcccaaattacagctatgctctgccatcttgggatacttgctgacactgtacctggtctcacatagtctgggatcctgctgagccctaccatcctagggtctagagtcaataccatacagtgcctcatcccctgggaccaaagtttccattgtgccctattggctcagcttcccaaattgcagccataccatactccccaggtccacacctccagaacaccccttcttccccagagttggacaaatgctgcaccccccaggaatagactcacagctacaacctggccccttgagcaaaacctgttaaagggtacctcagagtcacagatcctagcactgtgagccacctaatccaaacctgccacagaaactgaacctacaccccaagacccagatgccacagtagattcttgaaaccaggagactaggactccagttgcacagctactctaattttctgcacctggaatccagcaccattgcagctgcacgttggccacattagacctgctaccaagagagagccccttgactaaatctcctcattgtggggaaacaagaagaggaggactacaaaagcccttgacactgagtacattaacctgtgccaccactacatccacaaacttctacagcctagtccactgaggtgcccacagttattgctgaggttgaatgcagttgaagaagacgcatggaagctatgccactgcacctattcagaaacagagtcatcacactttcccaaccaaaacactaaacccaactgcaggtgaaattgtttctctaaaaaacccactcttgaaagtttggaagaggtgactatttcgccagatgcacagacatcaatgcaggaacacaataaacatgagaaagcaaggaaatatgacaccaccaaaggaacataactctcattaatagacctcaatggaaaaagaaatcaatgtattgctggaaaaggaattcaaaataatgatcttaagataactcaataagatacaagaaaacagataaacaattcaatgaattcaggaaagtaatttacagtatgaatgaaaatttcaacagagatagaaataaaaaagaagcaaactaaaattctgcaggtgaagaattcaatgaataaaattaaaaaatacagtaatgagcttcaacagcagatatgatgaagcagaagaaaggaagagatagatcccaatacaataatagttgataacttcaacaccactctcagcactggacagataatccagacagaaagtcaacaaagaagcattcaatttaaaaagcactttagaccaaatgcatctaacagatatttacacaacatttcatccaacagctgtgaaatacacattcttttcatcagcacatggaatattctccaggataaaccatacagtaagtcacaaaacaagtctcaacaaatttgaaagaattaaaattatatcaaatatcatttatgaccacaataaaactcgaaatcaataagaggaacttttaagactgtacaaagacatgggaaattaaataatgtactcctgagtgaccaataggaattaagaagggaattttagaatgtcaacaaagaaaatgaaaatagaaatgcaacgtactagaatttataagatatagcaaaaagcagcattaagatggaagtttatggcaataaatacctacatcaaaaaagcagagagatttcaaataaatctcatccttgaaaatgcatgtcaaggaactaggaaatcaagaataaaccaaacccaaaattagtagaaagaaagaaataataaagatcagagcagaaataaatgaaattcagactaaaaaaaaaaaagatcaacaaaatgaaaaattgaatttttcaaaagataaacaaaaatgacaaataattagctagactaaacaaaaaagacccaaaagaatgaaatcagaaatgaaaacagaaacattacaactcatatcacagaaacacaaaggataattagagaccatacaccaacagattagaaaacctagcagaaacaggtatatttctggacaatacaacctaccaagactgaacccagaagaaatagaaagcctgcacaaaccagtcatgagcattgagattgaatctgtaacaaaaagtctcccatcaaaggaaagcccaaagaaattcctgttgaaataccaatgacattcctatcaaaatgccaattctacagtaatccaatggcttcagtggggaattctaccaaacactaaaaaaactaatacctattcttctgaaaatcttcccgaaaattgaagaggagggaattcttctaaattccttgtatgaggccactattatggtaattatgattatgattatgattatgtgattattattatgattccaaaaccagacaaggacacaacaaaaaaagcaaactataggctaaatactctgatgaagataatagatgaaaaccttcaaccaaatactagcaaattgaatccagcagcatattaaaaacattatttatcatgatcaagtgagatttatcccaggaatgcaaggatggttcaacatatgcaaatcacatcaacagaatgaaggacaaaaaccgtattatcatcataacagacacagaaaaagtatttgataaaatccaacatcccttcataaaaattctcagcaagttaggtatgaaaggaatatacctcaacacaataagagctatatgtgacaaacccacagccaacatcatactgaacatgcaagagttgaaagcttttctctaaaatctggaacaagccaatgatatcaggccagatgtagtggctcatgcctctaattctagcactttgggaggccaaggcaggaggatcacttgagcccaacaaaggaaacaatcaacagagtgaaaagacaatctacagaatgttagaaaatatttgcaaactctccatccaacaagggactaatatttagaatacattggaaactcaaacaactaaacagaaaagaaaacaaatttttttattaaaaataggcaaatgaaaaaatatttaaaagtttttaaaaccaaaaaaggaactgaatagacgtctctaaaaggaagatatacgaatggccaacagacatatgagaaaatgctcaacattactaatcataaggaaaatgcaaattgaaaccacaataagatataatctcaccccagttaaaatggctattattaaaaaaggcaaaaaacaattgctgtcaaagattcagagaaaggggagctttaatgcattattggttgaaatcttgtctttggaattagcacagccattgaaaaacaataaagagcttcctcaaaaaatggaaatgagtactgccccatgatcccaccatcctctaccgggtatttatccaaaggaaatctatgtcaaagagacatctacactacatgttcattgcagcactattcacaatgccagtgttggaatcaacctacgtgtccatcaacagatgaatgcataaagaaaatgtagtgtttatacacaaacacacacagagagagagagagagaggaattctattctgccatgaaaaagaatgaaatcttgtcatctgaggtaacatggatgagcttggaggacatgttaagtgaaataaagctagacacagacagccaaatatcacatgttctcactcatatatggaagccaaataagttgatctcatagaaatagggagtagaatagtggtaaccagaggctgggaatgggaggggataggatagctagaagtcgattaataaataaaaaattacagtcaggtaggaggaataggccccggtgttctctaacaccatagggtgactataactaacaacaatttattgtatattttcatacggctagaagagcaaattttgattgttcccagcacaaagaagtgataaatgtttgaggtgatggatatgctaattgttgcaggaagtcagggaccccgaatggagggaccagctggagccatggcagaggaacataaattgtgaagatttcatggacatttatcagttcccaaataatacttttataatttcttatgcctgtctttactttaatctcataatcctgttatcttcataagctgaggatgtacgtcacctcaggaccactgggataattgtgttaactgtacaaattgattgtaaaacatatgtgtttgaacaatatgaaatcagtgcaccttgaaaaagacagaataacagcgatttttagggaataagggaagacaaccataaggtctgactgcctgaggggttgggcaaaaagagccatatttttcttcttgcagaaagcctataaatgaacgtgcaagtagggaagatatcgctaaattattttcctagcaaggaatattaatactaataccctgggaaaggaatgcatccctgggggaggtctataaacggccgctctgggaatgtctgtcttatgtggttgagataaggactgagataaggactgagatacgccctggtctcctgcagtaccctcagcttattaggggggtgaaaaactccaccctggtaaatttgtggtcacactggttctctgctctcaaactctgttttctgttgtttaagatgtttatcaagataatatatgcactgctgaacatagacccttatcagtagttctgtttttgccctttgccttgtgatctttgttggacccttatcagtggttctgcttttgccctttgtcctgttccctcagaagcatgtgatctttgttagacccttattagtagttctgctttttgcctttgaagcatgtgatctttgtacccactccctgtgcttacaccccctccctttttgaaacccttaacaaaaaacctgctggtttgaggctcaggcggtcatcacagtcctactgatatgtgatgtcacccccggctgcccagctgtaaaatcctctctttatactgtctctctttatttctcagctggccaacaattatggaaaacagaaagaacctacattgaaatattgggggcaggttcccccaatactaattatcctgatttgatcatcacccattgtatatatgtatccaaatatcacaatgtaccccaaaatatatacaattattatgtgtcaattaaaaacaatcataaaacttttaaacagctaaaataaaagtatattgttttcttcaaaaaaaatctaatgcagttttccctactaggttttgggcttgcttaggacccatggctcctctctcccttccaatgtatcccttttggaataggaatgtccatcctatgcctgccccatcattgtactttggaagcagataacttcttgtcaagttacaaaggtccacagatggagaggaatttcaccccagaatgaatcaccctgcatttctcccacacttgatgcaggtgatatgtcgctgagattgtggactaagagttggtgctggaaggggttagccatcgtggagatgttgctatgggatgcagggattttgcctgtgagaaggacatgattatggggggagcggagggcaaactgtcatgggttaaaatgtgtcccctataaattcatgtgttgaagtcctaacccccaggaccacagaatgtgaccttgtttggaaacagtctttgcagctgcaatcaagttcggatgaggtcaccctggagtagggcaagcctctgatccaatatgactgctgtcctcatgaaaagggggaatctgggcacagacgcacgtgtggagaacgccctgtgaagatggtgctgcttccacaagccaagagcagcagagacggccggcaaagcccagcagcaaggagagagcctggaacagagtctccatgacacagaggagccagccccaccgagacctccatcccagatgaccggcctccagaaccaggacggaataaacgtctgttgtttaagccacgcagtctggggtgcagtgttgccagggccgcacttaacggatacgagtgttgtcctgagctgccagccccacagactgcacaaggcctccctgccccagccaagtgcagtctccccagccccctgggtgtgccatgggcagtgtggggcccatcactccgtcctcccccaggctgggaggttgagcccattatgagctccatggggtgaagctggagcgagaggctgggagccgactgggagcccgcggctggaggatggatttccccagggacccacacgtgcacctccacctgtctcctggacgttctctctgagggcagggctggtgccagctcagggatccagcagggacagaagggcgggccgggtccttgtggagagcacatttagtgggagggacatgatttcccctcacaagtgtccattcttcctgttccttgctggacgcttcctcttccattctggacacttcctgtgcgacacctcctcgggctttcccgaggccctctggcctcattccgttccctgctacctcccacttccacgtacgtccttgcccagctcttccctctatccagagcttctgcctggcaaggtccctgctgagatcagtccaggctcccccagcacaggtaggagccttgcacatgcccttggacctccccaccctgcatgatgccagcatccccaggccccagggaggccccatttctctctctgctggtagtccagtggccctggagtcccactgcaggtggggtgtgcccctgaactctgaggaagctaagtaccctgccctcagacaggctatcccccctgctcagccccagggccctgccccctaccccttcccctcacctgcaccacaggctctggccaactctgcccaggccctgaatgggcccctctggctcccctctgctgctacactgccctgcaccacctccactcagcctcagtgtgttcatccgcctgtcccacgtcccctcggcccccaggagcacagctggtggccctggctcctcgcagcccatcttgttccttctggagcaccagcctcagaggccttcctgtgcagggtccactcggccagccctgggaccctcctggtctcaagcacacacattctccctgcagccagacctgcccctgcctgtgagctcagacctgagccttggaacgccttcccttctccatcccagctcgcctttgccagctgctcagcaggatgaactcacactcccctccctgcaccatgagtgagagtcagctggagagatgcccaggcaaaagcagccaccagggcccagtgggggccagaagcttcagatgagaggcccaggtattgagaggctgagaccacgggcagaatggtcataatcgttgccagtctcagtccagccccagggactcagagacagagaaaagagcagcacacaaggtccgggctccccaccttctcccgtgagtacgggggagtatgggggcagccaccacccccatccccacacacccatgaggcagcctcagctgtgtctggactccccctcgccctctgacacagaaaccaccagaagaaaagggaacttcaggaagtaagtggtgccgccggtttcaatcctgttcttagtgtttgcagcgtggagttcacacccctggggacctgggggccgagctgtgatttcctaggaagacaagtggcagctgacagcgtgggcaaggctgcccacatgtacctcgccacaacaggaagggctgagacccccacctcggtgagtggggtcagcacagggcaggagcacaggctcaggagaaggacagagcctgggcgcagccatcggcgcttctggacctgagctgctgaacaggctgcaagaggctggggagaggctggggcgaggccagccccacatggaagcctaagcggagccagcacaggggaggtgggcagccttcaggcaccgatgcccacccagtgcgagacgacagggaccgtgggcaggggcttccaagccaacagggcaggacacaccagaggctgactgaggcctccaggacgaccgggctgggagtgtgaggaacatgacgggatggggcagagccagccatggggtgatgccaggatgggcatgaccgacctgagctcaggaggcagcagagagagggaggaggagaggccccaggtgaaccgaggggcttgtccaggccggcagcatcaccggagcccagggcagggtcagcagagctggccgtagggccctcctctcagccaggaccaaggacagcaggtgagctgggagcagagcagggagggtgagtgtggcagcaggacaggagggtggaagccaaggagcccagaggcagaggcagggacaggggaggcacaggggctgggctcagagccagctgatggggttggggcacctgctggccgggagcagggctgtggtcagcagcggagaggaggggagagctgtgctgagtgcacgggcgggaggagggaagagtccagggaggcccagaaaggcccagagtgcagcaggcctggggcgaggggaggggctgaggctccgtgcgttcagggaactgacccagcagagcagaggccactgaggagctgaggttctggagaggcttccagagcaggagcagtgcagggacgggaggatccgggagctcatccaggaggggcacatgggcaagggcaaggggctctgttggggagacctgactggacactggggctgctccacagcatagggaacacgccaagtgctgcaaaaacaaaaatgaggcaagaaaaacagcctaaacctggacagagggtgccaggacaggcaggggggcaacagtggaccgagtgacgttgctgccccaggttgagggagggcagagtgagcagggggcaggcattggagttcaggggaccaggaccaagcagccacaggtgcacagggcaggtgggaggcaggaagaacagggggcagctcctggagctcaggggaccacgggagagcatctgaaggtgaacaggagccggtggaggggcaggatgagcaggaggaagaccctggagctcaggggaccagggcagagcagccacaggtgaggaggcagccacaggtgcgcagggcaggtgggaggcaggaccagcagggggcagcccctggagctcatagagccagggcagagcagttgcaggtgagcagggctcagtggaagatgggcaagcagggggcagctcctggagctcagggcaccagggcagtgtagccacaggtgagcaggggctggtgggaggcaggacaagcaggcggcagctcccggagctcagggaaccagggcagtgtagctgcaggtgagcaggggctggtggaaggcaggacaagcaggtggcagctcctggagctcagggaaccagggcagtgtagctgcaggtgagcaggggctggtgggaggcaggacgagcagggggcagcccctggagctcaggggaccaggggagggcatcagaaggtgagcaggggctggtgggaggcaggatgagtaaggggcagcccctttagctcaggggaccagggcagagcagcctcaggtgagcaggggcaggtgaggggcaggacgagcagggggcagtcctggagctcaggggatcagggcagagcatcagaaggtgagcatggctggtgggaggtgggcgagcagggggcagcccctggagctcaggggaccagggcagagcagtcgcaggtgagcacgggttggtgggaggtagaacgagtagggggcagctcctggagctcagggaacaggggagaacatcagaagatgagaagggccggtgggaggttgcagagcagggggcagcttctgcagctctgccagccagggcagagcagctgcaggtaagcagggctggtgggaagcaggggtagcaggtgggcagcccctggagctcagagagccggggaagatcatcggtaggtgagcaggggctggtggaaagcaggaggagcaaggggcagctcatggagctcagaggaccagggaagagcagccacaggtgaacaggggcaggtgggcggcagaatgagcaggggcagctcctggagctcaggggacaagggcagagcagccataggcaaacaggagcagggtcaggggacaggaggagcagggggcagctcttggagctcaggggaccagggcagagccgctgcaggtgagcaggggcaggtggggggcaggaggagcagggggcatctcctggagctcagagcaccagggcagagcagccacaggtgagcagggacggtgggaggcagcacgcagctcctagactttggcaggagctgggtagttgccggcagcagacagctgagggctggtgaaagtgcagtgcagcctcctggtgccgggaagggagtgtgagtccatcccactgagcagttggcaagggcgagctgggatggagaagggaaggcgttccagggctcggggctgagctctcaggcaggggcaggtgtggctgcagggggaacgtgtgcttgagaccaggagggtcccagggctggccccagcggaccctgggcaggaaggcctctgaggctggtgccccagaaggagcaagatgggctgccaggagccaggaccatcagcacaatgaagctgagtggaggtggtgcagggcagtgtagcagcagagggcagccagaggggcccattcagggcctgggcagagtcagccagagcctgtggtgcaggtgaggggaaggggtggtgagcggggccctggggctgagcagaggggatggcctggctgagggcagggcgcttagcttcctcagaggtcaggggcacaccccacctgcagtgggactccagggccactgggccagcagcagagagaaatggggcctccctgtggcctgggggtcctggcaccacgcagggtggggagggccaagggcaggtgcaaggctcctacctgtgctggggggcctgggttgagcccagcagggaccttgccgggggaagctctggagagagggaggaggtgggctggtggctgagaaggccaggccagggctgggagggtgacggtgtggtgactgagcctccagaagtaatgcaggacactgggaggcagggggcatccaggcactcagggccctgacctgggctgctgcacactggggctaaggggaaaggaggggagaggctgaggaggaggctcccggggcgatattccaaggcagggggttccggggccctggggctgaagggcgccgaccctatgcagtgtctggcccctctgctgcacagaagaaaagggccttggagggcagagggcaggctatgaccagggccctgggcaagtcaggcccactcactagcggagggccacgctggggcggcagggtcaggagcttcaggggactcaggggacccacgagaagccatctgagaacagtgtccactggtcaagccaggcacccataaaaggctggagtggggccaatgggcatgagccgtccctgaggtggcaccgatggccagagctgaggccaagctagaggccctggactgtgctgactcccggcagacacagagcgctgacctggctgccgagccccgcctcctaggctgcaggggtgcctgcagaagggcaccacagggccaccggtcctgcaagctttctggggcgggccgggcctgaccttggctttggggcagggagggggctaaggtgaggcaggtggcgccagccaggcgcacacccaatgcccgtgagcccagacactggaccctgcctggaccctcgtggatagacaagaaccgaggggcctctgcgccctgggcccagctctgtcccacaccgcagtcacatggcgccatctctcttgcagcttccaccaagggcccatcggtcttccccctggcgccctgctccaggagcacctctgggggcacagcggccctgggctgcctggtcaaggactacttcccagaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttggtgagaggccagcgcagggagggagggtgtctgctggaagccaggctcagccctcctgcctggacgcatcccggctgtgcagtcccagcccagggcaccaaggcaggccccgtctgactcctcacccggaggcctctgcccgccccactcatgctcagggagagggtcttctggctttttccaccaggctccgggcaggcacaggctggatgcccctaccccaggcccttcacacacaggggcaggtgctgcgctcagagctgccaagagccatatccaggaggaccctgcccctgacctaagcccaccccaaaggccaaactctctactcactcagctcagataccttctctcttcccagatctgagtaactcccaatcttctctctgcagagctcaaaaccccacttggtgacacaactcacacatgcccacggtgcccaggtaagccagcccaggcctcgccctccagctcaaggcgggacaagagccctagagtggcctgagtccagggacaggccccagcagggtgctgacgcatccacctccatcccagatccccgtaactcccaatcttctctctgcagagcccaaatcttgtgacacacctcccccgtgcccacggtgcccaggtaagccagcccaggcctcgccctccagctcaaggcaggacaagagccctagagtggcctgagtccagggacaggccccagcagggtgctgacgcgtccacctccatcccagatccccgtaactcccaatcttctctctgcagagcccaaatcttgtgacacacctcccccatgcccacggtgcccaggtaagccagcccaggcctcgccctccagctcaaggcgggacaagagccctagagtggcctgagtccagggacaggccccagcagggtgctgacgcatccacctccatcccagatccccgtaactcccaatcttctctctgcagagcccaaatcttgtgacacacctcccccgtgcccaaggtgcccaggtaagccagcccaggcctcgccctccagctcaaggcaggacaggtgccctagagtggcctgcatccagggacaggtcccagtcgggtgctgacacatctgcctccatctcttcctcagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggtgggacccgcggggtatgagggccacatggacagaggccagcttgacccaccctctgccctgggagtgaccgctgtgccaacctctgtccctacaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaatgagtgcgacggccggcaagcccccgctccccgggctctcggggtcgcgcgaggatgcttggcacgtaccccgtgtacatacttcccgggcacccagcatggaaataaagcacccagcgctgccctgggcccctgcgagactgtgatggttctttccacgggtcaggccgagtctgaggcctgagtggcatgagggaggcagagcgggtcccactgtccccacactggcccaggctgtgcaggtgtgcctgggccgcctagggtggggctcagccaggggctgccctcggcagggtgggggatttgccagcgtggccctccctccagcagcagctgccctgggctgggccacgggaagccctaggagcccctggggacagacacacagcccctgcctctgtaggagactgtcctgtcctgtgagcgccctgtcctccgacccgcatgcccactcgggggcatgcctagtccatgtgcgtagggacaggccctccctcacccatctacccccacggcactaacccctggcagccctgcccagcctcgcacccgcatggggacacaaccgactccggggacatgcactctcgggccctgtggagagactggtccagatgcccacacacacactcagcccagacccgttcaacaaaccccgcactgaggttggccggccacacggccaccacacacacacgtgcacgcctcacacacggagcctcacccgggcgaaccgcacagcacccagaccagagcaaggtcctcgcacacgtgaacactcctcggacacaggcccccacgagccccacgcggcacctcaaggcccacgagccgctcggcagcttctccacatgctgaccagctcagacaaacccagccctcctctcacaaggtgcccctgcagccgccacacacacacaggcccccacacacaggggaacacacgccacgtcgcgtccctggcactggcccacttcccaatacagcccttccctgcagctggggtcacatgaggtgtgggcttcaccatcctcctgccctctgggcctcagggagggacacgggagacggggagtgggtcctgctgagggccaggtcgctatctagggccgggtgtgtggctgagtcccggggccaaagctggtgcccagggcgggcagctgtggggagctgacctcaggacactgttggcccatcccggccgggccctacatcctgggtcctgccacagagggaatcacccccagaggcccgagcccagcaggacacagcactgaccaccctcttcctgtccagagctgcaactggaggagagctgtgcggaggcgcaggacggggagctggacgggctgtggacgaccatcaccatcttcatcacactcttcctgttaagcgtgtgctacagtgccaccgtcaccttcttcaaggtcggccgcacgttgtccccagctgtccttgacattgtcctccatgctgtcacacactgtccctgacactgtccccaggctgtccccacctgtccctgacactgtcccccacgctctcacaaactgtccctcacactgtcccccatgctgtcacaaactgtcactgacactgtcccccatgctatccccacctgtccctgacactgtccctgacactgtctctcatgctgtccccactcatctgcgacactgtaccccacgctgtccccacttgtcctcaacaatgtcccccatgctgtccccacctgtccctgatgctgtcccccacactgtcccaatctgtccccaccactctcccccacgctgtccccacctgtccctgacactgtcccccatgccatccccatctgtcccgacaatgtccccagggtgtccccagctgtccctgatgctgtcccccacactgtccccacctctccctgacgctgtcccccacgtggtccccacttgtccctgatgctgtcccccacactgtccccacctgtccctgacactgtcccccatgccatccccatctgtcccgacaatgtccctatggtgtccccagctgtccctgatgctgtcccccacactgtccccacctgtccctgacgctgtcccccacactgtccccacctccccctgacactgtcccccacactgtccccacctctccctaacactgtcccacacactgtcccctcctgtccccaacactttcccccatgctgtccccaccagtccccaacactgtacaccatgcttttcccacctgtccccaacactgtcccccatgctgtcccctcctgtccccaacaatgtcccccatgctgtttcctcctgtccccaacactgtccgccactctgtttcctcctttccctgacactgtcccccactctgtccccacctgtagccaacactatcccctacgctgtctccacctgtccctgatgctgtcccccacactgtccccactcctccctgacactgtcccctatgctgtccccaccggttcctaacactgtcccccacactgtccctacctgtccccgacactttctcccatgctgttcccacgtgtctccaacactgtcccccacacagtctccacctgtccctgacactgtcccccatgctgtcctcacccatctctgacactgtacacatactgtccccacctgtccctgatgctgtcctccatgatgtccccacctctccctgacactgtcacccatgctgtccccacctgcccctgacactctcctccacgctgttctcacctgtccccaacactctcccccacactgtctccacctgtccctgacactgtcctccacgctgtccccacctatccctgacactgtcccccatgctgtcctcacctgtccccaacactctcctccacactgtcctcacctgtccccaacactctccccccacactgtctcaacctgtccctgacactgtcccccatgctgtcctcacctgtccctgacactgtcccccatgctgtcctcacctgtctctgacactgtcccccgtgctgtccccacctgacactatcttctgtgctgtccacatgctgttgctgccctggctctgctctccatgtccaggcctcagagcaggcagtggtgaggccctggcacatgggtggcatgaggggccggataggcctcaggggcagggctgtggcctgggtggcctgaggggtgagcaggcctcgggggcagggctgtggcctcgctcacccctgtgctgtgccttgcctacaggtgaagtggatcttctcctcggtggtggacctgaagcagaccatcatccccgactataggaacatgattgggcagggggcctagggccaccctctgcggggtgtccagggccacccagatcccacacacgagccgtgggccatgctcagccaccacccaggccacaactgcccccgacctcaccgccctcaaccccatggctctctgtctttgcagtcgccctctgagccctgacacgccccccttccagaccctgtgcatagcaggtctaccccagacctccgctgcttggtgcatgcagggagctggggaccaggtgtcccctcagcaggatgtccctgccctccagaccgccagatgctcacacaaaaggaggcagtgaccagcatccgaggcccccacccaggcaggagctggccctggagccaaccccgtccacgccagcctcctgaacacaggcgtggtttccagatggtgagtgggagcatcagccgccaaggtagggaagccacagcaccatcaggccctgttggggaggcttccgagagctgcgaaggctcactcagacggccttcctcccagcccgcagccagccagcctccattccgggcactcccgtgaactcctgacatgaggaatgaggttgttctgatttcaagcaaagaacgctgctctctggctcctgggaacagtctcggtgccagcaccaccccttggctgcctgcctacactgctggattctcgggtggaactggacccgcagggacagccagccccagagtccgcactggggagagaaggggccaggcccaggacactgccacctcccacccactccagtccaccgagatcactcagagaagagcctgggccatgtggccactgcaggagccccacagtgcaagagtgaggatagcccaaggaagggctgggcatctgcccagacaggcctcccagagaaggctggtgaccaggtcccaggcgggcaagactcagccttggtggggcctgaggacagaggaggcccaggagcatcggggagagaggtggagggacaccgggagagccaggagcgtggacacagccagaactcatcacagaggctggcgtccagccccgggtcacgtgcagcaggaacaagcagccactctgggggcaccaggtggagaggcaagatgccaaagagggtgcccgtgttcttgcgaaagcggggctgctggccacgagtgctggacagaggcccccacgctctgctgcccccatcacgccgttccgtgactgtcacgcagaatccgcagacaggaagggaggctcgagcgggactgcggccagcgcctgcctcggccgtcagggaggactcccgggctcactcgaaggaggtgccaccatttcagctttggtagcttttcttcttcttttaaattttctaaagctcattaattgtctttgatgtttcttttgtgatgacaataaaatatcctttttaagtcttgtacttcgtgatgggagccgccttcctgtgtccacgcgcctcctgcccccggtgggaagcacattcaggaggaggctggtccagctgcacctcgggggctccctgcatacgccccccgcctcctgcagccacacgcattgcccgagcgaccctccctggcccctgtcgctacatggacccccggggcttctcctcttttctacatggatgcagtttctcctcctgctgggcacggtgctgcctgccctggtcactctgcgggggacagggcctccagggaaagctgggtcgaggctgggagctggctcaggctggccaggcagagccacagggagggccttccagaaccaaccatggtccgaagcgagaggtgggtgtcagatctgtgtgcgtcagctcaggaccacagcggggcggctcccacagcagacatggatcctcccaggcctagagaccaggaatctgagatcaggatgcaggcagggctggtttctctcaagccctctctccttggcttgtagacaccgtctcctccctggtcctcacgtggccatccctctgtgtgcccgtgtcctaagcttctcttcttataagaacacacatcagattagattagtgaccccctatgaacttaatgacctctgtaaagaccccatctccaaatagtcacattgtgaggccagggattaagacttgaatatatgaatttgtaggggccacgatttaacccatcacagtccagactctggcccccaaaattcatgttcttctcacatgcagaatacattcatcctgtctcagcatccccctgggcactaggtcatgtagcaaggacggattttcaacagaaataactattgcaacagaagaaagagtccggcatgacctggactcaccttcatctgtgcagaggccacagccttgtaaagggaggtggtagggggagcagggtgggtgctcggggctcagtcgtcggggaagggaaaagttgcccagcgctggtcagcgtccccgggatgggacccgctgtgtccgtgccggccactgttgaggtcaggattctgtcctcccagagcctggagacacaggccccatccttcccaatggggacacttcagggagcggctctcaggtcccgagaaagaccctcctgggtcacaggaaatgcacagacatcgggaacagacagaaggacgtgtggttgcggccctctcagcagataccctgagaaagggaggtcggggttggtccaaacggtgagttctggtgcacggagctttctcaggcaggtgttgacggggcaggggtcggcctaggggtacggccagaagctgttagaaactgttagtgtctgctcaagtctttacaagccaaggttgaggccgagtggagaggctccgaggagcctggctggaactcagtcaaggacagggtcttgttactgcagtggctgcggtggctgcggtggctggaaaatgccgtcggagttgcctgtggcaggagagagaccatctcacccaggaaggaggagtggttggattcgtttgtgtggcatcgagcagctggagcttcaccaaacacagagttggggactaaatccccagactccaggccctgccatgccgtgggaaggctcgccactggagggtgggctccagggggcctggcctgaactgggtgctgaagcccagccctttaactctcaggacacgctgctgcagccccgcggggggtgagggagacagcacctggggtgcagggcgggcagctgctgcatcaccggctctatcccaagcccaaggatggcgtcccagagatgcaggagagctttgtccagagaaggtgccagccctcagggaccctgctggagagatctccaccctctgcccttcaaggggccctacgggcttccgggtgccctggtggggtgggctccagtccactgtctgaggatggacggcctggccaggataaggaaaggaaacccaggacggtgccgggctccgggtcattccgtgcactgagcaggctgagttgggaagaagcagatgcttcctgcagctcctgcccctgcagggcctggcgcctggaccaggttcccctggggaaattgggcccctccctgagccacccggggcccaccgccccctttccacctgggaccgagcatcctccagagggtcagccctcctgagggaacaccatgcccagccccaggaccctccctcaactctccagcaaggctgcactgtgggcggcccctgcacataccccagcagtccatgctgtgatgtaacatgacatggtgtgacgtggtgtgatgtctctggtgtgacgtggatgtcatgtggcatgatgcgacaggacatggtgtgatgttgtatgatgtggtatgacggtgtgatatccgaggggtgatgtgatgtggtgtgacatggtgtaatgtccctggtgtgaggtggcgttggacatgctgggatgtggtgtgacacagtgtgacatccctggtgtgatgtggtgtgatgaagcgtaacaggctgtgacatagtgtgacgtggtgtgatataatgtgatgtggtgtgaggtggcgtgacatggtgggatgtggtgtgacatggtataatgtccctggtgtgaggtggtgtgatgtggtatgatggggtgtggcagggtacgacatccctagtgtgatgataagtttcatggtatgatgtggcgtgacatccctggcgtgacataatgagatgtggtgtgacatggtgtggcattcctggtgtgactcctgtgttctgacatttgtggccaccccaggatacagaggtccctgtagccaagggaagggggagaatagaaccatctgagcatgttgacctggaggaattggtggcccttgagtccacgaagcccaccctgccaggtgcccctgccccacgtgacccaagtgggcttgcagagcagcaagcaggactctggttagactgcaagaaggacctgccaccacgtggccttgtgaggagacacagagcaaggcagtgacctcagcgtccacccagcacagggtgctgctgaagctcctcctgtcctctcagcagcggtctcagagcaaggcccaaggcaggctgaagagaggggcagagggaggatgctggggaggcaggggtgaggggagtgagagcccaggtttcagctgagcccctgcacagggaaggaggctagctgaacacccatctccccacacactcccaaccctgcctctgcccgaacacctcccagaaggcacctcaaactctgctacccacactcagcaaggggtatggtgtccccaccgagtccagccagtgaggcccggcacagccatgcctgtgccgaccactcccatggccaagctccctgctaacatggtaggacagagccaggcctggaggagacagaacatcagtcccatggggaagctccctgctcacatggcagggccgggcctggaggagacagaacgccccgtctggtatggtactcaggctgcacatgcctgccacgcacgggggccatgtggcacacacgggtactcacacggtcctcacacagggacacacgcacttgcaaccccagcacccacccagtgcactcatgcacgggctccccaggtgggtcacagtctcacgccttgagctactccatgtgccaggcccttcacccacattcccgtccccggtgccagctgttgagccacaccgtcttctctgtggatccctcccagcccgctcagcacaatggacatgctctctccagtccagcaactgcactggcctcttcccctcagaatccacgtctggccatctcccaggaaacccggaccaccacgggcagggaccaccttctcactgtccatgtggaccaccccacacctgaccccaggcagagtcacactacgacctgcttcaatattgaaaaggggaaaagctggaggaggggaaagatgaaagagaaaaaagcaagaggggagggtcacattcttgtgaggctttgattagagttcactgagcccccacgttgcatgaaaaggaggggtggagggagcaattacgcattcgccttgtgctcagtaaatctgcactttataagcaaataaacagagtagaggaagaagtcaaatatgcattcgtctcaggggtaggaggaacgatttcttgtctcattttgtcccatgtcatgaagaccggcctgttaatttatattctcagggtgagggaggccacctgggtagacctggcctatctgctgctgctatcactttggaaacaaaaggaaaggcatgactttttttttttttcatgactcagcttcccacctcaactgttcattttggcatagtgagtttggagtcctgagattttattttcctttcacaatggtcaaggtcgcaccctcagtattcaggagagctggtccaacccagacccctgccgtccctggacgcttttcaaatacgtgctgcagtctctgacactctctcaccatggtagaaactgaggtcttggtgagcctgcaagcccctgctcatggggacaatgcaggctgaaacccgcatttctgaccccaaagctcctgttcctttcactcacccccacaccagctctttgagtccagagctttgtccttgcctgagtcctaccctcagggacaggggcccaacccagacaccaacacatcataccctgagagggtgccaggagcccagagatgtttggagagcacagaagccctggaggctctgtggagatgctgcacatttctctattcaacagatactcaccaggtggccagcggcagagatgccacatggcatggagctcgccttggccaacaggacaggtgtggggttgggaggccttcccagggcactccttgaagcagagctgtggggaaaagttggggccaacctcagatctcctcatcaacaccggttctcctgccctcctgggccacagaaaactaagctccctggatactgcggctgggtggggccatgagggagaagaaatcacaacgagttaaaagatcattttctaaaactgttatgatcaggactcacataaacatatgacgacacatttcagagatgctctttatctcattaattaaggtgtcgtaaccagttcaaagtggaattctaagtactacacttacataattgattcaggaatgctaaaaggagttcatagatagatgcaaaactggccttttccctggaagatgaggagcaattcattgtccttccaaaggtgagaacttgaatttctaccaactcaaagagcttttgcattgctatcaattatgtacaacttagagcagtagtccccaacatttttggcaccaggaaccagttccatggaagacaatttttccacagaccaggatcgggggatggcttggggacaaagctgttctacctcagatcattaggcattaggatttcacgaggagtgtgcaacttagatctgggaatgtgcagctcgcaatagggttcgctcctatgagaatctaatgctgccactgatctgacgggaggtggagctcaggcaggaatgctcacacacccctcacctcctgctctgtggcccagttcctaacaggccatgagcagattccagtgcatgacccaggggttggggacccctggcttatagaggtgtaaaatagttcaaaggaaataaaagatgcagagctccatagaatgaaataacttggaagagtgtacaagacgatgccttgctttccatggaaggcacctactaatcttttggtccatttcagttcttcttaatgcttcctataaacatatataactgactgacacaaacagatccataatataaagaagaccactgtaaaccaatgagaaaaaaaatcaaataatccaacaaggaataggcaagagaattgaacagatgttttacagaagatatccaaatagccactaaacatatgaaaagatgttgaaccacactagtcaacagggaaatgaaaatgaaaaaccacatgagagaaagtagttctgattccaataattctggagcagctaatatcagactagccctttggcagatggcaattataaacactagaaacgctgtaagcacacacaacacccacacacaccaattgcaggcactggaacatgaccagaagtaggcaaacactagtaaggattattccgttaaatattcgtctgaagtcacactccagggcatgtaatgggtacagctagagttcaagcaggaaactgcagccctcctggtgaggagtgggatgccgggctacattttcagagcagctggaaatgaagagaagatgtccataaaggagaaggtcaccgaagggaaaccccacaatctgcaagtaaactccactgaaacctctggctgatcccttaggtgtgcatgggtagggaaaactccaaagggcccagcagaaagcaacacgtgtaaggtcaagagaactgagattccagctactgccaactgccaggcagacagactggggagtttgagtcaactcaagctaactgcttgctaacattgaaaaaaacaattaatgttctgctaaggaagaatgcaaaccccatagcctgtacacatgttaacaacatcaggtgcacatccaaaattaccaggtatgcaaagaaatatgaaaatgtgatccatagttaaaagaaaaagggatcaatggagatcaactccaagatgacctagatgcagatacagttatcagacaaggactttaaagaagttatgttaaatatgttcaaagacttaaaggaaaatatggttatcatgagtgactagatgaggtatctctataaaaaactgaaaatagttacaagaagcaaatgaaaattctagaactaagagtatgattcggaaatgaaaaacatcatttgaccaggcccagtggctcatacctgtaatcctagcactctgggaggccaaacatggaaggatcacttgatctcaggagtttgagaccaccctgggcaacatggtgaaaccccatctctattttattaaagaagaaaagaaagagaaaaacattacccaagtttaataacagattggacaagacataagaaggaactgaaaacttaaagatgcatcaatagaatatgtcaattctttttaatccaatccaaagaagagagagaaaaatactaaaaaatgaaaagagactcatcctgctggacaaggtgaagcattctaaaacatgtgaaactggagtccagagggggatgtaatacttccatgggaaaggtcaaccctaagctatatgcaaatgtacctgcgtaggctggtgtggtgggctgatggcatctccctggccaaatgtatgcccacctggaacctcagaatgtgaccttatttggaaatggggtctttacaaattaggttaaggacttgagatgatatcatactaaattttggatggatcccaagtccaaacactggtgtcctcataagaggagaggacaaagacatacatggaggtaagccatatgatgacaaaggagaagatgagcggtgtgtcaggagccacctgtgtttgtccatttgcattactgtaaagaaatacctgaggctgagtaacttatgaaggaaagaggttcaattggctcacagttctgcaggctgtataggaagtatggcaccagcatctgcttctggcgaggacctcaggaaacttacagtcatagcagaaggtgaagggagagcaggtatgccacatggcaagaatgggagcaagaggctgagggggggccccagacttaaacaactagactgtgtgtgagctgactggggcagaattcactcatcaccaaggggatgattctaaatcattcatgagggatcttcccccttgatctaatcacctcctaccaggccccacttccaacactgggaatcatattacaacatgagatttggaggggacaaatatataaaccatatccttccacccctggtcccccaaatctcatgttgcaaaatacaatcatgccttctcaacagtcccccaaagtcttacctcattccagcatcaacccaaatttcccaagtcccaagtctcatctgaagatgagtcccttccacctatcagcctatgaaatcaaacacaaattattgactcccaaaatacaatgagagtgcagacattgcgtaaacattcccattccacaagggagaagttggcaaaaagaaaggatctacatgccccatatatgtcagaaatccagcagggcagtcattaaatcttaaagctccaaggtaatctcctttgacttcatgtcccatatccagggcacattggtgcagggggtgggctcccaaggccttggaaaactctacccttgtggctttggaggatgttgcccctgtggcttctctcacatgatagagttgagtgcctgtggcttttccagattcagggtgcaaactgccagtggatccaccattctggggtctggaggacagtggcccccttcccacagctccactaggcagtgccctggtggggacattatatgggggttcaaccccacattctctttggcactgctctagtagaggttctctgtgagggctccatgctggcaggaggcttctgtctgggcacctaggctttctcatacatttctgaaatctagagggaagatgccaagcttccttcactcgtgtattctgggggcctacaggcttaacaccagatggaagtcaccaaggcttatagtggcttgcactctccaaagaagcagcctaagctatacttggggccctttgagccaaggctggagccagaggaaccaggatgtggagagcagtgtcccaaggctgcacaggcagcagtggccatggccatggcccacaaaaccatcctttccctcttggcctctgggcctgtgatgggaaagaccacctcagagatttccaaaatgccttcaaggccttcttccctttgttctggatatgagcacttagctcccttttagttatgctaatctctctagcaactggctgctccatagcctacttatatttgtctcctgaaaataccttttcttttctaccatatggccaggccatgaattttccaaattttttatgctctgcttccctttgttgatgaaaaaagccaaactctataaaacacttgacgagattgattctgagccacatgtgagagccatgaactgtggcacagcctcaaaaggtcctgagaacatgtgtgcaaggtgcttgggttgcggcctggttttatgttttagggagacatgagacatcaatcaatacatgtaaagtatacattcgtttggtttggaatggcaggacaattcaaagtggggaattccaaatcataggtggatttgaagattttctgattggcaattggctgaaaaatttaaattatctaaaaagttgaagtcagcaaaaagcaatgcttaagataaagcaggttgtggaagccaaggttcttgttatgtagatgaagcctccacgttccagagagaagagatggtcaatgtctcttatcagaacctaaaaggtgccagactcttggataaatctctcctgaatcaggaagagacctggaaagggaaaaagattctcgacagaatatacatttcctccacaagagacggctttgcagggccattccaaaatgtgtcagagaaatatattctggcataaaatactttaatttccttccatgcctgccaactgtcatgtgatgctataccagagtcaggttggaatttgatatcttattgctacaaagagtctgctttgtcagtcttaagctccctgttttaatgttaacaccggtcagctgagcctaaactccaacagggagagggtatagtgagggagtccaaaccaccctccccttcctgtcatggcctgaactggttttccaggtttctttggaatccccttgcattagcattttattttttcatttgcaccttttaaatatcagttccaactttaagtcattcctttgctcccatatcttaccatagactgttagaagcaaccaggtcacaccttagaaatgtctgcttagaagtatcttccaccagatgtcctaagtcatcactcttaaggtcaaacttccacagatccctagggcatgaatacaatgcagccaagttgtttcttaggatttaacaagcgtgacctttactccagttcccaataagttcctcatttccatctgagatttcatcagcctggctttcacagtccatatgtctatcagcattttggtgacaaccatttaatcagtctctaagaaattccaaactttccctcatcttcctgtcttcttctgagtcctccaaattcttctaacttctctgcctgttacctgattccaaagctgcttccaaattttcaggtatctttatagcaatgttccactcctcaataccaaatttctgtgttagtttgtgttactagaaaaaaaaatacatgaggctagtaatttataaagaaaagaggtttaggccaggcactgtggctcatacctgtcatcctagcattttgggaggcagaggcaggaggatcacttgagctcagaagtttgagaccaacctgggcaacatagtgagaacttgtcttgaaaagacaagaagaagggaagggtggggaagagcagaagggcagaagggcagggcagaagggaagggcagggaaggcagaagagaaggaaggaagggaggtttaattagttcatatttctgcaggccgttctggaaacacggccctggcatctgcttctggcgaggcctcagggagattgcaatcacagcagaaggcgaagggggagcaggcatgtcacatggcaagagggagcaagagaagaaagtggcacgtcccagacttttaaacaaccagctgtcacagggactaactgagggagaactcgctcatcacctgggagatggtgctaggccattcatgaggggtccagccccatgatctaatcacctcccaccaggcccacctccaacactgggaatcacatctcaacatgaaatttggagagacgcacatccaaactattgcaccacaggaagctggaagaggtggacggtcctcccctggagcactcagagacagccaccaacaccttgatctcagatttctgactcccagaactctgaaaaaatttttgttgttttaagccacatttgtgatattttgttacggcagccacagcacggatatagctggtaacagagttctttagcctccaaaatacaagcctggggtaaataactattgaatttggccacatggaaatcaggaagaatgtaataagcatcatcgatggacgggatgacctgggagatcgtggcaagtttaaagctaattggaagttggcaaccaaaaaatcctgtcttgcaaatggccaggaaattgccaagaaaacctttagaaaacatggttaaagatggagaaacccggatgactccctggtttctgaagaggtgcttaggcattgaagtgagactgatgagacttcacactgtacccttcagaagggcagacactcacgagataatcaaccacggctccctcgctgggaggcagacacagagctggaggcggcggccacaaactaggtgggcagagaggcgtcagcatcgggacttgcgggaggccctgggaaggaacaggcagcggtggggcctggacagccctggggaaaggaagttacttggaggagaccaggggcttgcatttgggccaaaaccaaggacaagagatcagctggtcccagggaactctggagcccaacaccccaccacgggtgcaggggcctgacaacccaacagagggctgtgggcaccgggcaccagcctgtggggggtctgaaggctgctgcccagccacacatgtcctggttctgaacaaagggttcaagagacacctggaaacctacccttctgagagcagcctcttagcctcagctggtattggcccctggtcaccccacatgccccgacagtggggcctggcctcagaaaggggcccctccatttgtactttctatctgatccttgacacagtgctaacaccaaagaccaaacccgaatcttggttcacatactctgcaaagaaatgactaagacaagttcttccggaggtcagttttagaacattattctgacttaattctgccttatctctgtgcaacaagaaaactatctgcacatctgtagtaaaatgtgaaggtaccttcattttgtttgtatactaaacttttaagaaatacctcactttttaaaacttggttttgtgttttgtatgcttataatattttccataatagatcattttaatgataaactctgaatcttctgacagaatgcagatcaatggattcctggccatcagggaggcgttgattgcaaaggggcctggtggaatatttggagagattctacatcttcttgcaactgttcatctggattacggtggtggttgcatgagtgtgcatttgttgaaactcacatgtcacaggatggattatactgaatgtaaactacacttgcgtaaatatgacttttaaaactttaaaaagttgggggatggttcactgccccggctcgaagccccctggccacgctgcctggccagcccacccgcatccctgccagcgcttgcctccagcgtcccaacagcctcctgaccccctgggctgctctaaaccctcaggagcgcagccatccgggatcagctggatggagatggggagcccgagactcgtgccacaccacgtcctcccacccccaccagccacacgcagacgtcaaagcagcactgtcctcgcacgcgctgctcccacccaccctggcatggccattccaggcctggggcaggaaggcagatgctccccctgcccccagacacaagcattcctgcacatacccccagcacacacacacactcccatgcgcacactgacacacacaggtgtgtgcagctgagacacagcccattcccaggcagtccagcccccgtcactgagggaaaggggcagcaccacggggccacaggagtggcagctggacacagagccaggcgctggcgaaggcccaggccactgaggcgggctgccggcatggctgggcgtgaaggccagaagagggcaggaggggccgtaggcactgtgcctattgggcctaggtgggcacacgcctggcaggagaggaacagcccagcccctgaggaaggggtgggggcaggggccatttctggaggccagggcagggccagcaccccaaggaaaagcagagcagggtgagaacggacatggggctcagagctgagcaggcctgctgggccccaggagggagacacagacgaccggggatctcaaggctggcagaggccagagatggagccccacctgggatgccatcctccttcctgggggcccaccctgcccggcccctccagcccagcacagcttggggcattggatagaaccgggagagagccgaccaggcactgaggcccctgccccaaatgcccacagcctggggaaaatgagcaggtacatgggaggggcaagtggagccccaggcacacccacacagtgcacacggcctcacctgggccggagggggcaggaggctcgccaccccgctgtggtttctctcctaatctcaccctgggtttctgccacacttgatgcaggtgatgtttctctgacattgtggactaagagttggtgctggaaggggttagccatcttggagatgttgctatggggtgcagggattttgcgtgtgagaaggacatgattatggggggagcggagggcaaactgtcatgggttaaaatgtgtcccctataaattcatgtgttgaagtcctaacccccaggaccacagaatgtgaccttgtttggaaacagtctttgcagctgcaatcaagttcagatgaggtcaccctggagtagcgcaagcctctgatccaatatgactgctgtcctcatgaaaagggggaatctgggcacagacagcacgtggggagaacgccctgtgaagatggtgctgcttccataagccaagagcagcagagacggccggcaaagcccagcagcagggagagagcctgggacagagtctcccatgacacagaggtgccagccccaccgaggcctccatcccagatgcccggcctccagaaccaggacggaataaacgtctgttgtttaagccacgcagtctggggtgctgtgttgccagggccacagttaacggatacgagtgttgtcctgagctgccagccccacaggctgcacgaggcctccctgccccagcccagtgcagactccccagccccctgggtgtgccatgggcagtgcggggacccctcactccgtcctcccccagcctgggaggttgagcccattatgagctccatggggtgaagctggaacgagaggctgggagccgactgggagcctgcggctggaggatggatttccccagggacccacacgtgcacctccacctgtctcctggacattctctctgagggcagggctggtgccagctcagggatccagcagggtcacaagggcaggccgggtccttgtggagagcacatttagtgggagggacatgatttcccttcaaagtgcccattctggacgcttcccgttccatgctggacgcttcctcttccacgctggatgcttcctgttccacactggatgcttcctgttccacgctggatgtttcctgttacactctggatgcttcctgttccacactggatgcttcctgttccatcctggatgcttcctgttccatgctggacatttcctgttccactctggatgctccctgttccatgctggatgcttcctgttccatgctggatgcttcctgttccatgctggacatttcctgttccactctgcatgcttcctgttccactctggatgcttcctgttccatggtggacgtttcctgttccactctgcatgcttcctgttccatgctggatgcttccttttccattctggatgcttcctgttccatgttggatgtttcttgttccactctggatgcttcctattccattctggatgcttcctgttccatgctggacatttcctgttccatgctggatgctttctgttacatcctggatgcttcctgttccatgctggatgttttttgtttgactctggatgcttccagttccattctggatgcttcctgttccatgctggatgcttccttttccattccgcacaattcctattccattctggacacttcctgtgcgacacctccttgggttttctgtctgcccagtccctctatcctcatcccgttccctgctacctcccacctccacaatcgtccttgcccagctcctccctctctctagagcttcggcctggcaaggtccctcctgatctcagtccaggctcccccagcacaggtaggagcctagcacctgcccttggacctccccaccctgcatggtgccagcatcccccggtccccagggaggccccatttctctctctgcttgtagtccagtggccctggagtcccactgcaactcgggtgtgcccctgacctctgaggaagttaagtgtcctgtccctagccaggctatcccgtctgctcagccccagggccctgcccccaaccccttcccctcacctgcaccacaggctctggccaactctgcccaggccctgaatgggcccctctggctcccctctgctgctacactgccctgcaccacctccactcagcttcagtgtgttcatccacctgtcccaagtcccctcggcccccaggagcacagctggtggccctggctcctggcagcccatcttgttccttctggagcaccagcctcagaggccttcctgtgcagggtccacttggccagccctgggaccctcctggtctcaagcacacacgttctccctgcagccagacctgcccctgcctgtgagctcagccctgagccttggaatgccttcccatctccatcccagctcgcctttgccagctgctcagcaggatgaactcacactcccctccctgcaccatgagtcagagccagctggagacacgcccaggccaaagcagccaccagggcctagtgggggccagaagcttcagatgagaggcccaggtattgagaggctgagatcacgggcagaatggtcataatcgctgccagtatcagtccagccccagggactcagagacagagaaaagagcagcacacaaggtctgggctccccaccttctcccgtgagtacgggggagtatgggggcagccaccacccccatccccacacacccatgaggcagcctcggctgtgtctggactccccctcgccctctgacccagaaaccaccagaagaaaagggaacttcaggaagtaagtggtgccgccggtttcaatcctgttcttagtctttgcagcgtggagttcacacacctggggacctgggggccgagctgtgatttcctaggaagacaaatagcggctgacggcaggggcggggctgcccacatgtacctcgccagaacaggaagggctgagacccccacctcggtgagtggggtcagcacagggcaggggcacaggctcgggaggaggacagagcctgggggcagccgtgggcgctcctggacctgagatgctgaacaggctccaagaggctggggagacatggggtcgaggccggccccacatggaggcccaagcggagccagcacgggggaggtgggcagccttcaggcaccgatgcccacccagtgcgagacgacggggaccgtgggcaggggcttccaagccaacagggcaggacacaccagaggctgactgaggcctccaggacgaccgggctgggagcacgaggaacatgactggatgcggcagagccggccgtggggtgatgccaggatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcaggtgagccgggagcagagcagggagggtgagtgtggcagcaggacaggagggtggaagccaaggagcccagaggcagaggcagggacaggggaggcacaggggctgggctcagagccagctgatggggttggggcacctgctggcggggagcagggctgtggtcagcagtggagaggaggggagagctgtgctgagtgcacgggcgggagaagggaagagtccagggaggcccagaaaggcccagagtgcagcaggcctggggcgaggggaagggctgaggctccgtgcgttcagggaactgacccagcagagcagaggccactgaggagctgaggttccagagaggcttccagagcaggagcagtgcagggacaggaggatccgggagctcattcaggaggggcacatgggcaagggcaaggggctctgttggggagacctgactggacactggggctgctccacagcatagggaacacgccaagtgctgcaaaatcaaaaatgagggcagaaaaacagcccaaacctggacagagggtgccaggacaggcaggggggcaacagtgacctgagtgacattgctgcccgggttgagggagggcagagtgagcagggagcaggcattggagctcagggaccaggaccaagcagccacaggtgagcagggcaggtgggggcagaaggagcagggggcacctcctggagctcaggggaccagggcagagcagcctcaggtgagcaggggctggtgggcggcaggatgagcagggggaagaccctggagctcaggggaccagggcagagcatcagaaggtgagcatggctagtgggagatgggcaagcagggggcagcccctggagctcaggggaccaggacagagcatcaggaggtgagcatggctagtgggaggtgggcgagcagggggcagcccctggaactcaggggaccagggcagagcagccgcaggtgagcacgggctggtgggaggcgggaggaacagggggcagctcctggacttcaggggaccagggagggcatctgaaggtgaacaggggccagtggggggcaggatgagcagggggaagctcctggagctcagggagccaaggcagagcagccgcaggtcagcaggggcaggtgggaagcatggggagcaggtgggcagcccctggagctcagagagccagggcagatcatccacaggagagcaggggctggtaggaagcaggaggagcaagtgggcagcttttggagctcagagcaccagggcagaagagcctcaggtgagaaggggcaggtgggaggcagaataagcaggggacagcccctggacctcaggagaccagggcagagcatcacaacgtcagcatggctggtgggaggtgggcgagcagggggcagcccctggacctcagagagccagggcagatctgcaggtgagcaggggcaggtgggaggcaggaagagcaggaggcagctcctggagctcaggggatcagggcagagcagccacaggtgagcaggggcaggtaggaagcagaaagatcaggggtcagcccctggagctcaggggacaaggggagagcatcagaaggtgagcaggactgaggctcagcctcagggagccagggcagagcagctgcaggtgagcagggccggtgggaagcaggaggagcaggtgggcagcccctggagctcagagagccagggaagatcatccgcaggtgagcaggggctggtgggaagcaggaggagcaaggggcagctcctggagctcaggggaccagggcagagcagtcgcaggtgaacaggggcaggtggggggcaggaggagcaaggagcagctcctggagctcaggggaccagggcagagcagtcgcaggtgaacaggggcaggaggagcaaggggcagctcctggagctcaggggaccagggcagagcagccgcaggtgagcaggtgcaggtggggggcaggaggagcagggggcagctcctggagctcaggggaccagggcagagcagccgcaggtgagcaggggcaggtggggtgcaggaggagcagggggcaggcactggagctcaggggaccagggcagagcagtcgcaggtgaacaggggcaggtggggggcaggagtagcaaggggcagctcctggagctcaggggaccagggcagagcagtcgcaggtgaacaggggcaggtggggggcaggaggagcagggggcagctcctggagctcaggggaccagggcagagcagccgcaggtgagcaggtgcaggtggggggcaggaggagcaggggtcaggcactggagctcaggggaccagggcagagcagccgcaggtgagcaggggcaggtggggggcaggaggagcagggggcaggcactggagctcaggggaccagggcagagcagccgcaggtgagcaggggcaggtggggggcaggaggagcagggggcaggcactggagctcaggggaccagggcagagcagccgcaggtgagcaggggcaggtggggggcaggaggagcagggggcaggcactggagctcaggggaccagggcagagcagccgcaggtcagcagggccggtgggaggcaggacgagcaggggacaggcactagagctcagggcaaggcagccacaggtgagcagggctggtgggaggcatcactcagctcctagactttggcaggagctgggtagttgctggcaacagacagctgagggctggtgaaagtgcagtgcagcctcctggtgccgggaagggagtgtgagtccatcccactgagcagttggcaagggcgagctgggatggagaagggaaggcgttccagggctcagggctgagctctcaggcaggggcaggtgtggctgcagggggaacgtgtgcttgagaccaggagggtcccacggctggtcccagcggaccctgggcaggaaggcctctgaggctggcgccccagaaggagcaagatgggctgccaggagccagggccaccagcacaatgaagctgagtggaggtggtgcagggcagtgtagcagcagagggcagccagaggggcccattcagggcctgggcagagtcagccagagcctgtggtgcaggtgaggggaaggggtggtgagcggggccctggggctgagcagaggggatggcctggctgagggcagggcgcttagcctcctcagaggtcaggggcacaccccacctgcagtgggactccagggccactgggccagcggcagagagaaatggggcctccctgtggcctgggggtcctggcaccatgcagggtggggagggccaagggcaggtgcaaggctcctacctgtgctggggggcctgggttgagcccagcagggaccttgccgggggaagctctggagagagggaggaggtgggctggtggccgagaaggccaggccagggctgggagggtgacggtgtggtgactgagcctccagaagtaatgcaggacactgggaggcagggggcatccaggcactcagggccctgacctgggctgctgcacactggggctaaggggaaaggaggggagaggctgaggaggaggctccaggaggctattccaaggcagggggttccggggccctggggctgaagggcgccgaccctatgcagtgtctggcccctctgctgcacagaagaaaagggccttggagggcagagggcaggctatgaccagggccctgggcaagtcaggccaactcactaggggagggccacgctggggcggcagggtcaggggcttcagggggctcgggggacccacgagaagccatctgagaacagtgtccactggtcaagccaggcacccataaaaggctggagtggggccaatgggcatgagccgtccctgaggtggcaccgatggccagagctgaggccaagctagaggccctggactgtgctgactcccggcagacacagagcgctgacctggctgccgagccccgcctcctaggctgcaggggtgcctgcagaagggcaccacagggccaccggtcctgcaagctttctggggcaggccgggcctgaccttggctttggggcagggggtgggctaaggtgacgcaggtggcgccagccaggcgcacacccaatgcccgtgagcccagacactggacgctgaacctcgcggacagttaagaacccaggggcctctgcgccctgggcccagctctgtcccacaccgcggtcacatggcaccacctctcttgcagcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttggtgagaggccagcacagggagggagggtgtctgctggaagccaggctcagcgctcctgcctggacgcatcccggctatgcagccccagtccagggcagcaaggcaggccccgtctgcctcttcacccggaggcctctgcccgccccactcatgctcagggagagggtcttctggctttttccccaggctctgggcaggcacaggctaggtgcccctaacccaggccctgcacacaaaggggcaggtgctgggctcagacctgccaagagccatatccgggaggaccctgcccctgacctaagcccaccccaaaggccaaactctccactccctcagctcggacaccttctctcctcccagattccagtaactcccaatcttctctctgcagagcccaaatcttgtgacaaaactcacacatgcccaccgtgcccaggtaagccagcccaggcctcgccctccagctcaaggcgggacaggtgccctagagtagcctgcatccagggacaggccccagccgggtgctgacacgtccacctccatctcttcctcagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaaggtgggacccgtggggtgcgagggccacatggacagaggccggctcggcccaccctctgccctgagagtgaccgctgtaccaacctctgtccctacagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatgagtgccacggccggcaagcccccgctccccaggctctcggggtcgcgcgaggatgcttggcacgtaccccgtgtacatacttcccaggcacccagcatggaaataaagcacccagcgcttccctgggcccctgcgagactgtgatggttctttccacgggtcaggccgagtctgaggcctgagtggcatgagggaggcagagtgggtcccactgtccccacactggcccaggctgtgcaggtgtgcctgggccgcctagggtggggctcagccaggggctgccctcggcagggtgggggatttgccagcgtggccctccctccagcagcagctgccctgggctgggccacgagaagccctaggagcccctggggacagacacacagcccctgcctctgtaggagactgtcctgttctgtgagcgccctgtcctccgacccgcatgcccactcgggggcatgcctagtccatgtgcgtagggacaggccctccctcacccatctacccccacggcactaacccctggcagccctgcccagcctcgcacccgcatggggacacaaccgactccggggacatgcactctcgggccctgtggagagactggtccagatgcccacacacacactcagcccagacccgttcaacaaaccccgcactgaggttggccggccacacggccaccacacacacacgtgcacgcctcacacacggagcctcacccgggcgaaccgcacagcacccagaccagagcaaggtcctcgcacacgtgaacactcctcggacacaggcccccacgagccccacgcggcacctcaaggcccacgagccgctcggcagcttctccacatgctgacctgctcagacaaacccagccctcctctcacaaggtgcccctgcagccgccacacacacacaggggatcacacaccacgtcacgtccctggccctggcccacttcccagtgccgcccttccctgcagctggggtcacatgaggtgtgggcttcaccatcctcctgccctctgggcctcagggagggacacgggagacggggagcgggtcctgctgagggccaggtcgctatctagggccgggtgtctggctgagccccggggccaaagctggtgcccagggcgggcagctgtggggagctgacctcaggacattgttggcccatcccggccgggccctacatcctgggtcctgccacagagggaatcacccccagaggcccaagcccagggggacacagcactgaccacccccttcctgtccagagctgcaactggaggagagctgtgcggaggcgcaggacggggagctggacgggctgtggacgaccatcaccatcttcatcacactcttcctgttaagcgtgtgctacagtgccaccgtcaccttcttcaaggtcggccgcacgttgtccccagctgtccttgacattgtcccccatgctgtcacaaactgtctctgacactgtcccacaggctgtccccacctgtccctgacgctgtcccccatgctctcacaaactgtccctgacattgtccccaatgctgcccccacctgtccaacagtgtcccccaggctctccccacatgtccccgacactgtcccccatgctgtccccatctgtccccaacactgtcccccaccctgtccccctttgtccccaacactgtcccccacagtttccacctgtccctgacactgtcccccatgctttccccacctgtccctgacaccatcccccactctgtcccctatagttcctggccctgtcccccacgctgtcccctacagtacctggcactgtcccccatgctgtcccctcctgtatgaaaccctgtcccacatgctgtccccacctgtccgtgacaatatcccccacactgtccccacctgtccccgacactctcctccacgttgttcttacctaaacccgacactttcctccatgctgtccccacccatctccgacactgtaccccacgttgtccccacctgtcctcaacactgtcccccatgctgtccccacctgtccccaacactctcctccatgctgtccccacctgtccctgatattgtcccccatgcagtctccacctgtccccaatgctgtcccccaggctgtacctaccagtacaacactgtcccccatgctgtccccacctgtccctgacactgtcccccacgctgtcccctcctgtccccgacactgtcccccacactgtccccacctgtccccaacactatcctccatgctgtcccctcctgtccccacctgtcccctacactgtcccccatgctgtccccaccagtccccaaaactttcctccacactgtccccacctgtccccaacactgtcccccacgctatcccccctgtccccgacaatgtccccactgtttcctcctgttccctcctatccctgacactgtccgccatgctgtccccacctgtccctgacactgtctcccactctgtcccctataatccctgacactgtcccccacgccgtcccctcccgtatgcaccactgtcccccaagctgtccccacctgtcctcaacacagtcccccatgctgtccccacctgtccccaacactctcctccatgtccccacctgtccctgatattgtcccccatgcagtccccacctgtccccgatgctgtcccccgggctgtacctaccagtccaacactgtcccccacactctccccacctgtccctgatactgtcccccatgctgtccccacctgtcccggacactgttctccacgctctcccctcctgtccctgacactgtcccccacactgtccccacctgtccccaacactatcctccatcctgtcccaacctgtctcctacactgtcccccatgctgtccccaccagtccccaacactgtcctccatgctgtcccccatgtccccaacactgtcccccatgctatctcccctgtccctgacaatgtccccactgtttcctgtcccctcctatccctgacactgtcccccatgctgtccccacctgtcccccacatggtctccaccggtccctgacactgtctcccactctgtcccctataatccctgacactgtcccccacaccgtcccctcctgtatgcaccactgtcccccatgctgtccccacctgtccctgatgctgtcctccacacagtccccacctctccctgacactgtccccatctctccccaacactctcctccatgctgtccttaactgtccccaacactcttccacactctgtctccacctgtccctgacactgtcccccacactgtcctcacctgtgtctgacactgtcccccacgctgtccccacctgtccctgacgctgtcttctgtgctgtccacatgctgttggtgccctggctctgctctctatcaccaagcctcagagcaggcagtggtgaggccatggcacctgggtggcatgaggggccggatgggcctcaggggcagggctgtggcctgcgtggactgacgggtgggtgggccttgggggcagagaggtggcctcagtgccctgaggggtgggtggggctcgggggcagggctgtggcctcgctcacccctgtgctgtgccttgcctacaggtgaagtggatcttctcctcggtggtggacctgaagcagaccatcatccccgactacaggaacatgatcggacagggggcctagggccaccctctgcggggtgtccagggccgcccagaccccacacaccagccatgggccatgctcagccaccacccaggccacacctgcccccgacctcaccgccctcaaccccatgactctctggcctcgcagttgccctctgaccctgacacacctgacacgccccccttccagaccctgtgcatagcaggtctaccccagacctccgctgcttggtgcatgcagggcactgggggccaggtgtcccctcagcaggacgtccttgccctccggaccacaaggtgctcacacaaaaggaggcagtgaccggtatcccaggcccccacccaggcaggacctcgccctggagccaaccccgtccacgccagcctcctgaacacaggcgtggtttccagatggtgagtgggagcgtcagccgccaaggtagggaagccacagcaccatcaggccctgttggggaggcttccgagagctgcgaaggctcactcagacggccttcctcccagcccgcagccagccagcctccattccgggcactcccgtgaactcctgacatgaggaatgaggttgttctgatttcaagcaaagaacgctgctctctggctcctgggaacagtctcagtgccagcaccaccccttggctgcctgcccacactgctggattctcgggtggaactggacccgcagggacagccagccccagagtccgcactggggagagaaggggccaggcccaggacactgccacctcccacccactccagtccaccgagatcactcagagaagagcctgggccatgtggccgctgcaggagccccacagtgcaagggtgaggatagcccaaggaagggctgggcatctgcccagacaggcctcccagagaaggctggtgaccaggtcccaggcgggcaagactcagccttggtggggcctgaggacagaggaggcccaggagcatcggggagagaggtggagggacaccgggagagccaggagcgtggacacagccagaactcatcacagaggctggcgtccagccccgggtcacgtgcagcaggaacaagcagccactctgggggcaccaggtggagaggcaagacgacaaagagggtgcccgtgttcttgcgaaagcagggctgctggccacgagtgctggacagaggcccccacgctctgctgcccccatcacgccgttccgtgactgtcacgcagaatctgcagacaggaagggagactcgagcgggagtgcggccagcgcctgcctcggccgtcagggaggactcctgggctcactcgaaggaggtgccaccatttcagctttggtagcttttcttcttcttttaaattttctaaagctcattaattgtctttgatgtttcttttgtgatgacaataaaatatcctttttaagtcttgtacttcgtgatgggagccgccttcctgtgtccacgcgcctcctgcccccggtggaaaacacggtcaggaggaggctggtccagctgcacctcgggggctccctgcatacgccccccgcctcctgcagccacacgcattgcccgagcgaccctccctggcccctgtcactacatggacccccggggcttctcctcttttctacatggatgcagtttctcctcctgctgggcacggtgctgcctgccctggtcactctgcgggggacagggcctccagggaaagctgggtcgaggctgggagctggctcaggctggccaggcagagccacagggagggccttccagaaccaaccatggtccgaagcgagaggtgggtgtcagatctgtgtgcgtcagctcaggaccacagcggggcagctcccacggcagacatggatcctcccaggcctagagaccaggaatctgagatcaggatgcaggcagggctggtttctctcaagccctctctccttggcttgtagacaccgtctcctccctggtcctcacatggccatacctctgtgtgcccgtgtcctaagcttctcttcttagaacacacatcggattagattagtgaccccctatgaacttaatgacctctgtaaagaccccatctccaaatagtcacattgtgaggccagggattaagacttgaatatatgaatttgtaggggccacgatttaacccatcacagtccagactctggcccccaaaattcatgttcttctcacatgcaaaacacattcatcctgtctcagcatccccctgggcactaggtcatgtagcaaggacggattctcaacagaaataactattgcaacggaagaaagagtccggcatgacctggactcaccttcatctgtgcagaggccacagccttgtaaagggaggtggtagggggagcagggtgggtgctcggggctcagtcgttggggaagggaaaagtttcccagcgctggtcagcgtccccgggatgggacccgctgtgtccgtgccggccactgttgaggtcaggattctgtcctcccagagcctggagacacaggccccatccttcacaaaggggacacttcagggagtggctctcaggtcccgagaaagaccctcctgggtcacaggaaatgcacagacatcaggaacggatagaaggtcgtgtggttgcggccctctcagcagataccctgagaaagggaggtcggggttggtccaaacggtgagttctggtgcacggagctttctcaggcaggtgttgacggggcaggggtcggcctaggggtacggccagaagctgttagaaactgttagtgtctgctcaagtctttacaagccaaggttgaggccgagtggagaggctccgaggagcctggctggaactcagtcaaggacagggtcttgttactgcagtggctgcggtggctgcggtggctgcgaaatgccgtcggagttgcctgtggcaggagagagaccatctcacccaggaaggaggagtggttggattcgtttgtgtggcatcgagcagctggagcttcaccaaacacagagttggggatgaaatccccagagcccggaccctgccatgccgtgggaaggctcgctgctggagggtgggctccagggggcctggcctgaactgggtgctgaagcccagccctttaactctcaggacacgctgctgcagccccgcggggggtgagggagacagcacctggggtgcagggcgggcagctgctgcatcaccggctctatcccaagcccaaggatggcgtcccagagatgcaggagagctttgtccagagaaggtgccagccctcagggaccctgctggacagctctccaccctctgcccttcaaggggccctacgggcctccgggtgccctggtggggtgggctccagtccactgtctgaggatggacggcctggccaggataaggaaaggagacccaggacggtgccgggctccgggtcattccgtgcactgagcaggctgagttgggaagaagcagatgcttcctgcagctcctgcccctgcagggcctggcgcctggaccaggttcccctggggaaattgggcccctccctgagccacccggggcccacctcccactttctacctgggaccgagcatcctccagagggtcagccctcctgcgggaacaccatgcccagccccaggaccctccctcaactctccagcaaggctgcccctgcacgcccccagcagcccatgctgtgatgtagcatgacatcatgtgatgtggtgtgatgtcctatgacagggtgacatccctggtgtgatgtggtgtgatgtggcgtgatgtcctttgtgtgatgtggtgttggactacatggttggacatagtgtgatgtggtgtgaccgagtgtgacatccctggtgagatgtggtgtgacatggtgtgaggtgttgtgacatggtgtaatgtccctggtgtgaggtggtatgacatggtgtgaggtgttgtgacatggtataatgtccctggtgtgaggtggtgttggacatgatgtgatgtggtgtgacagagtgtgatgggtatgacatccctggtatgatgcggtatgagattatgtggtatggtgtgacatgatgtgatgtggcgtaacatccttggggtaatggggtatgatgtcgtttgacgggtgtggtggtgtggggtgtgatgaggtgtggtgtgacatgatgtgacctgtgacgtgctgtgtcagggtgccacatccttgctgtgatgtgatgcggtgtgacacggtgtgatgtggcatgatggggtgtgacccggtacgacatccccagtgtgatgagttaatggtgtgatgtgtgacatccctagtgtgacatagtgtgatgtggtgtgatgaagagggcctcgccctccacagctgtgggtatttctcatcaggtggaaacacgagactgagaaaagaaataagacacagagacaaagtgcagagaaagaacagtgagcccaggggaccggcacactcagcacgcgaggacctgcaccggcaccggtctctgggttccctcagtatttattgatgactattttcactatctccatacggggagtgcggcaggagaacagcgtgaacagggtgatgatggggagaaggtcagcaggaaaacatgtgagtaaaggaatctgcatcataaataactcccagggaaggtaccgtgctgggatgtacacatagactagatttatgtttctctttacccaaacatctcagtgtagtgaagagtaacagagccgtatcaccgctagcatatcttgtctccagccttagggcggttttctcctacctcagaatagaatgaatggtgggtgtaaagcccagacattccattcccagggacgtgcaggaaacagaggccttcttcttatctcaaccgtaaagaggccttcctcttttaccaatcctcctcagcacagaccctttacaggtgtcaggctgggggacagtcaggtctttcccttgccatgaggccatatctcaggctgtctcagtgaggagaaactgggacaatacctaggctttctccggcagaggtcccttcagctttccgcagcgtattctgtgcctagttaacagagaatggagaatggcgatgacttctaccaagcacactgcctgcaaacgtatcgtgaaccaggcacgtcctgcgcagccctaaaccccttaaaccttgattccatgcagcacaggtttctgtgagcacagtgttggggctaaagttacaggttaacagcgtctcaaagcagaacaatttttctttgtacagatcaaaatggagtttcttatgtgttccttttctacataggcacagtaacagtctgatctttcttttccccagtgtgacatggtgtgacgttcctggtgtgattcttgtgttgtgacatttgtggtcaccccaggatacagaggtctctgtggccaagggaagggggagaatggaaccatctgagcatgttgacctggaggaattggtggcccttgagtccacgaagcccacccttccaggtgcccctgccccacgtgacccaagtgggcttgcagagcagcaagcaggactctggttagacaggaggaaggacctgccaccacgtggccttgtgaggagacagagcgaggctgtgacctcggcgtccgaggcaggctgaagagacgggcagagggaggatgctggggaggcaggggtgaggggagtgagagcccaggtttcagctgagcccctccacagggaaggagcctagctgaacacccatctccccacacactcccaaccctgcctctgcccgaccacctcccagaaggcacctcgacccctctgctacccacactcagcaaggggtatggtgtccccaccgagtccagccagtgaggcccggcacagccacgcctgtgcccaccactcccatggccaagctcgctgctaacatggcaggacagggccaggcctggaggagacagaacatcagtcccatggggaagctccctgctcacacggcagggccgggcctggagaagacagaacaccccatccggcatggtactcaggctgcacatgcctgccacgaacgggggccacgcgacaatgctgccacgcacgggggacacacgacaatgcctgccatgcatagtggccacacaacaatgcctgccacgcgtgggggacacgcgacgatgcctgccatgcatggggacacgtgacacacacatacacacacgggcctcacaggcacacgaatgtttgcaaccccagcacccacccagcacactcaggcacaggctccctgggcgggtcacaacctcacaccttgagctactccatgtgccaggctcttcacccacgttcccgtccccggtgctagctattgagccacactgtcttctctgtggatccctcccagcccactcagcacaatggacatgctctctaccatccagtgactgcaccggcctcttcccctcagcacccacgtctggccatctcccaggaaacccggaccaccacgggcagggaccaccttcctcactgtccacatggaccaccccacacctgacctcagatgcagtcacactacgtcctgcttcaatattgaaagggggaaaagctggaggagggtaaagatgaaagagaaaaaagcaagaggggagggtcacattcttctgaggctttgattacatctcactgagccccccacgttgcatgaaaaggaggggtggagggagcaattacgcattcgccttgtgctcactaaatctacactttataagcaaataaacagagtagaggaagaagtcaaatatgcattcgtctcaggggtaggagggacgatttcttgtctcattttgtcccatgtcatgaagaccagctgttaatttatattctcagggtgagggaggccacctgggtagacctggcctatctgctgctgctatcagtttggaaacaaaaggaaacgcatgactttttttttttttcatgactcagcttcccacctcaacggttcattttggcatagtgagtttggagtcctgagattttattttcctttcacaatggtcaagatcgcaccctcagtattcaggagagctggtccaacccagacccctgctgtccctggacacttgaaatacgtgctgcagtctctgacactctctcaccatggtagaaactgaggtcttggcgagtctgcagcccctgctcatggggacaatgcaggctgaaacccgcatttctgacctcaaagctcctgttcttttcactcacccccacaccacctctttgagtccagagctttgtccttgcctgagtcctaccctcagggacaggggcccaacccagacaccaacacatcataccctgagagggtgccaggagcccagagatgtttggagagcacagaagccctggaggctctgtggagatgctgcacatttctctattcaacagatactcaccaggtggccagcggcagagatgccacatggcatggagctcgccttggccaacaggacaggtgtggggttgggaggccttcccacggcactccttgaagcagagctgtggggaaaagttggggccaacctcagatctccccatcaacaccggttctcctgccctcccgggccacagaaaactaagctccctggatactgcggctgggtggggccatgagggagaagaaatcacgagttaagagatcattttttaaaagtattatgatcaggactcacataaacatatgacgacacatttcagagatgctctttatctcattaattaaggtgttgcaaccagttcaaagtggaattctaagtactacacttacataattgattcaggaatactaaaaggagttcatagatagatgcaaaactggccttttccctggcagaggaggagcaattcattgtcctttcaaagatgagaacttggatttctaccaactcaaagagtttttgcattgctatcaattatgtacaacttagagccgtggtccccaacatttttggcaccaggaaccagttccatggaagacaatgtttccacagaccaggatcgggggatggtttggggacaaagctgttccacctcagatcattaggcattagggtgtcataaggagcatgcaacttagatcccgggaatgtgcagctcgcaatagggttcgctcctatgagaatctaatgctgccactgacctgacgggaggtggagctccggcaggaatgctcacacacccctcacctcctgctctgtgtcccagttcctaacaggccatgaactggttccagtgcatgacccaggggttggggacccctggcttatagaggtgtaaaatagttcaaaggaaataaaagatgcagagctccatagaataaaataacttggaagagtctacaagacgatgccttgctttccatggaaggcaccaagtaatcatttggtccatttcagtttttctcaatgtttcctataaacatatataactgactgacacaaacagatccataatataaagaagacccctgtaaaccaatgagaaaaaaaaatcaaataatctaatgaggaataggcaagagaattgaacagatgttttacagaagatatccaaatagccactaaacatatgaaaacatgttgaaccacactagtcaacagggaaatgaaaatgaaaaaccacgtgagagaaagtagttctgattccaataatgctggagcagctaatatcagaccagccctttggcagaaggcaattataaacactggaaatgctgtaagcacacacaacacccacacacaccaattgcaggcactgggacatgaccagaagtaggcaaacactagtaaggattattccgtgaaatattcgtctgaagtcacaccccagtgcaggtaatgggtgcagctagagtttaagcaggaaactgcagccctcctggtgaggagtgggatgcagggctgcattttcagagcagctggaaatgaagagaagatatccgtaaaggagaaggtcaccgaagggaaaccccacaatctgcaagtaaactccagtgaaacctctggccgattccttaggtgtgcatgggtagggaaaactccaaagggtccagcagaaagcaacacctgtaaggtcaagagaactgagattccagctactgccaactgccaggcaggcagacttgggagtttgagtcaactcaagctaactgcttgctaacattgaaaaaaacaattaatgctctgctaagaaagaatgcaaaccccatagcctgtaccacatgttatcaacaacatcaggcacacatccaaaattactatgtatgcaaagaaacatgaaaatgtgatccaaagtcaaaagaaaaagggatcaatggagatcaactccaagatgacctagatgcagatacagttatcagacaaggactttaaagaagttatgttaaatatgttcaaagacttaaaggaaaatatggttatcatgagtgactagatgaggtatctctataaaaaactgaaaatagttacaagaagcgaatgaaaattctagaactaaaagtatgattcggaaatgaaaaacatcatttgaccaggcccagtggctcatacctgtaatcctagcactttggaaggccaacaaggaaggatcacttgacctcaggagttggagaccagcctgggcaacatggtgaaaccccatctctattttattaaaaaagaaaagaaagagaaaaacattacccaagtttaataacagattggacaagacataagaaggaacagaaaacttaaagatgcatcaatagagtatatcaattctttttaatccaatccaaagaagaaagagaaaaatactaaaaaatgaaaagagattcatcctgctggagaaggcgaagcattctaaaacatgcaaaactggagtccagagggggatgtaatacttccatgagaaacgtcaaccctaagctatatgcaaatgtacctgcgtaggctggtgtggtgggctgatggcatctccctggccaaatgtatgcccacctggaacctcagaatgtgaccttatttggaaatggggtctttacaaattaggttaaggacttgagatgatatcatactaaattttggatggatcccaagtccaaacactggtgtcctcataagaggagaggacacagacacacatggaggtaagccatatgatgacaaaggagaagatgaggggtgtgtcaggagccacctgtgtttgtccatttgcattactgtaaagaaatacctgaggctgagtaacttatgaaggaaagaggttcaattggctcacagttctgcaggctgtataggaagtatggcaccagcatctgcttctggcgaggacctcaggaaacttacagtcatagcagaaggtgaagggagagcaggtatgccacatggcaagaatgggagcaagaggctgagggggggccccagacttaaacaactagactgtgtgtgagctgactgggggagaattcactcatcaccaaggggatgattctaaatcattcatgagggatcttcccccttgatctaatcacctcctaccaggccccacttccaacactgggaatcatattacaacatgagatttggaggggagaaatatataaaccatatccttccacccctggtcccccaaatctcatgttgcaaaatacaatcatgccttctcaacagtcccccaaagtcttacctcattccagaatcaacccaaatttcccaagtcccaagtctcatctgaagatgactcccttccacctatcagcctatgaaatcaaagacaaattattgactcccaaaatacaatgagagtgcagacattgggtaaacattcccattccacaagggagaagttggcaaaaagaaaggatctacatgccccatatatgtcagaaatccagcagggcagtcattaaatcttaaagctccaaggtaatctcctttgacttcatgtcccatatccagggcacattggtgcagggggtgggctcccaaggccttggaaaactctacccttgtggctttggaggatgttgcccctgtggcttctctcacatgatagagttgagtgcctgtggcttttccagattcagggtgcaaactgccagtggatccaccattctggggtctggaggacagtggcccccttcccacagctccactaggcagtgccctggtggggacattatatgggggttcaaccccacattctctttggcactgctctagtagaggttctctgtgagggctccatgctggcaggaggcttctgtctgggcacctaggctttctcatacatttctgaaatctagagggaagatgccaagcttccttcactcctgtattctgggggcctacaggcttaacaccagatggaagtcaccaaggcttatagtggcttgcactctccaaagaagcagcctaagctatacttggggccctttgagccaaggctggagccagaggaaccaggatgtggagagcagtgtcccaaggctgcacaggcagcagtggccatggccatggcccacaaaaccatcctttccctcttggcctctgggcctgtgatgggaaagaccacctcagagatttccaaaatgccttcaaggccttcttccctttgttctggatatgagcacttagctctcttttagttatgctaatctctctagcaactggctgctccatagcctacttatatttgtctcctgaaaataccttttcttttctaccatatggccaggctgtgaattttccacatttttaatgctctgcttccctttgttgatgaaaaaagccaaactccataaaacacttgaaaaattgattctgagccaaatatgagagccatgaactgtggcacagcctcaaaaggtcctgagaacatgtgtgcaaggtgcttgggttgcggcctggttttatgttttagggagacatgagacatcaatcaatacatgtaaagtatacattggtttggtttggtttggaaaagcaggacaattcaaagtggggaattccaaatcataggtggatttgaagattttctgattggcgattggctgaaaaagttaaattatctaaaaagttgaagtcagcgaaaagcaatgcttaagataagggggttgtggaagccaaggttcttgttatgtagacgaagcctccacgttccagagagaagagatggtcaatgtctcttatcagaacctaaaaggtgccagactcttggataaatctctcctgaatcaggaagagacctggaaagggaaaaagattctcaacagaatatacatttcctccacaagagacggctttgcagggcccttccaaaatgtgtcagagaaacatattctgggataaaatactttaatttccttccatgcctgccacctgtcatgtgatgctataccagagtcaggttgggatttgataccttattgctacaaagagtctgctttgtcagtcttaagctccctgttttaatgttaacactggtcagctgagcctaagctccaacagggagagggtatagtgagggagtccaaaccaccctccccttcctgtcatggcctgaactggttttccaggtttctttggaatccccttggattagcattttattttttcatttgcaacttttaaatataagttccaactttaagtcatttctttgctcccatatcttaccctagactgttagaagcaaccaggtcacaccttagaaacgtctgcttagaaatgtcttccccagatgccctaagtcatcactcttaaggtcaaacttccacagatccctagggcatgaacacaatgcagccaagttgtatcttaggatttaacaagcgtgacctttactccagttcccaataagttcctcatttccatctgagatttcatcagcctggctttcacagtgcatatgtctatcagcattttggtgacaaccatttaatagtctctaagaaattccaaactttccctcatcttcctgtcttcttctgagtcctccaaattcttctaacctctctgcctgttacctaattccaaagctgcttccacattttcaggtatctttatagcaatgttccactcctcaataccaatgttctgtgttagtttgtgttactagaaaaaaaaatacatgaggctagtaatttataaagaaaaggtgtttaggccaggcactgtggctcatacctgtcatcctagcattttgggaggcagaagcaggaggatcacttgagctcagaagtttgagaccagcctgggcaacatagtgagaacttgtcttgaaaagacaagaagaagggaagggcgggggagagcagaagagcagaagggaaacacggccctggcatctgcttctggtgaggcctcagggagattgcaatcatggcagaaggcgaagggggagcaggcatgtcacatggcaagagggagcaagagaaaagaagtggcacgtcccagaattgtaaacaacgagctgtcacagggactaactgagggagaactcactcatcacctgggagatggtgctaggccattcatgaggggtccagccccatgatctaatcacctcccaccaggcccacctccaacactggggcctgagagagaagagaacctcccccagcactcggtgtgcatcggtagtgaaggagcctcacctgagcccccgctgttgctcaatcgaattcccaagaacagagagaaaagggaacttccagggtggcccgggcctccaggggttcccactccatttttagctgaaagcactgaggcagagctccccccacccaggctccactgcccgacacagaaataacaaccacggttactgatcatctgggagctgtccaggaacccgacagggagccggacgggccacaccagccacaggcaccaaatggacgacccggcgcttcaggtatcccagcccaccgggagccccaatcaaggggccggcccaggcagcagtgagggagaggctgcctgggtccctgacagcgaggggactcctgggccaccctcacagcatcaaccaagcttcttagttactgcatggactccagacgtcccttccctgcatggggacacaggaaagctagaaacagcctaacgccgacctggagaaggcagggggctgggaatcttggctgggcccaagactaagaaggtcagaggccccatgctgggcagggctaggctgggtgcagactgcctgtcacccccaggacagggacagccaacccagagccgggagggagggtggggaggcggcagcagggagctgtcctgagctccactgcgcaactggctgatcttggcaagtccgagctgggtggactgaggggggcttggctgagtggactagactgagacgggcctaacagactgagctgaggcgagctgggtgggctgagagggctaccctgtcccttagaggacaggtggccaagctgggctgtcctgagccagggcgatcggggctggcccgggccaggcgggtttagctgagttgagtgagtggactgggtagagggaaatgagctaggctcagctgagctaggcttgagctgggttatcctaagccctaaggtggactgagctgggctgagctggacttatctggggagcagggcaaagtcaggctgagctgaggtggcctgccctgggtggtccaggattgagttaagctgaattaggctgacctggacttgactggacttggttgaaataagctgggccgacacaggagtagggacaagctacagttctctacttaggataaaatgggtgctcgtggactatccgggctgaaggagaccaagctggggtattacctgctgagcttacctgacctggcctgagttcagcagggctgcgctgagctggacagacctgagccaagcttagctggttgggctgagtaagctgggctgagctaaatgggattgagctgaggagggctaggctgggggagagacctgacgacggacagggttaaaagctggagtgagcaggccttaaattattgaactaaattgggctggggtgatctgaatttagctgggatgagctgggctgggctgaactgtgcccacgtgaactgggctaaactaggctcgcctgagtggactcagctgggttggtctcaactgggttcagctgagctgggctcggctagactacactgggttcagctgacactacactgggttcaacccgagaggggtgagcgcctacctaagccggcccagcccgttcgacctgttcatccgcaagtcgcccacgatcacctgtctggtggtggacctggcacccagcaagtggaccgtgaacctgacctggtcccgggccagtgggaagcctgtgaaccactccaccagaaaggaggagaagcagcgcaatggcacgttaaccgtcacgtccaccctgccggtgggcacccgagactggatcgaaggggagacctaccagtgcagggtgacccacccccacctgcccagggccctcgtgcggtccacgaccaagaccagcggtgagccacgggcaggccggggtcgtggggggagggagggagcgagtgagcggggcctgggctgaccccacgtctggccacaggcccgcgtgctgccccggaagtctatgcgtttgcgacgccggagtggctggggagccgggacaagcgcaccctcacctgcctgatccagaacttcatgcctgaggacatctcggtgcagtggctgcacaacgaggtgcagctcccggacgcccggcacagcacgacgcagccccgcaagaccaagggctccggcttcttcatcttcagccgcctggaggtgaccagggccgagtgggagcagaaagatgagttcatctgccgtgcagtccatgaggcagcgagcccctcacagaccgtccagcgagcggtgtctgtaaatcccggtaaatgacgtactcctgcctccctccctcccagggctccgtccagctgtgcagtggggagggctggccagaccttctgtccactgttgcaacgaccccaggaagctacccccaataaacagtgcctgctcagagcccagggtacacccgttcttgggagcgggcagggctgtgggcaggtgcatcttggcacagaggaatgggccccccaggaggggcagtgggaggaggtgggcagggctgagtccccccaggagaggtggtgggaggaggtgggcagggctgaggtgccactcatccatctgccttcgtgtcagggttatttgtcaaacagcgtatctgcagggactcatcacagctaccccgggccctctctgcccccactctcggtctaccccctccaaggagtccaaagacccaggggaggtcctcagggaaggggcaagggagccccgacagccctctctcttgggggcttggcttctacccccctggacaggagcccctgcacccccaggtatagatgggcacacaggcccctccaggtagaaaaacagccctaagtgaaacccccacacagacacacacgacccgacagccctcgcccaagtctgtgccactggcgttcgcctctctgccctgtcccaccttgccgagtcctggccccagcaccggggccagtggagccgagcccactcacaccccgcagcctccgccaccccgccctgtgggcacaccaggcccaggtcagcagccaggccccctctcctactgccccccaccgccccttggtccatcctgaatcggcctccaggggatcgccagcctcacacacccagtctcgcccactcacgcctcactcaaggcacagctgtgcacacactaggccccatagcaactccacagcaccctgtaccaccaccagggcgccatagacaccccacacgtggtcacacgtggcccacactccgcctcccaccctgcctccagcgaggctactgccaagcccttcctctgagccatacctgggccgctggatcccagagagaaatggagaggccctcacgtggtgtcctccagtccaaccctccctgtcaccctgtcagcagcaccccacagccaaacacaggatggatgcgtgggctccatcccccactcacccacaccggaaccccagagcaggctacgtgcccctcacagacctcaaacccacatgtgcatctgacaccccagatccaaacgctccccccggtcatgcacaccaagggcacagcacccaccaaatccacacggaaacacgggcaccgggcaccccatgagcacaaagcccctccatgtctgaagacagtccctgcacaccgtcacagccatacattcagcttcactctcacgtcccagcccacctgcacccagctctgggcctggagcagcagaaagaggtgtgagggcccgaggccggacctgcacctgctgatgacccgggaccagcaggcagctcacggtgttggggaagggagtggaggggactcagggcaggagccagagggaccaggctggtgggcggggccgggccggggtagggccaggaggcagctctggacacccacaggcctgggctcatagtccacaccaggacagcccctcagagcacccatgcagtgagtcccaggtcttgggagccaggccgcagagctcacgcatccttccgagggccctgagtgaggcggccactcctgtgccgaggggttgggtccttctctggggagggcgtggggtctagagaggcggagtggaggtaaccagaggtcaggagagaagccgtaaggaacagagggaaaatggggccagagtgggggcccagggacgagaggtcaggagtggtcggcctggctctgggccgttgactgactcgggacctgggtgcccaccctcagggctggctggcggctccgcgcagtcccagagggccccggatagggtgctctgccactccggacagcagcagggactgccgagagcagcagggggctctgtcccccacccccgctgccactgtggagccgggagggctgactggccaggtcccccagagctggacgtgtgcgtggaggaggccgagggcgaggcgccgtggacgtggaccggcctctgcatcttcgccgcactcttcctgctcagcgtgagctacagcgccgccatcacgctcctcatggtgggcacccacctccaggggcccggccagggcagggggttgggcagagccagcagagcgccctgacccacgccctcccctcaggtgcagcggttcctctcagccacgcggcaggggaggccccagacctccctcgactacaccaacgtcctccagccccacgcctaggccgcgggccactcacgctccaccaggcccagctttttctctgccagcgcctgagcctccctcgggctgcgccctgccctgggtgggaaaagggaagcagacaagaaaagggggcacaaggtcactactgtgggctgatggccagtgaacctgagcccagagggggccggctcagccgcaaggttaaaggcgccgagagaaccaccagtcgcagcccccacccgaaaaccgtgtctgtcccttcaacagagtcatcgaggaggggtggctgctagccgttctgagctcatcccaggcccctgggtctccgggtcactcccattctgactgtacaatcaccaaaagccaaggagggcccagcacccagcccaggacacagctgagtctgcgtccagcccaacaccagcccacggcctcactccccagcctcggtctgacccttctagccctgagatccaagtgcctggcatccccgtcccccaagcctcacccagaccttctttcccttcacccacccctcctgccacccatccacagcccccatcccttcacccacccctcctgccatctatcctcagcccccatcccttcacccacccctcctgccatccatccacagcccccatcccttcacccacccctcctgccatctatcctcagcccccatcccttcacccacccctcctgccatccatccacagcccccatcccttcacccacccctcctgccatctatcctcagcccccatcccttcacccacccctcctgccatccatccacagcccccatcccttcacccacccctcctgccatctatcctcagcccccatcccttcacccacccctcctgccatccatccacagcccccatcccttcacccacccctcctgccatctatcctcagcccccatcccttcacccacccctcctgccatccatccacagcccccatcccttcacccacccctcctgccatctatcctcagcccccatcccttcacccacccctcctgccatccatccacagcccccatcccttcacccacccctcctgccatctatcctcagcccccatcccttcacccacccctcctgccatccatccacagcccccatcccttcacccacccctcctgccatctatcctcagcccccatcccttcacccacccctcctgccacccatccaaagcccccatcccttcacccacccctcctgccatccacctcagcccccatcccttcacccacccctcctgccatctatcctcagcccccatcccttcacccacccctcctgccatctatcctcagcccccatcccttcacccacccctcctgccatctatcctcagcccccatcccttcacccacccctcctgccatctatccacagcccccatcccttcacccacccctcctgccatccacctcagcccccatcccttcacccacccctcctgccatctatcctcagcccccatcccttcacccacccctcctgccatctatcctcagcccccatcccttcacccacccctcctgccatctatcctcagcccccatttctgcagcctgaaggcacagggaagccctctgaggccaggccacaggacggttgagggcttcgggcccctggagtgggtagaggggctcccacagccagagaaggggtttcctgcagggacagcagctgccgacctcgtccctatgacctcgtccagtgtctggcttcagcagtcatacttctttctctctgagtttcttagtaaagatccttttcacaaaccccacgtctccggagggctctgtaggaggtgtgtgtggccctggagtggctggtgggaggcaggacccctgaggacgtgcaggaggagccagaggggaaggaagggcaggggccattctggggtcctgagagccaaagtgcccaagcagtggttcccatcaatcacccctcagcaccccagagactccccagctcagcgctgtcatacctggtctgctggtctccagcccagactcatgcctccttctcaggtaaagtcaaagcaacaatcaacatcgacccctttgtgggcaaaaccagaagaggcccatgctgtggtcagcacaggaggccccaagaatgcagctgcacagtcaccaaggtggaggctggtgggggcccccaggaccactggccacacaccctgatccagcacccactgagcacagacaaagctgactccccagcccacagccgcccaccagcctggacctcctgaagagctgagaggtgacccaggagcaggctggggccccagagccatcggggccacaggtgggcttgacccacaccagtcctcagggcaaatgtgcagcctccctggctggagaggcctgcttacaagggtctccacaacatcctaaaaatgggagagaacgcatgataggcatgacaaagggcagggttccctcatatacaaagagcactcagagatcactaagaagaaaggtgagcaataggttcttcatggaaaggaaaaacccagtggccgataatataaagaaaccattttaacaatgagaaaagtgaaaggaaggaggaggggatgaagggggtggaggtgcttcttggccctgactgagggcacgtaaatcattaagaccactttttagggccagttggcaaaatgccccaatgcaggagagtcctctcacagtgatggccccacagggagagcctcgctctgtgccaggagagccacgtcacatggagtctggcacaaagcggaatgaagcaagcctgcctcagtctgacagcggcacctgggccctccgccctgtcctctgctgcgacctcggagcagccgggcacgggggagaaggtgaggagcgacggctccctacggggtagaaaaccccaaagcgggcagcgctgaggctgactgggtccaaacaacatcagaggagggggcgtcgcaggacagggccaaggccacagccgctgcccagctcccctcacacactccctcattcacagacacacacgcgggcacacactcgcacatgcaaaaacacacaggttcacacacacagactcaacctctcatacacatttgcactcacacacaccaatcatgcactcacacaggctgacacgctcgggcacgctcataccaacacacacacagtctcaggaagccaggccctccatccaccccatcaccagcccagggtgtcgcaaacccacatctcctacaacagaccggccctccgcagccaaggtgccccggaccgggagcccccccgggggacagagctcagtgactttctctgccccgcaccctagatcatgagacctccatggccccagagcaagggcaaggagtcagctcactgccccactgtgtggcaggcgtcctcacgcacagaaaattccatcgcctcaaaggcctgagaggaagaccagatgagcacccacgtagaggagacagacggggcccgtggggaggggcagaggcccggattcacacccaggctcggaacagcgcccctgccttccacatggcctggcctcccgggagcaagaggatgccgtctcagggcctctccatccccctcttcattcccctattaacccacccgtgggtacaaccatggcccccaaaagatagagccacatcctagcccctggggccattgagtgcggcgttatttgtcaaaagggcctttgcagatcccatcaagataaggatttcgaggtgagggcaccctggattgtcaaggatttcgaggtgaaggaaccctggattgtcaaggatttcgaggtgaaggaaccctggattgtcaaggatttcgaggtgagggcgccctggattgtcaaggatttcgaggtgaaggaaccctggattgtcaaggatttcgaggtgagggcaccctggattgtcaaggatttcgaggtgaaggaaccctggattgtcaaggatttcgaggtgaaggaaccctggattgtcaaggatttcaaggtgagggcaccctggattgtcaaggatttcgaggtgagggaaacctggattgtcaaggatttcgaggtgagggaaccctggattgtcaaggatttcgagatgagggaaccctggattgtcaaggatttcgaggtgagggcaccctggattgtcaaggatttcgaggtgaaggaaccctggattgtcaaggatttcgaggtgagggcgccctggattgtcaaggatttcgaggtgaaggaaccctggattgtcaaggatttcgaggtgagggcaccctggattgtcaaggatttcgaggtgaaggaaccctggattgtcaaggatttcgaggtgaaggaaccctggattgtcaaggatttcgaggtgagggcaccctggattgtcaaggatttcgaggtgagggaaacctggattgtcaaggatttcgaggtgagggaaacctggattgtcaaggatttcgagatgagggaaccctggattgtcaaggatttcgaggtgagggcaccctggattgtcaaggatttcgaggtgagggcaccctggattgtcaaggatttcgaggtgagggaaccctggattgtcaaggatttcgaggtgaaggaaccctggattgtcaaggatttcgaggtgagggcaccctggattgtcaaggatttcgaggtgagggaaacctggattgtcaaggatttcgaggtgagggaaacctggattgtcaaggatttcgagatgagggaaccctggattgtcaaggatttcgaggtgagggcaccctggattgtcaaggatttcgaggtgagggcaccctggattgtcaaggatttcgaggtgagggaaccctggattgtcaaggatttcgaggtgagggaaccctggattgtcaaggatttcgaggtgagggcaccctggattgtcaaggatttcgaggtgagggcaccctggattgtcaaggatttcgaggtgagggaaccctggattgtcaaggatttcgaggtgagggcaccctggattgtcaaggatttcaaggtgagggcgccctggattgtcaaggatttcaaggtgaaggacaccctggattatcgagggggctaggtccaaggacaagtgtcctagctggagacagacgaggagacacagggatggggagaggcagaggcagacaggggtggtgctatggtctgagggtctgtgtctgcccgaaactcctgtgtgacagccgtcatcccagagtgagagcatgcagagctggggcctcagggaggtggttagggcctgagggggaaccctcaaaaatgtgattcggtccctaatctcactagagaccctaaagaaaagggaccccagagagcagccctgccctctttccaccacgtgaggacgcagtgaaaagatgggggtctgtgaaccaggaatcgacccttcctggaacttgaccctgctgccatcctgaccttgaacttccagcttcgagaaccgtgagaaatgaatgttgctgctgaacccaccagtctatggtatttttgttattgcagccagaaatgactaagatgcagcagccacgtccccctggcgagggccgggggcatcccaaggttcataacaaaagctccagagcttccctgaaccgccaggtgtgtcttcccaggaccctggggcagccccaggctacctccctcctcctctgaccccacctgccctgatccggcctcactgtcactccctggatttcacccgacagcctccgccggggtggcccggccccatggccagggcatcttccattcacgcccacgctttccaggactccgctgcagcagctcctctgtgaagcgcctctggcctcccattgccggtgccacccgagcccccagacatagctggcctcccccgactccagggccagcatcgctggcgggatctctccaacgcaacggccagctctctggtgacccacagtaggagtgccacctgggcagcgctggacagggtagagcaggcaccttggccaccctgacccgcagggctgcaggctaggagacggggtgcccccatgcccccaccctgggctgcagtctggggcccccagcggcccatggggcagaccgagggaggccaggccggagtggctccaacccagcagcgcaagactcactctccccagcctgatgcccgccctgtggccccaaggccccctcaacgggagtccactcacaggcacccttcccctgcgggtggtcggggaccctctctggccctgtgtctcccctttgccatctctgtctcggggtctctgagcctctaactgtgtctgttcctgtttccctgcatcgtggcccccaccccgccctgtggagccatgtggagccatgaggctccacggccggtggggtcacagagccctggccacacacacctggccccaccacagccagaccacaggccagacatgacgtggagccgcgcggccgtgtctgctggggcaggaagtgggcgagtgaccctgtctgtaggccagacgtacgggcatgcaggccctcccctccagcccctcagcatccagccacatctgtggacacagccagcgaggcagagcagggctctgctaaggacagacggccatcaaggcagggcctgggccgggccagggctccctccccacagcagccctcttggcaggcagccagacgcccgtgagggtggacctgccatgagggcctgcacgccggaggccgcccactcagcactgcgggccctccagcagcctgaccaggtgggtcttggaggtctccaggcctccgtctcctcctctgcacattgaggagtccagccaggctggtcctggccccttctggaagcaaaaggtggagaacaggcaccaagacaagagggaaggacaaaagaggtcaccacagggactccggaaccacagggcagggcttcctaaccaggcaggaaggatctgggcactgggggctgagccaggctggccaggcctaaccagggatgacccggcccttcctgggatacaaggtgaacaggtttcatggctgagctgaggcctaggctgagccgagccagagggcaaagaagatgacgtggagccagctgatacacgtccatgtgggctgccctgagctgccctgggctgggctgggctgagcaaggctaggctgaactgggctgagctgaactggtctgggctgagctgggctgagctaggctgggctgagctgggctgggctgagctagtctgggctgagctggactgggctgggctgagctggactgggctgggctgagctggactgggctgggctgagctgggctgagctaggctgggctgagctagtctgggctgagctggactgggctgggctgagctgggctgggctgggcttggacgagctgggctgggctgggttgagctgagctgagctgagctgggctgagctgggctgggctgggctgggctgggctgagctgggctgagctgggctgggctaagctggactgggctgggctgagctggactgggctgggctgagctagacttggctgagctgggctgggctgggctgggctgagctgggctaagctggactgggctgagctgtgctgggctgagctgggctaagctggactgggctgtgctgtgctgagctgggctgggctgagctgagctgggctgggctgagctgagctgggctggactgggctgggatgagctggactgggctgggatgagctgggctgggctgggctgagctgggctgagctgggctgggctgagctgagctgagctgggctgggctgggatgagctgggctgggctgggctgggctgggctgggctgggctgggttgggctgagctagactgggctgagctgagctgggctgagctggactgggccgggctgagctgggccgggccggattgggccgggccgggccggactgggccgggccgagccgggccgggccgggctgagcgggtctgagctgggctgagctgagctgggctgagctagaccaggctcgggtgagctaggccaggctgggctgggctgggctgggctgggctgagctgtgctgggctgggctgggctgggctgagctgtgctgggctgggctgggacaagctgggctgggctgggctgggacgagctgggctgggctgggctgggatgagctgggctgggctgagctgagctagggtgggctgagctgagctgggttgagctagaccaggctggggtgagctaggctgggctgggctgggccgggttgggctgggccgggctgggccgggatgggatgggctgggctgggctgggctgggctgggctgggacgggctgggctgggctgggctgggacgagctgggctggcctgggttgagctgagctgagctgagctgagctgggctggcctgagctgggctgggctaggctgggctgggctgggctgggcttggacgagctgggctgccctgggttgagctgagctgagctgagctgggctggggtgagctgggctgggctgggttgggctgagctagactgggctgggctgggctgggctgagctgggctaagctggactgggctgggctgggttgggctgaactgggctgggctgagttgggctgagctgggctgagctgagttgggctgagctgggctgagctgagttgggctgggctgagctgggctaagctggacctggctggggtgagctaggctgggctgcgctgagctgggctgggctgggctgggctgagctgggctgggctgagctgagctgggctgacctgggctgggctgacctgggctgggctaagctggactgatctgggctaggctgggctgggctgacctaagctgagccagactgggctgagctgggtgagcttaggtggattgagctggactgggctgagctgagctgggctgagctggactgggctaggctgagctgagcttggttgggttgacctgggctgagctgagctgaattgggttgacctgggctgagctgggttcggctgggctaggctgacctgggctgggctgagctgagctaggcttggatgagctgagctgggctgggttggactgcgctgggctgggttggactggtctgggctgacctgagctgtactgagctggtctgacctgtgctgagctgggctgggctaggctgagctgggctgacctgtgttgggctgggctgggctaagctgggctaggctgggctgagctggacggagctgacctgggtgagcttaagtggactgagctgagctggactgacctgggctaagctaagctgggctgacctgtgctgggctgggctggactaggctgggctgagctggactgagctgagctagactgagctgagctgggtgagcttaggtggactgagctgggctgggctgagctgagctggactgggctgggccgaactgagctagactgggctgagctgggctgagctggggtgggctgagctaggctgagctggggtgggctgagctgggctgagctaggctgagctgagctgggtttggttgacatggactgagctgtgttgagctgggctaggctaagctaggctgggcggagctgagctgggttgggctgagctgaactgggctggactgggctggactgggctgggctgggctgggctgggctgagctgagctgagctgtactgagctggcctgggccaggctgagctgggctgggctgagctgtactaagctggcctgggctgggctgagctgtactgagctggcctgggctgggttgacctgggctgagctggactaagctgggctgacctgggctgggatgggatgggctaggatgacttgggctggactgggcgggactgagctggactggcctgggctgagctgggctgggctggactgagctggactggcctgggctgggctgggcgggatgggctgaggtggctgctaatgtgggaaagaggccgtgggttgagtgtgattccacctgcagagccctgagcccagctgtgttcttaggggttctgagggccacgcagctctgttgcaccatgattctgtcttctctcttgcccactgcctgaaggaaatttggagtgggctgggcccagagctcccctgtatagcaggccctgtcctggagggcctggcagggacatggcttagcctgttggcctctagtcccgagacctcataggccacaggggtccactgtggcttgtttgggcctggggtggggctcatggagtggtgggtgttggactgagactctgaccagggacagggggatggggtcacagccaagccactccacccctaccccatgcacacagcactcagagcccagaccctctcctaagagcccccaccaaaatcctctctaggggcaggggatagagcaagacatgtcccccacccagagcaggggctgcggtcagggagctcaggggactcagccactccatggcagagccctgtttaatacaacttgtgtctgggatggcctgaatcagagaccctatctaaggagcatgttcagaaaccatgttgctgggatcagacagcagggtccaactgcaggcctgtggtgcaggagctgtgtgaccatggggctgtcaccaggcctctctgtgctgggttcctccagtatagaggagaggcagtatagaggagagggccgcgtcctcacagtgcattctgtgttccagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccaggtcagagggcaggctggggagtggggcggggccaccccgtcgtgccctgacactgcgcctgcacccgtgttccccacagggagccgccccttcactcacaccagagtggaccgcgggccgagccccaggaggtggtggtggacaggccaggaggggcgaggcgggggcatggggaagtatgtgctgaccagctcaggccatctctccactccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggtgggtccagaccctgctcggggccctgctcagtgctctggtttgcaaagcatattcctggcctgcctcctccctcccaatcctgggctccagtgctcatgccaagtacagagggaaactgaggcaggctgaggggccaggacacagcccagggtgcccaccagagcagaggggctctctcatcccctgcccagccccctgacctggctctctaccctccaggaaacacattccggcccgaggtccacctgctgccgccgccgtcggaggagctggccctgaacgagctggtgacgctgacgtgcctggcacgcggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaagcagccccacgcttccatccggcgcctgtctgtccatcctcagggtctcagcacttgggaaagggccagggcatggacagggaagaataccccctgccctcagcctcggggggcccctggcacccccctgagcctttccaccctggtgtgagtgtgagttgtgagtgtgagagtgtgtggtgcaggaggcctcgctggtgtgagatcttaggtctgccaaggcaggcacagcccaggatgggttctgagagatgcacatgccccggacagttctgagtgagcagtggcatggccgtttgtccctgagagagccgcctctggctgtagctgggagggaatagggagggtaaaaggagcaggctagccaagaaaggcgcaggtagtggcaggagcggcgagggagtgaggggctggactccagggccccactgggaggacaagctccaggagggccccaccaccctagtgggtgggcctcaggacgtcccactgacgcatgcaggaaggggcacctccccttaaccacactgctctgtacggggcacgtgggcacaggtgcacactcacactcacatatacgcctgagccctgcaggagcggaacgttcacagcccagacccagttccagaaaagccaggggagtcccctcccaagcccccaagctcagcctgctcccctaggcccctctggcttccctgtgtttccactgtgcacagatcaggcaccaactccacagacccctcccaggcagcccctgctccctgcctggccaagtctcccatcccttcctaagcccaactaggacccaaagcatagacagggaggggccacgtggggtggcatcagaagcaggccagtgagacagggcctgcccagggccctctgcatgcctctggcttctgcctggggctcccaggagtgtaagaacagtcccacaaccactgtggggacacctggcacccagactcccacaagggggcagtggggcccctgctcgtgccttagacatcttccgggcctccccagggccccccgccttctggctgcctccctctgctctcagggccaaggtgaggtggaggccactgtcacccctgagggtccagtcaccagagggtaattgagagcaacaggtcactcggggaagccctgccacagagaagccctccagcccatgggacccaggacctggcccaggggaggggcttttaaagagagggggaaagagggagaatcaacagatgaggggctgaaccagcagacagagatcaggcagacacatgggtagatcctaggacatataatgaatggatgggtggatggaggattggtagacggaggatggatgggtgggtaaatggctggatggaggatggacagatggatatatgatggatggatgaaggacgggtggatggaggatggatgagtggatgaatgaaggatggaagatggatggatggatgggtggatggactgatggatgatggatggatggatggatggatgatggatggatgggtaggcggatggaggatggaagggtggatggaggatggaagatagatggaggggtgaatggaggatgggtggactgacggaggattgaggatactggggtgggtgggtgggtagatctatggaggataggtgtatggaagataattggatggagaattgctttatgaatggatgaatgaagagatggaaaatagctttatagatggatgggtgaatggatggatggatagatggaagaaggatgaatggatggaaaatagctttatagatatatgggtggatatttaagtgatagccttacattaatagatgaatggaggatgaatggttgggtgagtgggtaggagtgttactgatggaggggtggatatacggataatagctttatagatggatggatggatagatggatggaaggatagaaagacaggtgaatgactggatgtatcagcatatgacaagcaggtacagctgtacatgggaggtctatgccctgagaccctgaggaaaatgaggatgcccgtgctggtggccctcacctggccctcgcttgtaacccctcagccacattccctgggaaggcaacagaggcctctggtcttgcccattcaacctttggcacactgagtgtcagacccaggtctctgtcttggacccagatctccttgagggtgggtgtgtctggtcctctctggccccgggacccagtcactgaatacgtggctgggactgagacggggtggggtgggaggggcgggagggtacctcgggctcaagcttcccttggagaagcagatggtgtccactttctgccctgccaagtctctccctgaagtgccctaagaatgtcaaagacagaaggtcccagcccctcacctgggactctgcctcctcatcctccctgggggagtctcaggccttagatggggacccagaccccactgtccccagaccccaaggaagcatagccgctgttcacacgagtctgggcctggcaggctcttgctgtgttgcagattggcagatgccgcctccctatgtggtgctggacttgccgcaggagaccctggaggaggagacccccggcgccaacctgtggcccaccaccatcaccttcctcaccctcttcctgctgagcctgttctatagcacagcactgaccgtgaccagcgtccggggcccatctggcaacagggagggcccccagtactgagcaggagccggcaaggcacaggtgggagcccaggagggggatgagcccacagtagatgaggtgggctgcagtgcttggctaagaggagagcaccacctgctcccactgtggggggacgtgctctcctggggggcccttcacagacactgaggacacgcgcaggcccagggtcagggctgagcttccctccagtgcagtaacgaggattccgtccaggctcccatgagccaggccagggctgagacagagggcgttggcaaggatgctgctccttcaggctgtgacccctctgtctttgcagggaggaagtgtggaggaacctcttggagaagccagctatgcttgccagaactcagccctttcagacatcaccgacccgcccttactcacatgccttccaggtgcaataaagtggccccaaggaaaatgttcacagactctgaatgaggagacgggggtcagggaaagggtggtggctttagactggagaacgcctgcttcaaagtccccctgggtgtcatggtggtcatggtgggcatggacagagggtacccctggtcccaaaatcaagaaatgacctgatcttgaatgaggctgaggcccaaggatgaatgctggattcaccagagaccatggcaaagaagcctgctcctaagaactacatgggatccctgttcctcataacctagacagccctggtcctcctcactgggtcctcatcctgatcacagggccctggtcctgaccagtgggcccgtttaccgatcactgagctctggtcctactacttggtccctgttcctgatcacttaattctagccttgatcactgagccttagtcctgatcactgagtcctactcctgtttttggccctggacctcatcactcagccctggtcctcatcactcagccccggtcctggtcactcagccctggtcctcgtcactgagccctggacctcctcactcagccctggacctcctcactcagccctggacctcctcactcagccctggtcctcatcactcagccctggacctcatcactcagccctggtcctcatcactcagccctggacctcctcactcagccctggacctcatcactcagccctggtcctggtcactcagccctggacctcgtcactcagccctggacctcgtcactcagccctggacctcgtcactcagccctggtcctcatcactcagccctggacctcatcactcagccctggacctcctcactcagccctggacctcatcactcagccctggacctcctcacttagccctggacctcgtcactcagccctggtcctggtcactcagccctggtcctcatcactcagccctggacctcatcactcagccctggtcctcatcactcagccctggtcctgatcacccagccctggtcctgatcactcagtcctggtccagatcacacagccctggtcctgatcactccatcctagtcctcatcactcagccctggtcctgatcacccagccctggtcctgatcactcagtcctggtccagatcactcagccctggtcctgatcactcagctctggtcctgattattagatcctgatgctagtcactgggcactgggcactgggccctgatcctaatcactgaaccctgctcctgatcaatgaaccctggccctgatcaaagggctttgctcctgatcactgggccctggtcatgctgtgttctggtccttacccctgaactctggtcctgattactgagtcttggtcctgatccctgagtcctagacttgatcactcaattccagtcctcatcagtgggccctggtcgtgatcactgagccctgatctggatcactaggctctggtcctaactcagtcctggtctggatcgctgagtcttgatcctgatcactgggccatgttctggatcaatgagccctggccctgatcactgggccctggtcctgctaactatgctctggtcctgaccactgagcccttgtcccagtcaacagtcaataactgagctctggtcctagtcaatagtcaatcactgagccctggtcctgatcactgggtcctggtcctgatcactgggtcctgttcttatccctgaatcttggtcctgatcactgagccctggccctcatcactgggtcttgttcctaatcactgggctctggttctgaccaatggcccctggttctggtccctgactcctggtcctgatcaatgggctctgctcttgacttctgagtcctggtgctgatcatccagtcctggtcctgatcactgggccctgattctaatcactcagacctccttttgatcactgaaccctagtatttatcactgagccctgatcctgatcgttgggccctatttctggtaactgagctctgatcctgaccactgacctctgttcctaatcactgagccctggaccagatcactggcccctggtcctgatcactggcccctggacctgatcactgacccttgttcccgattgctgagccctggacctgatcactgagccctgttcctgatcactaacccctattcctgatcactgagccctggtcctgattactgagccctggacccagtcaatgacccctgttcctgatcactgagccctggaccaaatcactgagccctggaccagatcactgggccctggtcttgatcactgggccctggtcctgattactgagccctgatcctgatcactgggccctgttcctgaccactgagccctggaccagaccgcggatccctgttcctgatcactgatctctggttctttaattatgcatattcattttgaaatctgattccttttctgagcatgtatcagtctgactagacactgagtcctgtctgatttctgagccttggccctcatgagtaagtgacctgcagtggtggagggaggcctccaggggagccgagaccctctcagtgcatgtactcactggtagatgaagaaatgaccccaatgacttgctccatttttccaggctcagaggggtgtgtaggccccaggaggacttggtggcgagaagaccagcccaggccctgtgagctacacccagccccagcccctaaggggtcgccaggtctcgacttagcactggggagggggtacagtacaggagtggggacaggaaggtgaggggaggccatgccgtttgtattctcttgcttttctctctctcctgaagcctcttgaatagacctgcagaaatacccaaaatagccctgtggggtggctgagtcattgtgaacacagcccaggtcaggtgttccagccagagaactgctgttctgagaaacatgccccaaaaccgagacctggccaggtgtgcctggggcctgagcgaggggctgcagccacaggtaggcccagccccaaccagcccagggtcagctagggctttccaggtccagggttaggcagaggtcagccagggtcaaccatggtctatctgaggggagagacaagagacacagagacatagagagagagagagacagggatggggagagacaagagagacaggaaaggagagacaaagacagacacagagagagagatggggatggagagagataagagacagggacagggagggacagaggcgaggccagtgacagagacagagttacaagagacagaaagagagagagatgagatgagagagataagaagaaacggagacagagatgggagaaaaagagaggagatgggaacagggaaaaagagacatggagacagacatgcagagagaacacaacagaggcagagaacacacagggagagaaagaggcagcaagatgggcccaggaactcagctgcaagcccctctcacacagtcactctcacaaacacacaccacgactattatacaacattcacacacaaacacacagaaacatacccacgctcacagccacacactaagtcactgtcacatccatacccacactcacacccaaacacacatggcccaggagcaaatggggagacctcagcctgcagctgggagcggccgagcgggcgctgggccagagtcggggcctgtctgtgggtggggggcacggcagcacgggcccacctgcacctacaaggcctggcccccgaggtcactgggccaccacccagccctcgccctgttccccgtctgtgctggccggggcaggactctgagcctccaggaaacctgcagatccacacaggacccggaacatcgggctggggtgggtaacaacatgggagaggcgggagcaggaggtcccaggaccctgcgcactgcgaccccagccctgggggctgaagcccaggacagcctcaggtctcccaggagggactggacagtgggggatggtcagagaacaggagagccagcagggtgcagcccgaggacagggatggacgctgggaggtcaacaggacaggggcaggggccgtggagtgggcgaaggtcctggagggcctagagaacctgtgggtccgtgtttgtgggaaggaggccaggagcagcccagagtggccaggctggcaggggtgaggaggtgggggcagtgaggtgagggtgaccgagccagtgaggcctctggccagggaggggaccttggctgggctctgactgaacccagggctcctggagaaggggccccaggcggggatgaggatgtgggcatctgactccatcaacaatggggcttccaacacgcacagcctgggcctcggagacctgggccctgacccgcctccccctggcactgggccgggtgccgtgtgtggtccccagtccccgcagcacctcccccacactggtcacgttccagggcccctctgaagcacctgctgtgaggggatgtggggaggggacagggacttgggcctgagctgccgggtcgggggggagtcggggacccaggctcagcgtgtggctggggaccagacagatggggatggaggaggacacgccctgtacccactgcctgccaaggggctggacccacgcccagtctaggccatgtcccccgaggcctgtgaaccttcactctgagccactaaaacattcaggagctttgaaagcagcccccgtccttgtcactatgcgatgactctgagcatcacgctgtccctgctggatccaccctccagccccagcgagggaggctgggccccgggcagcaggtggtgagggcagcgggcacagccaccctacagcacacacagggtctcagggacgcgtccaccacagcccgtgcacaggctcctcacggcactgagttcacccggggcgcgggccgtttgtcctcaggagtcccgctgtaccctccgcccccagccctgtcctgctgaggctgcagctgggtcccggggcacagggcggccctgagcactttgtcatcttggtccctgtcgggtgggctgctggctgtctgtggagctggcagagccgcggttcagccttggaggccggtcctggggcccagcagccgtggggagcactgcccagtcccgtgcccacagggaatcacctgggctgaggaagggcccacacgccgacgggatcggggtcaggcagcgcacgcctggcaccgagatcccacgtcccgaagtggggacacggcccaggggcactgttccgggagggtctcaagatggggtctcctatttcaatcttcactccttctgcacctgttagctgggaaccttctagaaggaggggtgtcctcaatcatggggtggttgtgagctgagcacagatcatgcaggaaggtacatggcttctccttcaccaggaaaacagtgcagagagacagagacacagagacagagacagagtaacagagaaagagagacagagagagacacagagacagagacagagtaacagagatagacagagagacacagagacagagacagagtaacagagatagagagacagagagagacacagagacagagtaacagagaaagacagagagacagagacagagacagagtaacagagagacagaaagagacagagacagagtaacagagatagagagacagagagagagatagagacagaggcaggcacagagataagaaagatacacagaaacagagagagacagagatagatagtcactgtcacattcatacccacgctcacctgctcacacactcacacactcacctcacactcacacacactctcacactcacagtcacttacactcacacacagtcacacacacacagtcacacacacactcacaaacacactcacacactcacacacactctcacacacacactgagcttccctcaggccctgtcacttccgatggggcctacggcctgtctaagcctctgggccaccagcccctggctcaccggtgtgtgcccaccacaccccgccttgggggtcccctctatgagctgggcacatgccctccgctctgttcatggctggcctgggggaaacagggcccacccaaggcctggctcagggaaggcctcaaacacacatggcccaggagcaaaggggcagagctcagcctgcagctgggagcgggcaggggtagtggagtgggcagagggcctggagaacctgcagggctccgatgtctctgggaagggggcccaggagcagctcagcgtggctgggccggcaggggcgaggaggtgggggccgtgagggaggggtgactcggctgtgtggggtgccgggggacacgggctttgctccggctgagcccaggcagtggcgaatccctgagctgccaggaggagagcagggccggggtcaggcagaggtgggccgcggggccgagggctgcggccggtcgggagcagtcggtcggttgagggcaccattacatggagggctgtgagacgggagaccccattcccttcattccttgtgcacgtgttagtgaggaaacttctagaaggagggcattgctcgtagtgggtgagtgtgagcacagatcatgcaggctggcgtgctgccgtgaagtgcctctctttactttccagacctcagcatggcaagcccgtcctgcgccccagggtctttctggagtacacgccgcgcggtcctggtgggcaccatacctggcacccacgctttggccgggcccgaaccttgcgccctcccagcccccatgtggctctcccttggccatactggccttttgccagtcctcctacctcaccctagggtctgcctggccctgccctcccttcctagccccccaaggaggctggagggcacccctgcgtccaccagcagcagctcctcatgggcgagtctccttgggccagtgacacatagtgtgccccgatggtgccacggcagcctgggccctccgccttcctgcttggcaggcacccccgctccctgcaccctcaccggggcacctgtgagccctgagggccagtgggggtctcactgctgctccctcccacagcctagcctcgggcctcagggctctgcatccaagcggcccagggctccctgcggtctcagcccgagtgggcctttgagccttcgcgttctctgcagggtgggacctgcccaagggctgctgagggcttcccaggggtcctgtgggtcccacctaggggcaagctggtgaggaaagtgggtcctgccatggcggccgggtgggctgagttttcggcatctctgggcccaacagcaggtccctggagcggcgcccacccctcccccaggcaggtgtgagggctctgatctgtttctccttgagtgactcattctgggcagacttggccctcagggcacatgcaaatggttgtttgttccacaccgaaaacatgtttcttgccctctgaggctgtttccagaaatagcttgcacgattctccacctgcagctgcagccgccacccacccagtgtggccaggctggcccaggcctccagattcggggacaccccccgccccctcccccagcgtggccaggctggctcaggcctccagattcggggacacccgccccctcccccaggacaggcccacttgggttactgacactgggaccaccctgcaaacgtcaactttattgaattcagtggttctgaacttgttgccatctttgggaccaggacccaggggcagcccccaggttggcaggaagggcaggggagccaacgctggcagggcccccagccaacccccaccccagaagccccaaggaggctgagcggaggtggccctggtggcctgggcacaggcagcccgattggtacagggccggtctggtgcaggcccgcacctcccccaccctcatggcctggtggtccccactgtacagagagaacactgaggctcagcagggccagggacatggcctgaggttacatggtgatgggggctgggtctccgggcctgggggccgtggtgggtgcagcacccggactgcgtgggctgtggcctccctgctcccagctctgtcacacccgtctccatctgagcctccagctccatctttcccgctgtccctgtctctggctacccttctgtctccctgtctctctgcctctctgaaggtatctccctgcccgaatctctgtctctgtcccattgtcggtgtctctgactcatctctgtcaagcccgtctgctgggctttgtcccgccatcttgcctgtcttggcctctctctctttctgtgtgtctccgtcggtgcctcctttctccatccatctctcccccgtgtctgtctctatccctccgtctctcttcccgtctatccctccctctgtgcctgtccctttgctgtgtccctttctttgcctctgtctctctgtctgtctcttcgtgtccctgtgtgtctctctctgtctctctgcttctatctctgtctttctgtatctctgtctatatctcagcctctttgtgtccctgtgtgtgtgtctctctcttctctgtctttccatgcctctgtctatatctctgtctctctgcctctgtatctctgtctgtctgttcgtgtccctgtgtatgtctctctcggtctctttctgtatctctgtctatatctgtctctctcatctgtctcttcctgtgtgtgtctctctgtctctctgcctctgtctctctctctctgtctcttcatctctgtctctgcctctgtgtcattttgtgtgtgtttctctatgtctctctgtctgtgtctcttcctctctgtagctctccctctctctgtctctccttatacctctctttctctctctctgtttctttctctgtctctttttgtctttctctgtctctctgtctctgtctcttcccctctatatatctctgtctttctgttgctgtctgtctctgtttctcttcagccctctctgtctctctttgtctctgtctttctctgcctttctaactctctttctctgtctctctgtctctatctcagtctctcttcttatctctgtctctatctctctctgtctctcactctctgtatctgtctttctcttatctctattgctctgtctctatctctgtctctctcatctctatctctgtctctatctctctttctgtctctctgtatctctctgtatctctgtctctgtaactctctttatctcttactgcctctgtttctctcactctgtctctgtctttctttatctctgtcttggtctctgtctctctgtaactttatctctgtctctctgtttctatctctgtttttctctgtctgtctctgcctatatctctgtctctctttatctgtctctctgtctctgtgtatctctgtctctctgtaactttatctctgtctttttctgtctctgtgtctgtgtgtctgtctctgtgtctctgtttttctctctctctctctctgcctatttttctctctctgtctctgtcaatgtctctttctggatctgtgtttctttctctctgtctctgtctctccatctctgtctctatctatctgtctctctgtaactcatctctgtctctatttgtgtctgcatgtctctttctgtgtctctgtttctctctctgtttctgtctctttgtttctctgtctctgtgtctttctctctgtctctgtctgtatctctgtgtttctatttctctgtctctctctgtctctgtctctctctttctctgttactctgtttctgtctctgtgtctctgtctctctgtaactcctcatctctgtctctatttgtgtctgcatgtctctttctgtgtctctgtttctctctgtctctgtctctctgtttctctgtctctgtctctgtgtctttgtctctgtctgtatctctgtgtctctatttctctgtctctctttctctctctgtctctgtctctctgtctttctctgttactctgtctctgtctctgtgtgtctctctctgcctctctgtctttctctgttactctgtctctgtctctctctgtctctctctgttactctgtctctgtctctgtgtctctctgtctgtctttctctgttactctgtctctgtctctgtgtctctctctgtctctctgtctttctctgttactctgtctctgtctctgtgtctctctctgtctctctttctctgttactctgtctctgtctctctctgtctctctgtctttctctgttactctgtctctgtctctgtgtctctgtctctctgtctttctctgttactctgtctctgtctctgtgtctctctctgtctctctttctctgttactctgtctctgtctctctctgtctctctgtctttctctgttactctgtctctgtctctgtgtctctgtctctctgtctttctctgttactctgtctctgtctctgtgtctctctctgtctctgtctttctccgttactctgtctctctctctgtctctctgtgactctatctgttactctgtctctgtctctgtgtctctctgtctctctttctctgttactctgtctgtgtctctgtgtctctctctcgtctgtctttctctgttactctgtctctgtctctgtgtctctgtctctctgcactgttttcctggtgaaggagaagccatgtaccttcctgcatgatctgtgctcagctcacaaccaccccatgattgaggacacccctccttctagaaggttcccagctaacaggtgcagaaggagtgaagattgaaataggagaccccatcttgagaccctcccggaacagtgcccctgggccgtgtccccacttcgggacgtgggatctcggtgccaggcgtgcgctgcctgaccccgatcccgtcggcgtgtgggcccttcctcagcccaggtgattccctgtgggcacgggactgggcagtgctccccacggctgctgggccccaggaccggcctccaaggctgaaccgcggctctgccagctccacagacagccagcagcccacccgacagggaccaacatgacaaggtgctcagggccgccctgtgccccgggacccagctgcagcctcagcaggacagggctgggggcggagggcacagccggactcctgaggacaaacggcccgcgccccgggtgaactcagtgccgtgaggagcctgtgcacgggctgtggtggacgcgtccctgagaccctgtgtgtgctgtagcgtggctgtgcccgctgccctcaccacctgctgcccggggcccagcctccctcgctggggctggagggtggatccagcagggacagcgtgatgctcagagtcatcgcatagtgacaaggacgggggctgctttcaaagctcctgaatgttttagtggctcagggtgaaggttcacaggcctcgggggacatggcctagactgggcgtgggtccagccccttggcaggcagtgggtacagggcgtgtcctcctccatccccatctgtctggtccccagccacacgctgagcctgggtccccgactcccccccgacccggcagctcaggcccaagtccctgtcccctccccacatcccctcacagcaggtgcttcagaggggccctggaacgtgaccagtgtgggggaggtgctgcggggactggggaccacacacggcacccggcccagtgccagggggaggcgggtcagggcccaggtctccgaggcccaggctgtgcgtgtcggaagccccattgttgatggagtcagatgcccacatcctcatccccgcctggggccccttctccaggagccctgggttcagtcagagcccagccaaggtcccctccctggccagaggcctcactgtctcggtcaccctaacctcactgcccccacctcctcacccctgccagcctggccactcagggctgctcctggcctccttcccacagacactgacccacaggttctccaggccctccaggaccttctcacactccacagcccctgcccctgtcctgttgacctcccagcgtccatccctgtcctcaggctgcaccctgctggctgtcctgttctctgaccatcccccactgtccagtccctcctgggagacctgaggctgtcctgggcttcagcccccagggctggggtcgcagtgcgcagggtcctggacctcctgctcctgcctctggcatgctgttacccaccccaacctccccagcccgatgttcggggtcccgtgtgtatctgtgggtttccccgaggctcagagtcctgccccggccagcacagacggggaacagggcgagggctgggtggtggcccagtgacctcgggggccaggcctggggtgtgcaggtgggcccgtgctgccgtgccccccacccacagacaggccccgactctggcccagcacccgctccgccgctcccagctgcaggctgagctctgcccatctgtttctgggccatgtgcatgtgtgtttggagcctttcctgagccaggctttgggtgggccctgtttccccaggccaccgatgagcagagcgctgtcagcttaccgaggggacccccgaggcagggtttcgtgggcacacaccagtgagccctggagctggtggggggtgagcgtgtgagggtgggagcgtgtgagcatgggtacaaatgtgacagtgacttagcgtcggggtttgagtgtgggtgggggtgtaagtgtgggtgagggtgtgagtgtggaagtgtgttagtgagtatatgaatgtgagggtgagtgtgagtgagggtgtgagtgtgtataggcgtgtgggttgtgtgtataggaagtgtgcgtgttgtgtgtgtgtataggaggtgtatgtgttgtgagtgtgtgatagttgcatgtgttgtgtgtgtataggtctatgggttgtgtgtgtggtgtatgggttgtgtatgaatgtgtggtgtatgggttgtatgtgtgtataggtatatgtgttgtgtgtttttgtggtacatgagtttgtgtgtgtgtataggtgtatgggttgtgtgtgtggtgtatgggttgtatgtgtgggtggtgtatgcgtgtgtgtatgagtgtttcgtgtatgtgttgtgtgtgtggtgtggtatatgtgtgtgtgagtgtgtggtgtatgggttgtatgtgtgtataggtgtataggttgtgtgtgagtttgtggtatatgggttatgtgtgtgagtgtgtgtacaggcgtatgggttgtgtgtgaatgtgtggtgtatgggttgtgtatgagtgtgtgtaggtgtgtggcttgtttatgagtgtgtatacaggtgtatgggttgtgagtgtgtgggtatggtttgtgtatgtggtctgtgggttgtgtatgagtgtgtggtgtataagttgtgtgtgtatataggtgtacgggttgagtgtgagtttgtggtatatgggttgtatgtgtatataagtgtatgggttgtgtgtgagtgtgtggtgtatgggttgtgtgggggggggtgtacggcttgtttatgagtgtgtgtataggtgtatgggttgtgtgtgtggttatggcttgtgtgtgtttatggtctgtgggttgtgtgtgtgctgtatgagttgtgtgtgtgtgtataggtgtttggttgtgtgtgtttgtggtatatggattgtgtgtgagtttatgtatagatgtatgggttgtgtgtgagtgtgtggtgtatgaattgtgagtgtgagtgtgtataggtgtatgtgttgtgtgtgcagtgtatgggttgtgtgtgtgaatgtgtataggcatatgggctgtgtgtgtgtgtggttatggcttgtgtgtgtttgtggtctatgggttgtgtgtgtggtgtatgagtttgtgtgtgtggtgtatgggttgtgtgtgtggcatatgggtgtgtgtataggtgtatcatttgtgtgtgagcgtgtggtatatgggctgtgtgtgagtgtgtggtatatgggtgtgtgagtgtgtataaatgtatgggtttgtgtggtatatagattgtgaatgtgtctgtggtgtatgggttgtgtgtggtgtatgggttgtgtgattgtgtataggtgtatgggttgtgtgtgagtgtggtatatagtttgtgtgagtgtgtggcataaagtttgtgagagtgtggtatatgggttgtgtgtggtatatggctgtgagagtgtatataggtgtatggtctgtgtgtgagtgtgtagcatatagtttgtgggtgtatgtggtgtagttgtgtgaatgtgtggtgtatgggcgtgtgagtgtgtataggtatatgggctgtgtgagagtgtggtatatgggttgtgtgtgtgtgctctatgagtgtgtgtaagtgtatgctctgtgtgtgtatggggggtgtgtgtgtgtatatataggggtaggggttgtgagtgttttgtgtatgggtgtgtatgtatgtacacggggtgtgtgtgtgggacatgggtgtgtgtgtatatgtgtatgtgttatatatgtgagtgtggtatatatagtgtggtgtgtatatagtgtatgcgctgtgtgtggtgtatgtgtgtgtgtgtatatatgtatgggttgtgtgtgtggtatgtgttgtatgtgggaaataggtgtgtgagtgtatatgtgcgcgcgctgtgtgtgtgtgtgttatatatgtgtgtgtatatgtgtatgggttatgtgtgagtgtgtgctacatagtttgtggtgtgagtgtgtactgtatgggctgtgtgtgtggtgtgtgggtgtgtgcgtataggtgtatgggttgtgtgtgtgtggtgtatgggttgtatgtggtatatgggtgtgagtgtgtataggtgtatgggttgtgtgagtgtgtataggtgtatgggttgtgtgtgagtgtctgatgtatgggttgtgtgtatgtggtatatgggtatgtgagtgtgtggtatatagtttgtgagtgtgagtgtgtggtgtatgagctgtgtgtgtgtggtatatgggtgtgtgagtgtatataggtgtatggttggtgtgtgactgtgtggtacatagtttgtgagtgtgagtgtgtggtgtatgggttgtgcgtgtttggtatatgggtgtgtgagtgtgtggtatatagtttgtgagtgtgagtgtgtggtgtatgagttgtgtaggtgtgtggtgtatgggttgggtgggagtgtgtgggacgtgactggataagttcgtgagtgtgagtgtgtggctgtgggtgtctgtgtgtctctgggtgtgtgtggatgggggtatgtgggtgtgagtgtgtgtgtgaggtgtgggtgtgggggtgcactgcgtgtcctccctgggggtggcccctgagagtcggggcctgagcccggatgtctccgtgactctgcatgtctccctctgcctccgtctctctgctttgtgtctgtctctgtcatccctgcctcgctggaaaggtgactggataagttcgtgagtgtgagtgtgtggctgtgggtgtctgtgtgtctctgggtgtgtgtggatgggggtatgtgggtgtgagtgtgtgtgtgaggtgtgggtgtgggggtgcactgcgtgtcctccctgggggtggcccctgagagtcggggcctgagcccggatgtctccgtgactctgcatgtctccctctgcctccgtctctctgctttgtgtctgtctctgtcatccctgcctctgccccatccctctgggtcctagaatctgtccaagtctggggccgcctcccaggaagccccacaagtgtccaccaagggatgcacggaggacaaactgcagtgcacacatacgaggaggctgagtcaccagagcctccacgctagtcctgccccgactccccgggtcagggctccaggccccaagcgccgcccggctcccccctgggctggggcctgtatggggctgggagtctggaggctcagccctgcgggggaggtgtgagcaaacccgcctgcactgcgaaccaagcacaggccatcccctgacactcagacacgcagagacgtgcacagacacatacacatacgcacagacacacagacatgcacacacagaaacgcacagacacacagacatgcacacacagaaacgcacagacacacacagacatgcacagagacacacacacagagtcatgcacagacatgcacagacacacacacacacagacacacagacatgcacagagacacacacgcacagaaatgcacagacacacacggacatgcacagacacacacatatgtgcacagagacacacatatagacacacatccacatggatgcacagacacacagagacacacacaggcaaacacatacacacacagacacataaagacacagacacacggatatgcacacacacatacagacacacatgcacgtggatgcacagacacacaccgacacacatagagacacacacacacacagacacataaagacacacacagacatgcccgcacacaggcaccccctcccgcaggtcacgcttgcagcccctggccactgtcctgccccgtgtcatgaacctgcctcccctgttgctccacgccaggacattgctgcctgaccacagcctggaccacctgctcagccctatcagtgcggacaaaggccttgtcctggcggtgacaatgagccaggcccactgcacacttgtccacaccacacacctgtccaccccacacacctgtccaccccacacacctgtccaccccacacacctgtccacactacacacccgtccgcatcacgcacaaccgcacacctccagctcatccaccactcactgcacacacgcttgcatctcacacgctcatgctcacactcatgcactaacacacacattctcccacctgttgccaagctcacacacgtgcacacatggcgttgctgggccaggctttggcacatggggtcagggaaggctcggagagcgtacgccttggcctctctggcggcatgtccgggtctgcggggcagaggtcacagttgctgccccacgacaccgcatgtgcccctgcagggcctgggaatggcaccccgcagagcccgcactcagggccagctcgtgtcagcaccgcgtggaccacgtcccgaggacacctgggccagccagtgctgcgggctgcagcgagtgtgtgtgcacacgcatgcccatatacgtgttgtgtgtgcttgtgtgcatgggagggggtccctgggtgggccagggtctgcctcgggggctggagtgggaggcctgggcccctcagctttcctccaacccagcctcacttccccgcccctctcacctctgcgtggccaccagccagccctgggcttggccccggcatgaggcctgaggcagggccctggataacgctcaggacgggcacctgggccttctgggcctcctcgccaaggaccagactcggcctcagcgcctcacactcatcgggggtcatgccctggggcccagccaggaccctcgctgccccactcaggaggctggacacactagcaggtgggggggccgcagctccccctcccccacccccgtccagtctgaaaaacaagacctcatgggcaccgggccgcagctcccacccccaccccaccacacaggcacaaacacattcttgcaaatatttctaaaaatgctgaaaatgggaaccacagagcaggtgggacagtggtgtggaaacccccacccacctccgagatggcgatttgcattgggggaggtggggggaaggctggcacccaggcagctggtttgcaggattcctgactattcacactccccagccacaccccatgtccaggccaatgctgtggccaggcccagagtgaccaggccccagggcacttcccagaggactgcctggtggagggggtaacaagtcggaccttgccccaggggagctgggccagggaggagacccctgcatggaggtcccaggcatggcccccaggaacaggacccccagcaccctcggaagaggattttgtgggtcacctggggacagagcttcctccgtgcacctgctgggcccctcacagcccacctgtcaccaaacctctgtcctcccctgtgcccaggcctggccaacccaggcgctttcagcccgtagaccctaggtggggtcgcccaaccctaccccggcctcaggaccctctggggttgccccacgagaccaccccagaacagacctgcccaaccccagccctgcatcttcagtgggacacagaggcctccataggaccccaccccacacccaggggctgtccggggcccatcaccccagcagctgagaccctgggagatgacaccctgtgcctagaacagggtggaccacatggggggacattgtgacccgtgtcccagccaggcaggacagccccaccccagcctcctagaggaggggtctgtgcctgcgcccaccccctcagtggaacctaagccctccagggaggactcaagtttgaggaaaggatccctgggaagacccccagggtgcagcccgggtgacagggctcagggggcccttcctgcacatacagcctcccacaaatatagtcatgcacaccccacagagacacacagaacacacaaacacacagagacacagacacatagacagacttagagacataaagacacacaatacacacagacacactaacacacacacagacacctagacacacatacagagacagacacacacaaacacacagaaacacaagcacacataccacacacacacgacacacagatacacatagacacacacagagacagagacacacacagacacagagacacacaaacacagatatacctcacacacacacacacggacacacatacaaagacagagacacacacaaacacacagacacacaagcacagacacactaccacacacatacaggcacacagacacatagacacatatacagagacagagacacacacagacacagaaacacaagcacagacacactaccacacacacagagacacacagacacacataggcacacacagagtcagagacacacagacacagaaacacaagcacagacacactaccacacacagacacgcataggcacacacagagacagagacacacgcagacacaggtacacaagcacagacacgctaccacacgcagagacacacacagagatagatacagacacacataaagtcagaggcacacacagacacatacagacacacagaggtacacggcacagacacacacactcagaggctcacactcagccacagccacgtgcacacagctcacacggcccacactcaggtccacaagggctcacagcgtcacagaggcccccagtcccacagccagacaagcacaggccgtgctcacgctcacacactgacgcacacattctcccacccgctgccaagctcacgctcacacatgcacacgtggcattgctgggccaggctttggcacatggggtcagggaaggctcagagagtgagcatcacagacacagggtgggactggtgtccggggggtccatgagcagccgaggggcagccctgccacgcccacaggccccaggtctattctcaggcacccgcctggggctgggggcttccttctgggaactcgaggacctccgttctgcacggagacacacgtccagaaagggacaccccagggccacacccagacacacccagcccgactcgggcacccagcacacgccaggcacacaacaaacacaggagctggcacacgcctggccccaggccaggacagcagcaggcaactcggccagtgcacacagccgctcacacacaccacacatccccacaagccctcacaccctcacatccccacacaccctcacagatcctcacactcccacacatccacacacatcctcaaacaccccacacatccacacacaccccacacaccccacacatccacacacaccctcacatccccacaccctcacacaccccacaccccacacacccccacacatccacacacaccctcacatccccacacacccccacacatccacacacaccccacaccccacacacaccctcacaccctcacacatcctcacactcccacacatccacacacaccctcacatccccacacatccacacacaccccacacacccacacacaccctcacatccccacaccctcacatatcctcacactcccacacatccccacacatccccacaccccacatccacacacatccacacacatcctcacacacatacacacaccctcacacaccacacacccactccctcacacaccctcacacaccccacacatccacacaccctcacactctcacaccttcacacatccacacacaccccacaccccacacgtgcacacacaccctcacatccccacacatccacacacaccccacaccccacacaccccacacatcctcacatccacacacaccccacacaccaaacacaccctcacacatcctcacactcccacacatccacacacaccccacaccccacacatccacacacaccctcacatccacacacatgcacacacaccccacacatcccacacatccacacacaccctcacaccctcacactccctcacacccccacactctcacacccccccactctcacaccctcactcacacactctcacacaccctcacaccctcacagtctgaaaacttcacacaccctcacaccctcacacacccacacaccctcacacaccgtcacacactccacacataccctcacacactctctcacacacacccttacaccctcactctcacacacccacacactctcacacaccctcacacatacacacccttgacagcttgcctgcagtctgtcagaggggtccctcagagggccaccacgccctgcggatcaggtgcccagaatccaccatccagcggctctgggcctttcccctctcagctcatgacctttgggtaccacggctcaggggtacccctgtgctccccagctgccaatccctgcatctccttgggcccctgctgacctctccagtggcctcagggtgacgtcctggccaggccctgtccctctgcagccacctctgcccactgccccaccacctgcccagggctcccccaggctcccacaccagccgtgggggtctctcaggcaggccggccaggtggcaccacggctcccccaagggcagcaggtcaggcgtgagcattgccgtctcccatcccctcctgctgagcccccacaggagcctggcagcccgatcctgtcgccatagtgagggcagctcctggcccaccaggcccagtccacaccagccggccgcaggcagcgtgtctgggagacaccccaggccgcccaccgcccagcaggggacaagccagcccccagacccgtgccctgcacagggggacggggctcagacccaggctgcccttgacagcaggagctgtggtgggcccacggtggggaccactggggacaggcctgggggcacacaatgctcctgaggggcctcaggctgcgtcctgggttggggcactgttctgtgagtaggtgacatgtcaccttgaaagggcttctatttcactaagagaaaaggtggaggctttcctgggggagggcggtgcggtgttgtgtgggacagtgagagagggaccaccagcacagacaaaggagaggaaagtgcagggggggtgggggctgcagggacagaggcttggggaggcgctggaaccgcagggcgcgggcctggggggcccacacgccacctcgagggaccgcacctggggaccacagacgcaggcccactcgggctctggagggccctcctggggctgcctggccacgctctctctctcctggtcccagatcccctccacggcccctccccacccgtccatccagaggttgcccagggctggtcagaaggggtcacatgacacccccaggaccggctggaagtggagggatcgtggtcccgcaattcaactcccacccggcactccccactcaacatcacttaggacagttatattgtttcgggttttttttttcttctgtattaaaagcattaacttccaatactgcttttataaaacacacatgcactgtggtgaggacgttttgttaaaatgaaagggacaagccggggctggacggggaagccccctggtggggggacacgggaggggcaccctgcactcacagaaaagcccctccattctttgcacgtttcaaatgttgtattttcaaatataattaagcgacgtgggaggaagggcaccgcgtgctaggcaggagcagccccctcctgggagggagatggcagacaggggacagggtgggggacagggtgggggacagggtgggggacagtgaccaggtgaggaaagatgcgggtcagggactgggggtgcaaatggggaggtggtgggagacgaagcccctccaaacctgacgccccgccgcttcccgagcccggggttcagggcttcctgttttcctgtgtgattatgagctcctgctcctgccctcgccccacgcgcgagtctcccctggaaggatgtgcaagcttttcacaagcaccacagactcttacaacccgggaccacctgggaccccaggcggtcaggaccagggccaccccacacggcaggcaccagcgctcctgacctgggctgcagaacagcctgtggtcaggcaggggctcccactggcccctgtcctcggcaggcccttccccaggagcagcgtccgggagctcaagacaggcttgggggctgcccgtccacctggggaggatctttgcagggccctttctttctcactaaacagcttgcctgtagaaaggagaattcgaagggatttaaatccagtatttttactggttttccccggggctagccagggtgtctgccccacctgctggtggaaacgaagttcccactctggccttctccgttagggctttatttcatggaggttgcatatgcccgcctccctgcaatgcgatggtgaggccagggactggggatggggcaaggcctggaagggtgtgactgtctgtgaggtggggatgggcctgcagagggacgtccgggaatacacggaggcgtctcgcaccgacaccggggttcactgtgacgggaggggctagagaccatctgagtgggctggaatgggggttgtcgcacacccctcgggggtggatgtgggtgcccagcaagagaagcagacccggccccacaggaggctgcagatggaagcttcagaggcggctccggggctgccacaaaccccgcccctccacgtgcctccctgtcccgggagccgcccctctgacccccaggcccttccccggacgtcccagctgctccacagcccaggcttctcccctcctgcccccatggaacccccaccctgggctgtctgggcctgcctagccggccgtgtggggtcccccaggcccgtggcccaagcacccatctccgtgtccagcgcccagcgcactcggacgtttcacacgcgggcctctggggaggacccccaggcaccgccagcccaaccccggcggccggaaactggacccgctgcggcagccgctgaggctctgctgcccccgtgtggccgacagcagcatcgaacgccgccgaccacgcggcgcttcccgggctcggggcaggggcaggggcaggggcacgggcaggggcaggggcaggggcaggggcaggggcagggccagggccaggggcagggccaggcgtgctctcggggccggatcccggctctgccttgggctcagggctggggcccggtccgtgtccagcactgtgatcccctcccctccccagcgcctgccgcggaggtggctgtggcatccgcgaacaggcatcagcttgtggggctctgtggtctgggatcccagcctctgccaaagtcctgcattccctgggtgtggggacgctgtgacctggggacgctgtggcctgggggccttgcaaggctgcacctggggcagatggggaagctggcctgggctcctcggtggggccccgcgccccccacttctgccggcagcatccgatgctccctgaccctggtcaggacccttcctcctggcgtggcccagtgtccccgcggaagccccagaacgcggcctgcccgggagccggctcgggcctggggcctgcgggtcttcactatggtcgcgaatggacccacgggatgctgcatgaggcgcacgagcttgaggcaccagcctccggccactgtccctggaggacaagggacgcggctccggagcagagggtcctcccctggggatgccctcccggcggctgggtgtggggctgggggctgtgcccggaagtgggtgggtgggagaagccctcctgagcacagaggacagcagccaggcccaggcccaggccctgcaggcccccaggggctccagagccccagagaggaggaaggcctccgtgtgctcagaatcagctcacaccccggggacgaacctcagagggccgggacaaggaaaggaaggccccggcccaacatcggggtctgggcgctggtgggacagggcaggctcagccttggggccggtcagggccctgttggggttcgggtccccctgccaggtccgcgtctgcagccacagcccctcaaccccagcagggaccccagagaccggctcgggaccccctggtggccgtcttgtgccactgcagttctgctgctgagaggttcccggggttcccggggttcccggggtccctggcccggcagcctcctgggctcccaggcaggcgcgctctgccgtccgctcatgcggggacagcggacctcagaggcaagcctaaaagacgcgcccagatcaggatcccaggaacccagctcacatacaaatcagaaaagccctaaagaagcagaaacaagaatcagtgaaacaagaaactatagaataagaacccaaacaaaagcaaaatgtcggcgttatcagacatagaatatgcaatgtgtgcttcagagggtttttttgtttgttttgttttgagatggagtctcgctctgtcgcccaggctggagtacagtggtgcgatctcggctcactgcaacctccgcctcccgagttcaagcgattctcctgcctcagcctcctgaatagctgggactacaggtgcccgccaccacgcccgactaatttttttggatttttagtagacacggggtttcaccgtgttagccaggatggtctcgatctcctgacctcatgatcttcctgcctcagcctcccaaagtactgggattacagcgtggccaccacgctcggccaagagattttttaaacttacttacagaagctattcaaatattactgcaaaatgggaaattactgcacattgcattttgaaatgacctgagagttttacgaagaacttctagaattgaaaaccgtaatagatgaggctaaaataagaatggatgggacaggcagcgcagaggacacgcaggagcgggagctggtaacaccgaagaaagagcaggagacgccacccagcccgagcgcagccccgcggaggctggacggaggctcccacaagggcttcttctgcccaaaggagaaacagagtcgggggaggcagtggctgggaattttccaaaatcgctgaataacaggacgcgtcaggatcaaggccaagtcccaagcaggataaataaaagcaaactccacgtccacaccttgacgcttgccgatggagctgccaacaccagaggcaaagagactttagaagcatccaaaaggaggccgggcgtggtggctcacatctgtaatcccagcacttttcgaggcagaggtgggtgggtcacctgaggtcaggagttggagagaccagccaggccaacatggtgaaacccggtctctattaaaaacacaaaaattagctggacgtggtggcgggtgtctgtggtcccagctactcgggaggctgaggcaggagaatcgcttgagcccgggaggcggaggttgcagtgagctgccatcgcgccactaccctccagcctgggagacagagtgagactctatcaaaaaaaaaaaaaaaatccgtcagggccggcccaggcaggtgcactcgcgcggccacagactccagagccggactcgggagccccccggcggccgtcccgtgccactgcacgttctcatagacaggagagtctcaagaaccctggagcaaacaagacgcctggagcagcctcccagcatctactcacctctgccggccgtttacacccgaaagccacccctcaagaccaggacaacggtgacactttcatacaaagggcacaggcacttaactccgcacgctggctgctggcgcctcctaagagtgtgtttagaaatgttaaagaaaaaattattccatgatagttgttcaatgcggaggcaggtgtgattcaggaccaccgccgcaggagcagggaccacggccatgcgggagagagatggggctcagttcttaacacagcatgggctggcggggattgacagccagggagctgggtaaactcggaggacggacattcccaagaggaaatattggggggaaggagggttctggctaaattagcccaggaagatttttgctgaagacagaccagggtgatcagacctgggagatggtggaagatgaggaactcaggatcaagggtgatcaaatgtcaagagtgggtctttaacctgatttaggggggttctttttttttctttttttttttttttttgagacgtagtctcactctgtcaccaggcagtggcacgtgtcatcgtgcagtggcacgatcttggctcactgcaacctctgcctcctgggttcaagcaattctcctgcctcagcctcccgagtagctgggattataggcgcgtgccaccacacccagctaattttcgtatttttagtagagacagggtttcaccatgttggccaggctggtctggaactcctgacctcagatgatcagcccacctcagcctcccagagtgctgggattacaggcatgagccaccgctccgggccccaccgggtactttttaaagcctttttcttacaaggaagtgcaggccggcctaggagaagtttccagagcccgactgcagtttagccaagcagagaatctttgtcagtccacactgtttaaggaaagaggagacattctcgtttccctccaacaatataagtccattttcttgttgggtggcctttcgttcattaagaaccagctggattttctgttgggactggatagaagaggacatttcgccgcatggtgctagcagttggacattcgaagaggagagactctgaaaataaatgaaacacaaaggttaacacttagaaatgcagtttctgagcccagtgggcaccaggccagaagatttctagacgctgggcctgaagcatcttcagctgcagccaggtaggcagctgaagggccttcctgatttgcaggtcaggtgttgcagaagctgcccgcacaggatctgtggggatgatttctctgaagtttacatcaacttgtcccatttcagctcacagggcttcaggaaaagggcagttttaaatttgactgattccaagtcagagggtgagggaaaaattagtttgcagagttgttgcctgatattagagaaaactagaagaattctgaaggggccagcccctccacacctgtgggtatttctcatcaggtaggacgagagactgagaaaagaaataagacacagagacaaagtatagagaaagcacagtgggcccaggaaaccggcgctcagcatacagaggacctgcaccggcaccggcctctgagttccctcagtatttattaattactattttcactatctcagcaagaggaatgcggcaggagaacagggtgacagtggggagaaggtcagcaagaaaacgtgagcaaaggaatctgtgtcacaaataagttcaagggaaggtactatgcctggacatgcacataggacagatttatgtttctctccacccaaacatttcagtggagtaaagaataacaaggcagcattgctgccagcatgtctcgtctcccaccacagggtggtttttctcctatctcagaatagaataaatgtacaatcgggttttataccgagacattccgttcccaggggcaggcaggagacagaggccttcctctatctcaactgcaagaggccttcctcttttaccaatccacctcagcacagacccttcacgggtgtcgggctgggggacggttaggtctttctcatcccacgaggccatatttcagactgtcacatggggagaaaccgtggacaatacccggctttccagggcagaggtccctgcggctttccgcagtgtattgtgcccctggttcatcgagactggagaatggcgatgacttttaccaagcatactgcctgtgaacactttgttaacaaggcacgtcctgcacagccctagatccctgaaaccttgattccatacagcacaggtttctgtgagctccaggttggggcaaagtggctggggcagagttacagattaacacctcagggcaaagcagttgttcagggtacaggtcaaaatggagtttcttatgtgttccttttctacatagacacagtaacagtttgatctctctttcttttccctacatagccccctttccttttgacaaaaccgccatcgtcattatggccccttctcgctggtcgctgtctcttcagagctgcgggatatacctgtagactttgtttttttcaggcttttcttagctaactgtgtcagctcctgtatttggccccaggtcagtggctttgcttccttggtggatggcaacttcttctgtaagttgtagatactaaattggaagctggttttttcctggggaaatacaagcaaaacttctcccccatgttatcaccttccctatttcccatgtcttgtttttgttgtctttccaccacatcagttttccttcatgtgggctgctctttttgccagtaaaatgttgttctgcagaagtagtggtctgatttctataaatgtttaaacaatttaaagtatagattgctaggttaagttgcatctggggagcgttatactcctgtctttttcttctttttgtttcaccagttgagattttgagtgttctattagttctttcaattatggcctgtccttgggaattatacaggattcctgttgtatgtgtaattttccactgatttaagaatttttgaaatgttttactacagtatcctggcccattatctaattttttctggaactcccatgacagcaaaacaagacaataaatgtcttttaacatgggaagtactttctcctgtctggcaggttgcccatacaaaatgtgaataagtatcaactgtcacatggacaaatgataattttccaaatgaaggtacaggtgtgacatccgtttgccataacgcattaggacatagacctctgggattaacttctgcctcctgagtgggcaggtgtaggacttgacactaggtgcaatgctgtacaatattttttgcctgtttccatgtgataccaaatttattttttagtcctgttgcatttacatgagttgaggcatgaagttcttgtgcttccatgaaggcagatgacactagcaagtcagcttgttcatttgctttagttaaaggccctggtaaattagtatgcgctcgaattgagtaatataaaatgggaaatttctttttctcacagtttgttgtaacaaattaaacagctggtttaactgatcatccatgctatatttaattagggctgtctcaacatcctttgtaccctgtactacatatgcagaatctgatacaatgctaataggctgattaaaatcttataacactgaaatgacagcaaccaactctgctctttgagctgagtgatattgagtttcagtgactcgttcttttggcccagtgtaagccacttttccattgctagaaccatcagtaaacaccgtcagagcatttttttaaaggtttctgtctggtaattttaggtaaaatccaagtagtcaattttaaaaactggaagattttcgttttggggtaatgattatcaataattcccacaaaatcagcaagacccatctgccatgcaccagaatttataaaggcttgtctaacctgttccttgtttacaggaacaatgattttatctgggtcaattccacacaattttattattcgtaattttgcctgactaattaatgtagccgtttgatccaagtgcaatgtaaaagtcttaatcgtactgtgaggaaggaaggaccactccacaagatctgtgttttgaacaatgatgcctgttggagaatgtgcagtagcaaaaatcaaaagtcggagtggggctaagtggtctattctatttacttgtgctggctgaattttttcttcaactaattcaatttctttcgtggcctctggagttaatgttcttttactattcgattctggatccccgctcaagatagagaacaaatttgacatggcattaagtctacaagtttgtgtcctatcctgaggtcgcagggtgctccactgagtgaggactgcccgccccacccagaggtgtcggttacttcaccatggcagttgtggcccctgctgctgcacatgccgccccagggggcactgcctcaggaaagccaggcacacccaagggtgcaggaatggcaggccctggcggtttggcgcgcaacagccggaacaagtacatgcgctcgggcctctgttccaccttcaccatccagtctctgcagccgcagccaccccctcagcctcggcctgcagcggtgctccccaacgcagctcctgcagtccaagcccctgggaggcctgcctggaggctgaggaagccggcttccctctgcaggtcatcctgaccccgcccgaggccccaaacccgaaactggaagagccgaatgtggagccgggcttgcgccgccctttgcccccggaagtggaagtggaagggcccgaggaagagctggaattcgcgggggagagagggttcgtgccagaaaccgccaaggccgagcctgaagtccctccacaggagggcgtgccagcgtggctgccgaggtccttatggacaccgcagggcaggcgggcggccacgcggcttccagccctcagatctcccagccgcagaagggccggaagccccgggacctagagcttccactcagcccgagcctgctaggtgcgccgggacccgaacggaccccaggatcgggaactggctccggcctccaggcgccgaggccggcgctgaccctgtccctgcttcctacgcacacgttgaccccggcgctgctgacacccagctcgctgcctcccagcgttcacttccggagcagcctgagtcccgctgcgccccgcagcccggccaagctctcctgccagcttccgtccagtggcggcgcccaggtgcacatcccttccatcggcgtggctggcctctcgacccccgcggtgctctcgccagggccgcagaggccatgaccaccaccagcaccaccaccccttctggggtccctccatccgtgctctctcaaggagaaacacagttcaactgaaagactcatgctctgattgtggtggggtggggatccttgggaaggatttctcccaggagtgactctcattaactcctccacagaaaacactcagcttccacagcttctctcttttctctcttttctgtccgtcccccagtggctgccctgacacgtctcctacttcaatggtaggggcggtttatttatttattttttgaaggccactgggaagcgcctgacctaacctattagggtggtcaggacgtctcccccacctccccgcttttttccccaagacaggacaatcggggtctgacttgagaacgacctttctttcttcattcctcggcctgcccgtggggagatgagggagccctgtgtccattttaggatgtgagtagaagttagtttcgttttattattcctggccatactcggggtccaggaagaatttgtaccatttaatgggttgggagtcttggccaaggcagaatcacacccttggaatagaaatttccacctccccaacctttctctcagacagcttatccttttttaaccaactttttggccagggaggaatgtccctttgttcttcttccccctgagaagccattcctttgtctgccaaactccctggggtcctgcctgtttcctcccatggaggggttttgtgggggtggttcctgtctgggggggcccctccagccagtactccaggtctccctgtctctcccgtgctgccattttgatagtataatctatttttaaatggggcttttcaataggggagagggagtcatctcttcctatatttggtggggtgggtgtgaagaaagggatttgggagggaatcttcctgccgcctcccccccagatgtttatttttgataacaaatgtgtattttcagttccctccctcccagccccccaatttcctacaggtaggtacaaaggacactttcaatgtccctggaggtgggagggaggaatgggggacataaagcctgtcctgtctctattctaggcaggaagagtgggttcaaaagactcctgggcttccctgtcagccctggcccagcccaggccttgggacctgggggttggtgatttgggggacggtgctacactcgtctccactgttttgcttccccaaaatggaccttttttttttctaaagagtcccagagaatggggaattgttcctgtaaatatatatttttcaaggtgaaaaaaaaaaaagaaaaacctgccataatgaagagcagaccaatattccagaaaactgtcactttaacagagaagaccaaattctagtttcacatgaactgttaatattaaagctaattttaattaaaccttataaataattccatccaggctgggcaaggtggcttacacctgtagtcccagcattccaggagggtggatcacttaagcccaggagtttgagatcagcctgggcaacatggggaagccctgtctctacaaaaaatacaaaaaaaaaattggccaggcatggtggcacgtgcccgtagtcccagctacttgggaggctgaggtgggaggattgcttgagccctcccacctcaacctccctcagcctcagtgctgagtgccactgcactgctgcctaggcaacacagtgggaccctgtctcaaaaataaataaataaataaatccggccaggtgcagtggctcatgcctgtaatcccaacactttgggaggcctaggcgggtggatcatgaggtcaggagttcgagaccagcctggccaacgtggtgaaacccctgtctctactaaaactataaaaattagctgggcgtggtggtgggcacctgtaatcccagctactctggaggctgaggcaggagaatcgcttgaacccaagaggcagaggttgcagtgaaccgagatcacaccattgcactccagcttaggcaacaagagtgaaactctgtctcaaaaaaataaataaataaatccaatcacagccgcctttgaccacataagatcccttttccacaatccttttacaactttttatttgtttgttttttgttttgttttgttttttgtttttgtttttgttttttttgagacaaagcactgacctggctgccgagccccgccccctaggctgcaggggtgcctgcagaagggcaccacagggccaccagtcctgcaagctttctggggcaggccgggcctgactttggctttggggcagggagggggctaaggtgaggcaggtggcaccagccaggtgcacactcaatgcccgtgagcccagacactggaccctgcctggaccctcgcggatagacaagaaccgaggggcctctgcaccctgggcccagctctgtcccacaccgcggtcacatggcaccacctctcttgcagcctccaccaagggcccatcggtcttccccctggtgccctcctccaggagcgtctctgagggcacagcggccctgggctgcctggtcaaggactacttccccgaaccggtgacggtgtcgtggaactcaggggccctgaccagaagcgtgcacaccttcccggctgtcctacagtcctcaggactctactccctcagcagcgtggtgaccgtgccctccagcagcttgggcacccagacctacacctgcaacgtagatcacaagcccagcaacaccaaggtggacaagacagttggtgagaggccagcacagggagggagggtgtctgctggaagccaggctcagccctcttgcctggacgtaccccggctgtgcagccccagtccagggcagcaaggcaggccccatctgtctcctcacccggaggcctctgcccgccccactcatgctcagggagagggtcttctggctttttccaccaggctccaggcagccacaggctggaagcccctaccccaggccctgcgcacaaaggggcaggtgctgcacttagactggccaagagccatatccgggaagaccctgcccctgacctaagcccaccccaaaggccaagatctccactccctcagctcagacacctctcctcccagatctgagtaactcccaatcttctctctgcagagcccaaaaccccatgttgtgacacaactcacacatgcccaccatgtgcaagtaagccagcccaggcctcgccctccagctcaaggcgggacaggtgccctagagtagcctgcgtccagggacaggccccaaccgggtgctgacacgtccgcctccatctcttcctcagcaactgaacccctggggggaccgtcagtcttcctcttccccccaaaacccaaggataccctcatgatctcccggacccctgaggtcacgtgcgtggtggtggacgtgagccacgaagaccctgaggtcaagttcaactggtacgtggacggcgtggaggtgcataatgccaagacaaagccgtgggaggagcagtacaacagcacgtaccatgtggtcagcgtcctcaccgtcgtgcaccagaactggctgaacggcaaggagtacaagtgcaaggtctccaacaaaggcctcccagcccccatcgagaaaaccatctccaaaaccaaaggtgggacccacggagcgcgaaggccacgtggacagaggccggcttggcccaccctctgccctgggagtgaccgctgtaccaacctctgtccctacagggcagccccgagaaccacaggtgtacaccctgcccccatcccagaagatgaccaagaaccaggtcaccctgacctgcctggtcaaaggcttctaccccagcgacatcgccgtggagtgggagagcaatgggcagccggagaacaactacaagaccacgcctcccatgctggactccaacggctccttcttcctctatagcaagctcaccgtggacaagagcaggtggcagcaggggaacgtcttctcatgctccgtgatgcatgagggtctgcagaaccactacacgcagaagagcctctccctgtccccggggtaaatgagtgcgacggccggcaagcccccgctccccgggctctcgcggtcgcacgaggatgcttggcacgtaccccgtctacatacttcccaggcacccagcatggaaataaagcacccaccactgccctgggcccctgcgagactgtgatggttctttccacgggtcaggccgagtctgaggcctgagtggcatgagggaggcagagcgggtcccactgtccccacactggcccaggctgtgcaggtgtgcctgggccgcctagggtggggctcagccaggggctgccctcggcagggtgggggatttgccagcgtggccctccctccagcagcacctgccctgggctgagccacgagaagccctaggagcccctggggacagacacacagcccctgcctctgtaggagactgtcctgttctgtgagcgccctgtcctccgaccccccatgcccactcgggggcatgcctagtccatgtgcgtagggacaggccctccctcacccatctacccccacggcactaacccctggcagccctgcccagcctcgcacccgcatggggacacaaccgactccggggacatgcactctcgggccctatggagggactggtccagatgcccacacacacactcagcccagacccgttcaacaaaccccgcactgaggttggccggccacacggccaccacacacacacgtgcacgcctcacacacggagcctcacccgggcgaactgcacagcacccagaccagagcaaggtcctcgcacacgtgaacactcctcggacacaggcccctacaagccccatgcggcacctcaaggcccacgagcctctcggcagcttctccacttgctgaccagctcagacaaacccagtcctcctctcacaaagtgcccctgcagccgccacacacacacaggggatcacacaccacgtcacgtccctggccctggcccacttcccaatacagcccttccctgctcctggggtcacatgaggggtgggcttcatatctcctgccctctggggctcagggagggacacgggagacggggagcgggtcctgctgagggccaggtcgctatttagggccgggtgtctggctgagccccagggccaaagccggtgcccaggatggacagcttccgggagctgacctcaggacactgttgggccatcgaggccgggccctacatcctaggccccgccacagagggaatcacccccagaggcccaagcccagggggacacagcactgaccacccccttcctgtccagagctgcaactggaggagagctgtgcggaggcgcaggacggggagctggacgggctgtggacgaccatcaccatcttcatcacactcttcctgctaagcgtgtgctacagtgccaccgtcaccttcttcaaggtcggccgcacgttgtccccagctgtccttgacattgcccccatgctgtcacacactgtccctgacactgtccccaggctgtccccacctgtccctgacgctgtcccccacgctctcacaaactgtccctcactctgtacccacctgtccaacagtgtcccccagactgtctccacatgtccctgacactatccccaacgctgtcgccacctgtccctgacactccccaacgctgtacccacctgtccaacagtgtcccccagactgtctccacatgtgcctgacactatccccaatgctgcacccacctgtccctgacactgtcccccacactgtcacaaactgtccctgacactgtcccccacacgttccctgtccctgacactgtcccctgtgctgtcacaaactgtcactgacagtgtcccccacactatccccacctgtccctgacgctgtcccccacactatccccacctgtccctgacgctgtcccccacactatccccacctgtcccggacactattccccacactgtccccaccagtccccaacactgtaccccatgctatccccacctgtccccaacactgtcccccacagtcccctcctgtccctgaatgtcccccatgctgtttcctcctgtcccctcctgtcccgacactgtcccctacactgtcttctcgtctcctcctatccctgacactgtcccccacgctgtcccctcctgtccccaacaatgtcccccacagtttcctcctgtacctcacactgtcccccatgctgtcttctcctgtctcctcctgtccctgacactgtcccccacgctgtcaccacctgtccccgacactgtcccccatactgtccccacctgtccccgacactgtcccccacgctgtcccctcctgtccccaacactgtccccatgctgtctcctcctgtctctgacactgtcccccactctgtcccctacagtccctgacactgtccccatgctttcccctcctgtatgcaacactgtcccccatgctgtctcctcctgtccctgacactgtcccccatgctgtccccacctgtcccactgtcccacatgctgtccccacctgtccctgacactgtccccgacactgtctctcatgctgtccccacccatctccgacactgtaccccatgctgtccccacctgtccttgacactgtcccccatgctgtccccacctgtccctgatgctgtcccccacactgtccccatctgtccctgacactctccccaatgctgtccccacctgtccctgacactgtcccccacgctgttcccacctgtccccgacactgtcccccacactgtccccacctgtcccaacaatgtcctcacactgtccccacctgtcccgacactgtccatgctgtccgcacctctccctgacactgtcccccatgctgtccccacctctccctgacgctgtcccccacactgtcccctctccctgacactgtcccccacactgtccccacctttccctgacactgtcccccacgctgtccccacctccccctgacactgtcccctacactgttcccacctctccctaacactgtcccccacgctgtcccctcctgtccccaacactttcccccacgctgtccccaccagtccccaacactgtacaccatgctttccccacctgtccccaacactgtcccccacactgtcccctcctgtccccaaaaatgtcccccacactgtttcctcctgtccccaacactgtccaccactctgtctcctcctgtccctgacactgtcccccactctgtccccacctgtccccaacactatcccccacactgtctccacctgtccctgacgctgtcttctgtactgcccacatgctgttggtgccctggctctgctctccatgtccaggcctcagagcaggcagtggtgaggccctggcacctgggtggactgaagggcggatgggcctcaggggcagggctgtggcctgggtggcatgaggggtgggtggaccttgggggaagagatgtggccctcagtgccctgaggggtgggtggggctcggggacagggctgtggcctcgctcacccctgtgctgtgccttgcctacaggtgaagtggatcttctcctcggtggtggacctgaagcagaccatcgtccccgactacaggaacatgatcgggcagggggcctagggccaccctctgcggggtgtccagggccgcccagaccccacacacgagccgtgggccatgctcagccaccacccaggccacacctgcccccgacctcaccgccctgaaccccatggctctctggcctcgaagtcaccttctgacccctgacacgccccccttccagaccctgtgcatagcaggtctaccccagacctccgctgcttgatgcatgcagggcgctgggggccaggtgtcccctcagcaggacgtccctgccctccagaccaccaggtgctcacacaaaaggagtcagtgaccggcatcccaggcccccacccaggcaggacctcgccctggagccaaccccgtccacaccagcctcctgaacacaggcgtggtttccagttggtgagtgggaaaatcagccgccaaggtagggaagccacagcaccatcaggccctgttggggaggcttccaagagctgcgaaggctcactcagacggccttcctcccagcccgcagccagccagcctccattccgggcactcccgtgaactcctgacatgaggaatgaggttgttctgatttcaagcaaagaacgctgctctctggctcctgagaacagtctcggtgccagcaccaccccttggctgcctgcccacactgctggattctcgggtggaactcgacccgcagggacagccagccccagagtccgcactggggagagaaggggccaggcccaggacactgccacctcccacccactccagtccaccgagatcactcagagaagagcctgggccatgtggccgctgcaggagccccacagtgcaagggtgaggatagcccaaggaagggctgggcatctgcccagacaggcctcccagagaaggctggtgaccaggtcccaggcgggcaagactcagccttggtggggcctgaggacagaggaggcccaggagcatcggggagagaggtggagggacaccgggagagccaggagcgtggacacagccagaactcatcacagaggctggcgtccagtcccgggtcacgtgcagcaggaacaagcagccactctgggggcaccaggtggagaggcaagacgccaaagagggtgcccgtgttcttgcgaaagcagggctgctggccacgagtgctggacagaggcccccacgctctgctgcccccatcacgccgttccgtgactgtcacgcagaatccgcagacaggaagggagactcgagcgggagtgcggccagcgcctgcctcagccgtcagggaggactcccgggctcactcgaaggaggtgccaccatttcagctttggtagcttttcttcttttaaattttctaaagttcattaattgtctttgatgtttcttttgtgatgacaataaaatatcctttttaagtcttgtacttcgtgatgggagccgccttcctgtgtccacgtgcctcctgcccccggtgggaaacacggtcaggaggaggctggtccagctgcacctcgggggctccctgcacacgccccccgcctcctgcagccacacgcattgcccgagcgaccctccctggcccctgtcgctacatggacccccggggcttctcctcttttctacatggatgcagtttctcctcctgctgggcacggtgctgcctgccctggtcactctgcgggggacagggcctccagggaaagctgggtcgaggctgggagctggctcaggctggccaggcagagccacagggagggccttccagaaccaaccatggtccgaagcgagaggtgggtgtcagatctgtgtgagtcagctcaggaccacagcggggcggctcccacggcagacatggatcctcccaggcctagagaccaggaatctgagatcaggatgcaggcagggctggtttctctcaagccctctctccttggcttgtagacaccgtctcctccctggtcctcacgtggccatccctctgtgtgcccgtgtcctaagcttctcttcttagaacacacatcggattagattagtgaccccctatgaacttaatgacctctgtaaagaccccatctccaaatagtcacattgtgaggccagggattaagacttgaatatatgaatttgtaggggccacaatttaacccatcacagtccagactctgggccccaaaattcatgttcttctcacatgcagaatacattcatcctgtctcagcatccccctgggcactaggtcatgtagcaaggacagattttcaacagaaataactattgcaacagaagaaagagtccggcatgacctggactcaccttcatctgtgcagaggccacagccttgtaaagggaggtggtagggggagcagggagggtgctcggggctcagtcttcggggaagggaaaagttgcccagcgctggtcagcgtccccgggatgggacccgctgtgtccgtgccggccactgttgaggtcaggattctgtcctcccagagcctggagacacaggccccatccttcccaatggggacacttcagggagcggctctcaagtcttgagaaagaccctcctgggtcacaggaaatgcacagacatcgggaacggatagaaggtcgtgtggttgcggccctctcagcagataccctgagaaagggaggtcggggttggtccaaacggtgagttctggtgcacggagctttctcaggcaggtgttgacggggcaggggtcggcctaggggtacggccagaagctgttagaaactgttagtgtctgctcaagtctttacaagccaaggttgaggccgagtggagaggctccgaggagcctggctggaactcagtcaaggacagggtcttgttactgcagtggctgcggtggctgcggtggctggaaaatgccgtcggagttgcctgtggcaggagagagaccatctcacccaggaaggaggagtggttggattcgtttgtgtggcatcgagcagctggagctgcaccagagttgggggtgaaatccccagagcccggaccctgctgtgccgtgggagggctcgccgctggagggtgggcttcagggtgcctggcctgaactgggtgctgaagcccagccctttaactctcaggacacgctgctgcagccccgcggggggtgagggagagagcacctggggtgcagggcgggcagcagctgcatcaccggctctatcccaagcccaaggatggcccctccctgaagcacccaggccccacctccccctttccacctggaaccgagcatcctccagagggccagtcctcctgcaggaacaccacgcccagccccaggaccctccctcaactctccagcaaggctgcctccacgcaccccctagcagtccatgctgtgatgtaacatgacatggtgtgatgtggtgtgatatccatggtgtgccagggtgtaatgtgtgatgtgacaggacatggtgtgatgtggtatgacagagtgtgacatccctggtgtgacatggtgtgatgtggtgtgatgtgatgtgacatggttggacatggtgtgatgtggtgtgacatagtgggatggggcatgacatccctagtatgataggatatgatatggtgtgatgtggtatggtgtgacatggtgggacatcctgtgacagagtgtgacacccctggtgtgatgtggtgtgacgtagtgtgatgtgatatgacctgatgtgatgcggtgtgacatccctggtgtgatggggtatgatatcatttaacgggtgtgatgtgatgtgatgtgatggagtgtgacatctctggtgtgacatgtgtgatgtggtgtgacagagtgtcacatcgttggtgtgatgtaatgcagtgtgacatggtgtgatgtggcatgatggggtgtgacagggttcgacctccctcatgtgatgaggagttgcatggtgtgatgtggtatgacatggtgtaatgtcccttctgtgatgtggtgttgggctacaaggttggacatggtgtgatgtggtgttacatccctggtgtgatgcagtgtgacatagtattatatggtatgacatccctggtatgatggggcataatatggtttgatgtggaatggtgtgacatgatgtgatgtaatgggacaaggtgtgacatccctagtgtgatgtggtgtgatgaagtgtaacaggctgtgacatagtgtggtgtggtgtggtgtgacatgatgtgatgtggtttggcataatgtgacgtgttctgatggggcgtgacgcccctggtgtgatggggtgtgatgttgtgtggcattatgtgaagtggtgtgatgacgggtgacatccacggtgtgatggggtgtgatgtggtgtgatgtggcatgacataaggtgatgtggcataacatccctggtgtgatggggtgtgatgtggtgtgacacaatttgatgtggtgtattgtggtgtgacataatgtgatgtggcataacatccctggggtaatggggtatgatgtagtttgacatggcgtgacgtaatgtgatgtggtgtgatggggtgtgacaactctggtggggtggggtgtgatgaagtgtggtgtgacatgatgtgatgtctgatgtgctgtgtcagggtgtcacatacttggtgtgatgtgatgcggtgtgacacagtgtgatgtggcatgatggggtgtgacctggtacgacatccccagtgtgatgaggagttacatagtgtgatgtggtgtgacatccctggtgtgacatagtgtgatatggtgtgatgaagggaacccctggcttatagaggtgtaaaataggtcaaaggaaataaaagatgcagagctcaatagaatgaaataacctggaagagggtacaagacgatgccttgctttccatggaaggcacctactaatcttttgtttttctcaatgtttcctataaacatatataactgactgacacaaacagatccataatataaagaagacccctgtaaaccaacgagaaaaaaaatcaaataattcaacaaggaataggcaaaagaattgaacagatgttttacagaagatatccaaatagccgctaaacatatgaaaaggtgttgaaccacactagtcaacagggaaatgaaaatgaaaaaccacatgagagaaagtagttctgattccagtaatgctggagcagctaatatcagactagccctttggcagatggcaattataaacactggaaaagctgtaagcacacacaacacccacacacaccaattgcaggcactggaacatgaccagaagtaggcaaacactagtaaggattattcccggaaatattggtctgaagtcacaccccagggcatgtaatgggtgcagctagagttcaagcaggaaactgcagccctcctggtgaggagtgggatgcagggctgcattttcagagcagctggaaatgaagagaagatgtccataaaggagaaggtcaccaaagggaaaccccacaatctgcaagtaaactccactgaaacctctggccgatcccttaggtgtgcatgggtagggaaaactccaaagggcccagcagaaagcagcacctgtaaggtcgagagaactgagattccagctactgccaactgccaggcagacagacttgggagtttgagtcaactcaagctgtttcctaacattgaaaaaaacaatcaatgccctgccaaggaagaacgcaaaacccatagcctgtaccacatgttatcaacaacatcaggtgcacatccaaaattaccatatatgcaaagaaacatgaaaatgtgatccatagtcagaagaaaaagggatcaatggagatcaactccaagatgacctagatgcagacccagttttcacacaaggactttaaagaagtcatgttaaatatgttcaaagacttaaaggacaatatggttataatgagtgactagatggggaatctctgtaagaaagggaaaatattaacaagaaccaaatgaaaattctagaactaaaagtatgattctgaaatgaaaaacatcatttggccaggcacagtggcccatgcctgttatcctagcactttgggaggccaagaaggaaggatcacttgatcccaggagtttgagaccagcctgggcaacatggagaaatcccatctctattttattaaaaaagaaaagaaatagaaaaacattactcaagtttcataacagaatggagcagacatgagaaggaactgaaaacttaaagatgcatcaatagactatgtcaattatttttaatctaatgcaaagaagagagagaaaaatactaaaaatgaaaagagactcatcctgctggacaaggcgaagcattctaaaacatgtgaaactggagtccagagggggatgtaatacttccatgggaaaggtcaaccctaagctatatgcaaatgtacctgcgtaggctggtgtgctgggttgatggcatctccctggccaaatgtatgcccacctggaacctcagaatgtgaccatatttagaaatagggtctttacaaattagtttaaggacttgagatgatatcatactaaattttcgatgggtcccaaatccaaagactggtgtcctcatgagaggagaggacacagacacacatggaagtagccagatgatgacaaaggagaagatgaggggtgtgtcaggagccacctgtgtttgtccctttgcattactgtaaagaaatacatgaggctgggtaacttataaaggaaagagattgaattagctcacagttctgcaggctttataggaagcatggcatcagcatctgcttctggcgaggacctcaggaaacttacaatcatagcagaaggtgaagggagagcaggtatgccacatggcaagaatgggagcaagaggctgagggggggcccagacttaaacaactagactgtgtgtgagctgactgggggagaattcactcatcaccaaggggaagatgctcaatcattcatgagggatctgcccccttgatctaatcacctcctagtggccccacttccaacactgggaatcatattacaacatgagatttggaggggacaaatatataaaccatatccttccacccctggtcccccaaatctcatgtccttctcatgttgcaaaatacaatcatgccttctcaacagtcccccaaagtcttacctcattccagaatcaacaaaaaattcccaagtcccaagtctcatctgaagatgagtcccttccacctatcagcctaggaaatcaaagacaaattgactcccaaaatacaatgagagtgcagacattgggtaaacattcccattccacaagggagaagttggcaaaaagaaaggatctacatgccccatacacgtcagaaatccagcagggcagttattaaatcttaaagctccaaggtaatctcctttgacttcatgtcccatatccagggcacactggtgcagggggtgggctcccaaagccttggacaactctacccctgtggctttggaggatgtacccctgtggcttctctcacacgatagagttgagtgcctgtggcttttccagattcagggtgcaaactgccagtggatctaccattctggggtctggaggacagtggcccccttcccacagctccactaggcagtgccctggtggggacattatatgggggttcaaccccacattctctttggcactgctctagtagaggttctctgtgagggctccatgctggcaggaggcttctctctgggcacctagggtttctcatacatttctgaaatctagagtgaagatgccaagcctccttcactcttgcattctgggggcctacaggcttaacaccagatggaagttcccaaggcttatagtggcttgcactctccaaagaagcagcctaagctgtacttggggccctttgagccaaggctggagccagaggaaccaggatgtggagagcagtgtcccaaggctgcacaggcagcagtggccatgggcatggcccacaaaaccatcctttccctcttggcctctgggcctgttatgggaaagaccacctcagagatttccgaaaggccttcaaggcctttttccctttgttctggatatgagcacttagctcccttttagttatgctaatctctctagcaactggctgctccatagcctacttatatttgtctcctgaaaataccttttcttttctaccacatggccaggctgtgaattttccacattttttatgctctgcttccctttgttgatgaaaaaagccaaactccataaaacacttgacgagattgattctgagccacatgtgagagccatgaactgtggcacagcctcaaaaggtcctgagaacacctgtgcaaggtggttgggttgcggcctgcttttatgttttagggagacatatcaatcaatacatgtaaagtatacattggtttggtttggtttggaaaagcaggacaattcaaagtggggaattccaaatcataggtggatttgaagattttctgattggcaattggctgaaaaagttaaattatctaaaaagttgaagtcagcaaaaagcaatgcttaagataagggggttgtggaagccaagtttcttgttatgtagatgaagcctccacgttccagagagaagagatggtcaatgtctcttatcagaacctaaaaggtgccagactcttggataaatctctcctgaatcaggaagagacctggaaagggaaaaagattctcaacagaatatacatttcctccacaagagacggctttgcagggcccttccaaaatgtgtcagagaaatatattctggcataaaatactttaatttccttccatgcctgccacctgtcatgtgatgctataccagaatcaggttgggatttgatatcttattgctacaaagagtctgctttgtcagtcttaagctccctgttttaatgttaacactggtcagctgagcctaagctccaacagggagagggtatagtgagggagtccaaaccaccctccccttcctgtcatggcctgaactggttttccaggtttctttggaatccccttggattagcattttattttgtcgtttacaccttttaaatataagttccaactttaagtcatttctttgctcccatatcttaccatagactgttagaagcaaccaggtcacaccttagaaacatctgcttagaaatgtcttccacagatgccctaagtcatcactcttaaggtcaaccttccacagatccctagggcatgaacacaatgcagccaagttgtttcttaggatttaacaagcgtgacctttacaccagttcccaataagtttctcatttccatctgagatttcatcagcctggctttcacagtccatatgtctatcagcattttggtgacaaccatttaatagtctctaagaaattccaaactttccctcatcttcctgtcttcttctgagtcctccaaattcttctaacctctctgcctgttacctgattccaaagctgcttccacattttcaggtatccttatagcaatgttccactcctcaataccaatgttctgagttagtctatttgtgttactagaaaaaaaaaaaaaacatgaatctggtaatttataaagaaaagaggtttgcaccaggcactgtggcaaggaagggaggattaactagctcacagttctgcagccattccggaaacacggccctggcatctgcttctggcgaggcctcagggagattgcaatcacggcagaaggcgaagggggagcaggcatgtcacatggcaagagggagcaagagaagagaagtggcacgtcctagacttttaaacaaccagctgtcacagggactaactgagggagaactcactcatcacctgggagatggtgctaggccattcatgaggggtccagccccatgatctaatcacctcccaccaggcccacctccaacactgggaatcacatctcaacatgaaatttggagagacacacatccaaactattgcaccacaggaagctggaagaggtggacggtcctcccctggagcactcagagacagccaccaacaccttgatctcagattcctgactcccagaactctgaaaaaatttttgttgttttaagccacatttgtgatattttgttacggcagccacagcacggatatagctggtaacagagttctttagcctccaaaatacaagcctggggtaaataactattgaatttggccacatggaaatcaggaagaatgtaataagcatcatcgatggacgggatgacctgggagatcgtggcaagtttaaagctaattggaagttggcaaccaaaaaatcctgtcttgcaaattgccaggaaattgccaagaaaacttttagaaaacatggttaaagatggagaaacctggatgaatccctggtttctgaagaggtgcttaggcattgaagtgagactgatgagacttcacactgtaccttcagaagggcagacactcacgagatcatcaaccacggctccctcgctgggaggcagacacagagctggaggcggcggccacaaactaggtgggcagagaggcgtcagcatcgggacttgcgggaggccctgggaaggaacaggcagcggtggggcctggacagccctggggaaaggaagttacttggaggagaccaggggcttgcatttgggccaaaaccaaggacaagagatcagctggtcccagggaactctggagcccagcaccccaccacgggtgcagggtcctgacaacccgagagggctgtgggcaccgggcaccagcctgtggggattctgaaggctgctgcccagccacacgtcccggttctgaacaaagggttcaagagacacctgcaaacctacctttctgagagcagcctcttagcctcagctggtattggcctttggtcaccccacatgccccgacagtggggcctggcctcagaaaggggcccctccatttgtactttctatctgatccttgacacagtgctaacaccaaagaccaaacccgaatcttggttcacatactctgcaaagaaatgactaagactagttcttccggaggtcagttttagaacgtttattctgacttaattctgccttatctctgtgcaccaagaaaactatctgcacatctgtagtaaaatgtgaaggtaccttcattttgtttgtatactaaacttttaagaaatacctcactttttaaaacttggttttgtgttttgtatgcttataatattttccataatagatcattttaatgatgaactctgagtcttctgacagaatgcagatcaatggattcctagccatcagggaggcgttgattgcaaaggggcctggtggaatttttggagagattctacatcttcttgcaactgttcatctggattacggtggtggttgcatgactgtgcatttgttgaaacttacatgtcacaggatggattatactgaatgtaaactacacttgagtaaatatgacttttaaaactttaaaaagttgggggatggttcactgccccggctcgaagccccctggccacgctgcctggccagcccacccccatccctgccagcgcttgcctccagcgtcccaacagcctcctgaccccctgggctgctctaaaccctcaggagcgcagccatccgggatcagctggatggagatggggagcccgagactcgtgccacaccacgtcctcccgcccacaccagccacacgcagacgtcaaagcagcactgtcctcgcacgcactgctcccacccaccctggcacggccattccaggcctggggcaggaaggcagatgctccccctgcccccagacacaagcattcctgcacacacccccagcacacacacgcactcccatgcgcacactgacacacacaggtgtgtgcagctgagacacagcccgttcccaggaagcccagcccccatcactgagggaaaggggcagcaccgtagggccacaggagtggcagctggacacagagccaggagctggtgaaggcccaggccactgaggcgggctgccggcatggctgggcgtgaaggccagaagagggcaggaggggctgggggcactatgcctattgggcctaggtgggcacacgccgggcaggagaggaacagcccagcccctcagacaggaaggggtgggggcaggggccatttgtggaggccagggcagggccagcaccccaaggaaaagcagagcagggtgagaacggacatggggctcagagctgagcaggcctgctgggccccaggagggagacacagatgaccggagatctcaaggctggcagaggccagagatggagccccagctgggaagccatcctccttcctgggggcccacgctgcccggcccctccagcccagcaagcttggggcattggatagaaccgggagagagccgaccaggcactgaggcccctgccccaaatgcccacagcctggggaaaatgagcaggtacatgggaggggcaagtggagccccaggcacacccacacagtgcacacggcctcacctgggccggagggggcaggaggctcgccaccccgctgtggtttctctcctaatctcaccctgggtttctctcacacttgatgcagatgatgtttctctgacattgtggactaagagttggtgctggaaggggttagccatcttggagatgttgctatgggatgcagggattttgcgtgtgagaaggacatgattatggggggaacggagggcaaactgtcatgggttaaaatgtgtcccctataaattcatgtgttgaagtcctaacccccaggaccgcagaatgtgaccttgtctggaaacagtctttgcagctgcaatcaagttcagatgaggtcaccctggagtagggcaagcctctgatccaatatgactgctgtcctcatgaaaagggggaatctgggcacagacagcacgtggggagaacgccctgtgaagatggtgctgcttccataagccaagagcaccagagacggccggcaaagcccagcagcaaggagagagcctgggacagagtctcccatgacacagaggagccagccccaccgaggcctccatcccagatgcccggcctccagaaccaggacggaataaacgtctgttgtttaagccacgcagtctggggtgcagtgttgccagggccacagttaacggatacgagtgttgtcctgagctgccagccccacaggctgcacgaggcctccctgccccagcccagtgcagactccccagccccctgggtgtgccatgggcagtggggggcccctcactccgtcctcccccagcctgggaggttgagcccattatgagctccatggggtgaagctggaacgagaggctgggagccgactgggagcctgcggctggaggatggatttccccagggacccacacgtgcacctccacctgtctcctggacattctctctgagggcagggctggtgccagctcagggatccagcagggtcacaagggcaggccgggtccttgtggagagcacatttagtgggagggacatgatttcccttcaaagtgcccattctggacgcttcccgttccatgctggacgcttcctcttccacgctggatgcttcctgttccacgctggatgcttcctgttccacgctggatgtttcctgttacactctggatgcttcctgttccacactggatgcttcctgttccatcctggatgcttcctgttccatgctggacatttcctgttccactctggatgctccctgttccatgctggatgcttcctgttccatgctggatgcttcctgttccatgctggacatttcctgttccactctgcatgcttcctgttccactctggatgcttcctgttccacactggacgcttcctgctccacgctggacgcttcctgttccatgctggatgcttcccgttacattctggatgcttcccgttccatgctggacgcttcctgttccacgctggacgtttcttgttccactctggatgcttcctgttccacgctggatgcttccttttccacgctggacacttcctgttccgcgctggacacttcctgctccacactggacgcttcctgctccaggctggacgcttcctgttccatgctggatgcttcctgttacattctggatgcttcccgttccatgctggacgcttcctgttccacgctggacgtttcttgttccactctggatgcttcctgttccacgctggacgcttcccattccactctggatgcttcctgttccatgctggacatttcttgttccactctggatgcttcctgttccatgctggatgcttcctgttccatgctggatgcttcctgttccatgctggacgtttcttgttccactctggatgcttcctgttacatgctggatgcttcctgttccatgctggacgtttcttgttccactctggatgcttcctgttccatgctggatgcttcctgttacattctggatgcttcctgttccatgctggacatttcctgttccactctggatgcttcctgttacattcttgatgcttcctgttccatgctggacatttcctgttccactctggatgcttcctgttacattctggatgcttcctgttccatgctggacatttcctgttccactctggatgcttcctgttacattctggatgcttcctgttccatgctggacatttcctgttccactctggatgcttcctgttacattcttgatgcttcctgttccatgctggacatttcctgttccactctggatgcttcctgttacattctggatgcttcctgttccactctggacgcttcccattccactctggatgcttccttttccatgctggacctttcttgttccactctggatgcttcctgttccatgctggatgcttccttttccattccggacacttcctattccattctggacacttcctgtgcgacacctcctcgggcttttggtctgcccagtccctctggcctcataccatccccccttacctcccacttccacgttcgtccttcctcagctcctccctctctctagagcttcggcctggcaaggtccctcctgatctcagtccaggctcccccagcacaggtaggagacttgcacctgcccttggacctccccaccctgcatgatgccagcatcccccaggccccagggaggccccatttctctctctgcttgtagtccagtggccctggagtgccactgcaactcgggtgtgcccctcgcctctgaggaagctaagtgccctaagctaagcagaggccatcccctctgctcagccccagggccctgccccctaccccttcccctcacctgcaccacaggctctggccaactctgcccaggctctgaatgggcccctctggctcccctctgctgctacactgccctgcaccacctccactcagcttcagtgtgttcatccacctgtcccacgtcccctcggcccccaggagcacagctggtggccctggctcctggcagcccatcttgttccttctggagcaccagcctcagaagccttcctgtgcagggtccactcggccagccctgggaccctcctggtctcaagcacacacattctccctgcagccagacctgcccctgcctgtgagctcagacctgagccttggaacgccttcccttctccatcccagctcgcctttgccagctgctcagcgggatgaactcacactcccctccctgcaccatgagtgagagccagctggagagacgcccaggccaaagcagccaccagggcccagtgggggtcagaagcttcaggtgagaggcccaggtattgagaggctgagaccacgggcagaatggtcataatcactgccagtatcagtccagccccagggactcagagacagagaaaagagcagtgaacaaggtccgggctccccaccttctcccacgagtatgggggcagccaccacccccatccccacacacccatgaggcagcctcggctgtgtctggactcccccttaccctgtgacacagaaaccaccagaagaaaagggaacttcaggaagtaagcggtgccgccggtttcaatcctgttcttagtctttgcagcgtggagttcacacccctggggacctgagggccgagctgtgatttcctaggaagacaaatagcagctgacggcgtgggcaagtctgcccacatgtaccgcgccaaaacaggaagggctgagacccccacctcggtgagtagggtcagcacagggcaagggcacaggctcgggaggagaaggacagagcctgggtgcagccgtgggcgctcctggacctcagctgctgaacaggctacaagaggctggggagacgtgggggcaaggccagccccacatggagacccaagcggagccagcacgggggaggtgggcagccttcaggcaccaacgcccacccagtgcaagatgacggggaccgtgggcaggggcttccaagccaacagggcaggacacaccagaggctgactgaggcctccatgacgaccaggctgggagcacgaggaacctgacgggatgcggcagagccggccgtggggtgatgccagcatgggcaggacccacctgagctgaggaggcagtagaacgagggaggaggagaggccccaggtgaacggaggggcttgtccaggccagcagcatcactggagcccagggcagggtcagcagtgctggccgtggggccctctctcagccaggaccaaggacagcaggtgagccgggagcagagcagggagggtgagtgtggcagcaggacaggagggtggaagccaaggagcccagaggcagaggcagggacaggggaggcacaggggctaggctcagagccacctgatggcgctggggcacctgctggcggggagcagggctgtggtcagcagcggagtggaggggagagctgtgctgagtgcacagatgggaggagggaagagtccagggaggcccagaaaggcccagagtgcagcaggcctggggcgaggggaggggtgaggctccgtgcgttcagggagctgacccagcagagcagaggccactgaggagctgaggttctggagaggcttccagagcaggagcagtgcagggacgggaggatctgggagctcacccaggaggggcacatgggcaagggcaaggggctctgttggggagacctgactggacactggggctgctccacagcatagggaacaagccaagtgctgcaaaaacaaaaatgaggccagaaaaacagcccaaacctggacagagggtgccaggacaggcaggggggcaacagtgacctgagtgacattgctgcccgggttgagggagggcagagtgagcagggggcaggcattggagttcagggtaccaggaccgagcagccacaggtgagcagggcaggtgggggcagaaggagcagggggcacctcctggagctcagcagaccagggcagagcaactgaaggtgaacaagggcaggtgggaggcaggatgagcagggggaagaccctggagctcaggggaccagggcagagcagcctcaggtgcctcaggtgagcaggggctggtgggtggcaggacgagtaggggacagctcctggagctcaggggaccaggacagagcatcaagagctgagcatggctagtgggaggtgggcgaacagggtgcagcccctggaactcgggaccagggcagagcagcggcaggtgagcacgggctggtgggaggcaggaggaacagggggcagctctgggacttcaggggaccaggggagggcatctgaaggtgaacaggggctggtgggggcaggaagagcagggggaagcccctggagctcaggggaccagggcagagcagccacaggtgagcaggggctggtaggaagcaggaggagcaggggacagcccctggagctcagagcaccagggcagagcaccctcaggtaagcaggggcaggtaggaggcaggacgagcaggggacagcccctggagctcaggggacagaggagagcatcagaaggtgagcaggactgaggcttagcctcagggaatcagagcagagcagccacaggtgagcagggccggtgggaggcaggacgagcaggggacaggcactagagctcagggcaaggcaaccacaggtgagcagggccggtgggaggcatcactcagctcctagattttggcaggagctgggtagttgctggcagcagacagctgagggctggtgaaagtgcagtgcagcctcctggtgccaggaagggagtgtgagcccatcccactgagcagttggcaagggtgagctgggatggagaagggaaggcattccagggctcggggctgagctctcaggcaggggcaggtgtggctgcagggggaatgtgtgcttgagaccaggagggtcccagggctggccccagcggaccctaggcaggaaggcctctgaggctggcgccccagaaggagcaagatgggctgccaggagccagggccaccagcacaatgaagctgagtggaggtggtgcagggcagtgtagcagcagagggctgccagaggggcccattcagggcctgggcagagtcagccagagcctgtggtgcaggtgaggggaaggggtggtgagcggggccctggggctgagcagaggggatggcctggctgagggcagggcacttagcctcctcagaggtcaggggcacaccccacctgcagtgggactccagggccactgggccagcggcagagagaaatggggcctccctgtggcctgggggtcctggcaccacgcagggtggggagggccaagggcaggtgcaaggctcctacctgtgctggggggcctgggttgagcccagcagggaccttgccgggggaagctctggagagagggaggaggtgggctggtggccgagaaggccaggccagggctgggagggtgaggttgtggtgactgagcctccagaagtaatgcaggacactgggaggcagggggcatccaggcactcagggccctgacctgggctgctgcacactggggctaaggggaaaggaggggagaggctgaggaggaggctccaggaggctattccaaggcagggggttccggggccctggggctgaagggcgccgaccctatgcagtgtctggcccctctgctgcacagaagaaaagggccttggagggcagagggcaggctatgaccagggccctgggcaagtcaggcccactcactagcggagggccacgctggggcggcagggtcaggagcttcaggggactcgggggacccacgagaagccatctgagaacagtgtccactggtcaagccaggcacccataaaaggctggagtggggccaatgggcatgagccgtccctgaggtggcaccgatggccagagctgaggccaagctagaggccctggactgtgctgactcccggcaggcacagagcgctgacctggctgccgagccccgcctcctaggctgcaggggtgcctgcagaagggcaccacagggccaccggtcctgcaagctttctggggcaggccgggcctgactttggctttggggcagggagggggctaaggtgacgcaggtggcgccagccaggtgcacacccaatgcccgtgagcccagacactggaccctgcctggaccctcgcagatagacaagaaccgaggggcctctgcgccctgggcccagctctgtcccacaccgcggtcacatggcaccacctctcttgcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgccctccagcaacttcggcacccagacctacacctgcaacgtagatcacaagcccagcaacaccaaggtggacaagacagttggtgagaggccagctcagggagggagggtgtctgctggaagccaggctcagccctcctgcctggacgcaccccggctgtgcagccccagcccagggcagcaaggcaggccccatctgtctcctcacccggaggcctctgcccgccccactcatgctcagggagagggtcttctggctttttccaccaggctccaggcaggcacaggctgggtgcccctaccccaggcccttcacacacaggggcaggtgcttggctcagacctgccaaaagccatatccgggaggaccctgcccctgacctaagccgaccccaaaggccaaactgtccactccctcagctcggacaccttctctcctcccagatccgagtaactcccaatcttctctctgcagagcgcaaatgttgtgtcgagtgcccaccgtgcccaggtaagccagcccaggcctcgccctccagctcaaggcgggacaggtgccctagagtagcctgcatccagggacagaccccagctgggtgctgacacgtccacctccatctcttcctcagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaaggtgggacccgcggggtatgagggccacatggacagaggccggctcggcccaccctctgccctgggagtgaccgctgtgccaacctctgtccctacagggcagccccgagaaccacaggtgtacaccctgcccccatcccgggaggagatgaccaagaaccaggtcagcctgacctgcctggtcaaaggcttctaccccagcgacatctccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatgagtgccacggccggcaagcccccgctccccaggctctcggggtcgcgcgaggatgcttggcacgtaccccgtctacatacttcccgggcacccagcatggaaataaagcacccagcgctgccctgggcccctgcgagactgtgatggttctttccgtgggtcaggccgagtctgaggcctgagtggcatgagggaggcagagcgggttccactgtccccacactggcccaggctgtgcaggtgtgcctgggccgcctagggtggggctcagccaggggctgccctcggcagggtgggggatttgccagcgtggccctccctccagcagcagctgccctgggctgggccacgggaagccctaggagcccctggggacagacacacagcccctgcctctgtaggagactgtcctgtcctgtgagcgccctgtcctccgacctccatgcccactcgggggcatgcctagtccatgtgcgtagggacaggccctccctcacccatctacccccacggcactaacccctggctgccctgcccagcctcgcacccgcatggggacacaaccgactccggggacatgcactctcgggccctgtggagggactggtccagatgcccacacacacactcagcccagacccgttcaacaaaccccgcgctgaggttggccggccacacggccaccacacacacacgtgcacgcctcacacacggagcctcacccgggcgaaccgcacagcacccagaccagagcaaggtcctcgcacacgtgaacactcctcagacacaggcccccacgagccccacgcggcacctcaaggcccacgagccgctcggcagcttctccacatgctgacctgctcagacaaacccagccctcctctcacaaggtgcccctgcagccgccacacacacacaggcccccacacacaggggaacacacgccacgtcgcgtccctggcactggcccacttcccaatgccgcccttccctgcagctgaggtcacatgaggtgtgggcttcaccatcctcctgccctctgggcctcagggagggacacaggagatggggagcgggtcctgctgagggccaggtcgctatctagggctgggtgtctggctgagtcccggggccaaagctggtgcccagggcaggcagctgtggggagctgacctcaggacactgttggcccatcccggccgggccctacatcctgggtcctgccacagagggaatcacccccagaggcccgagcccagcaggacacagtattgaccacccacttcctgtccagagctgcaactggaggagagctgtgcggaggcgcaggacggggagctggacgggctgtggaccaccatcaccatcttcatcacactcttcctgctaagcgtgtgctacagtgccaccatcaccttcttcaaggttggccgcacgttgtccccagctgtccttgacattgtcccccatgctgtcacacactgtccccatgctgtccccacatgtccctgacactgtcccccatgctgtccccacctgtcccggacactctcctccgcgctgtcttgacctgtgcccaacactgtcccccacgctatccccccatccccaacaatgtcccccacagtttcctcctgtcccctatccccgacactgtcctccacactgtccccacctctccctgtcactgtcgcccatgctgcccccacctgtcccaacactttcctccaagctgtcctcacctgtccccaacactctcccccacactctctccacctgtccctgacactctcccccatgctgtccccacctgtccctgatgctgtcctccacactgtccccacctctccctgtcactgtccccatgctgtcccctgtccctcacactttcctccatgctgtcctcacctgtccccaacactctcccccactgtctccacctgtccctgacactgtcccccacactgtccccacctgtccctgatgctgtcgtctgtgctgtccacatactgttggtgacctggctctgttctccaagttcaagcctcagagcaggcagtggtgaggccgtggcacctgggtggcctgaggggtgggcgggccttgggggcagggctgtggcctcgctcacccctgtgctgtgccttgcctacaggtgaagtggatcttctcctcagtggtggacctgaagcagaccatcgtccccgactacaggaacatgatcaggcagggggcctagggccaccctctgtggggtgtccagggccgcccagaccccacacaggagccgtgggccatgctcagccatcacccaggccacacctgcccccgacctcaccgccctcaaccccatggctctctggcctcgcagtcgccctctgaccctgacacgccccccttccagaccctgtgcatagcaggtctaccccagacctccgctgcttggtgcatgcagggcgctgggggccaagtgtcccctcagcaggacgtccctgccctccggcccgccaggtgctcacacaaaaggaggtagtgaccagcatcccaggcccccactcaggcaggacctcgccctggagccaaccctgtccacgccagcctcctgaacacaggcgtggtttccagatggtgagtgggagcatcagtcgccaaggtagggaagtcacagcaccatcaggccctgttggggaggcttccgagagctgcgaaggctcactcagacggccttcctcccagcccgcagccagccagcctccattccaggcactcccgtgaactcctgacatgaggaatgaggttgttctgatttcaagcaaagaacgctgctctctggctcctgggaacagtctcagtgccagcaccaccccttggctgcctgcccacactgctggattctcgggtggaactcgacccgcagggacagccagccccagagtccgcactggggagagaaggggccaggcccaggacactgccacctaccacccactccagtccaccgagatcactcggagaagagcctgggccatgtggccgctgcaggagccccacggtgcaagggtgaggatagcccaaggaagggctgggcatctgcccagacaggcctcccagagaaggctggtgaccaggtcccaggcgggcaagactcagccttggtggggcctgaggacagaggaggcccaggagcatcggggagagaggtggagggacaccgggagagccaggagcgtggacacagccagaactcatcacagaggctggcgtccagccccgggtcacgtgcagcaggaacaagcagccactctgggggcaccaggtggagaggcaagacgacaaagagggtgcccgtgttcttgtgaaagcggggctgctggccacgagtgctggacagaggcccccacgctctgctgcccccatcacgccgttccgtgactgtcacgcagaatccgcagacagggagactcgagcgggagtgcggccagcgcctgcctcagctgtcagggaggactcccgggctcactcgaaggaggtgccaccatttcagctttggtagcttttcttcttcttttaaattttctaaagctcattaattgtctttgatgtttcttttgtgatgacaataaaatatcctttttaagtcttgtacttcgtgatgggagccgccttcctgtgtccacgcgcctcctgcccccggtgggaagcacggtcaggaggaggctggtccagctgcacctcgggggctccctgcatacgccccccgcctcctgcagccacacgcattgcccgagcgaccctccctggcccctgtcgctacatggacccccggggtttctcctcttttctacatggatgcagtttctcctcctgctgggcacggtgctgcctgccctggtcactctgcgggggacagggcctccagggaaagctgggtcgaggctgggagctggctcaggctgcccaggcagagccacagggagggccttccagaaccaaccatggtccgaagcgagaggtgggtgtcagatctgtgtgagtcagctcaggaccacagcggggcggctcccacagcagacatggatcctcccaggcctagagaccaggaatctgagatcaggatgcaggcagggctggtttctctcaagccctctctccttggcttgtagacaccgtctcctccctggtcctcacatggccatccctctgtgtgcccgtgtcctaagcttctcttcttataagaacacacatcggattagattagtgaccccctatgaacttaatgacctctgtaaagaccccatctccaaatagtcacattgtgaggccagggattaagacttgaatatatgaatttgtaggggccacgatttaacccatcacagtccagactctggcccccaaaattcatgttcttctcacatgcaaaacacattcatcctgtctcagcatccccctgggcactaggtcatgtagcaaggacggattttcaacagaaataactattgcaacagaagaaagagtccggcatgacctggactcaccttcatctgtgcagaggccacagccttgtaaagggaggtggtagggggagcagggagggtgctcggggctcagtcgtcggggaagggaaaagttgcccagcgctggtcagcgtccccgggatgggacccgctgtgtctgtgccggccactgttgaggtcaggattctgtcctcccagagcctggagacacaggccccatccttcccaatggggacacttcagggagtggctctcaggtcccgagaaagaccctcctgggtcacaggaaatgcacagacatcgggaacggatagaaggtcgtgtggttgcggccctctcagcagataccctgagaaagggaggtcggggttggtccaaacggtgagttctggtgcacggagctttctcaggcaggtgttgacggggcaggggtcggcctaggggtacggccagaagctgttagaaactgttagtgtctgctcaagtctttacaagccaaggttgaggccgagtggagaggctccgaggagcctggctggaactcagtcaaggacagggtcttgttactgcagtggctgcggtggctgcggtggctgcgaaatgccgtcggagttgcctgtggcaggagagagaccatctcacccaggaaggaggagtggttggattcgtttgtgtggcatcgagcagctggagcttcaccaaacacagagttggggactaaatccccagactccaggccctgccatgccgtgggaaggctcgccactggagggtgcgctccagggggcctggcctgaactgggtgctgaagcccagccctttaactctcaggacacgctgctgcagccccgcggggggtgagggagagagcacctggggtgcagggcgggcagctgctgcatcaccggctctatcccaagcccaaggatggcgtcccagagatgcaggagagctttgtccagagaaggtgccagccctcagggaccctgctggagagatctccaccctctgcccttcaaggggccctacgggcctccaggtgctctggtggggtgggctccagtccactgtctgaggatggacggcctggccaggataaggaaaggaaacccaggacggtgccgggctccgggtcattccgtgcactgagcaggctgagttgggaagaagcagatgcttcctgcagctgctgccccctgcagggcctggcgcctggaccaggttcccctggggaaattgggcccctccctgagccacccggggcccacctcccactttctacctgggaccgagcatcctccagagggtcagccctcctgcgggaacaccatgcccagccccaggaccctccctcaactctccagcaaggctgcccctgcacaccccccagcagcccatgctgtgatgtaacatgacatcgtgtgacatggtgtgatgtcctatcacagtgtgacatccctggtgtgatgtggtgtgacatggtgggatgtggtgtgacatggtgtgatgtccctggtgtgaggtggtgttggacatagtgtgatgtgatgcgacagatgtaacatccctggtgtgatttggtgtgacgtagtgtgatgggtatgacatccctggcttgatgaggtataatatgaaatgatgtggaatggtgtgacatgatgtgatgtgatgggacagggtgtgacgtccctggtgtgatgtgatgtaacaggctgtgacatagtgtgatgtgggtggtgtgacatgatgtgatgtggtgtgatggtgtgggacatccctggtgtgatggggtgtgattaaaccttgattccatgcagcacatgtttctgtgagcacagggttggggctaaagttacaggttaacagcatctcaaagcagaacaatttttctttgtacagatcaaaatggagtttcttatgtgttccttttctacataggcacagtaacagtctgatctttcttttccccacagtgtgacatggtgtgacatttctggtgtgactcttgtgttgtgacatttgtggtcaccccaggatacagaggtctctgtggccaagggaagggggagaatggaaccatctgagcatgttgacctggaggaattggtggcccttgagtccacgaagcccacccttccaggtgcccctgccccacgtgacccaagtgggcttgcagagcagcaagcaggactctggttagacaggaggaaggacctgccaccacgtggccttgtgaggagacagagcgaggctgtgacctcggcgtccgcccagcacagggtgctgctgaagctcctccggtcctctcagcagcggtctcagagcaaggcccaaggcaggctgaagagaggggcagagggaggatgctggggaggcaggtgtgaggggactgagagcccaggtttcagctgagcccctccacagggaaggagcctagctgaacacccatctccccacacgctcccaaccctgcctctgcccgaccacctcccagagggcacctcgaaccctctgctacccacactcagcaaggggtatggtgcccccaccaagcccagccagcaaagcctggcacagccacgcctgtgcccaccactcccatggccaaggtcactgctaacatggcaggacagagccaggcctggaggagacagaacatcagtcccatggggaagctccctgctcacacggcagggccaggcctggagaagacagaacaccccatctggcatggtactcaggctgcacatgcctgccacgaacgggggccacgcgacaatgcctgccacacatgggggccacgcaacgatgcctgccacacatgggggccacgcgacgatgcctgccacacatgggggccacgcgacgatgcctgccacgcatgggggacacgtgacacacacatacacacacgggcctcacaggcacacaaatgcttgcgaacccagcacccacccagcacactcaggcataggctccctgggcaggtcacaacctcacgccttgagctagtccatgtgccaggcccgtcacccacgtactcgtccccggtgctagctattgagccacaccgtcttctctgtggatccctcccagcccactcagcacaatggacatgctctctcccgtccagtgactgcaccggcctcttcccctcagcacccaagtctggccatctcccaggaaacccggaccaccacgggcagggaccacgttcctcactgtccacgtggaccaccccacacctgaccccagatgcagtcacactacgtcctgcttcaatattgaaaaggggaaaagctggaggagggtaaagatgaaagagaaaaaagcaagaggggagggtcacattcttctgaggctttgattacatctcactgagcccccacgttgcatgaaaaggaggggtggagggagcaattacacatttgccttgtgctcagtaaatctgcactttataagcaaataaacagagtagaggaagaagtcaaatatgcattcgtctcaggggcaggagggatgatttcttgtctcattttgtcccatgtcatgaagaccgggctgttaatttatattgtcagggtgagggaggccacctgggtagacctggcctatctgctgctgctctcagtttggaaacaaaaggaaacgcatgactttttttttttttttcatgactcagcttcccacctcaactgttctttttggcatagtgactttagggtcctgagattttattttcctttcacaatggtcaagatcacaccctcagtattcaggagagctggtccaacccagacccctgccgtccctggacgcttttcaaatacgtgctgcagtctctgacactctctcaccatggtagaaactgaggtcttggtgagtctgcagcccctgctcatggggacaatgcaggctgaaacccgcatttctgaccccaaagctcctgttcctttcactcacccccacaccagctctttgagtccagagctttgtccttgcctgagtcctaccctcagggacaggggcccaacccagccaccaacacatcataccctgagagggtgccaggagcccagagatgtttggagagcacagtagccctggaagctctgtggagatgctgcacatttctctattcaacagatactcgccaggtggccagcagcagagatgccacatggcatggagctcgccttggccaacaggacaggtgtggggttgggaggccttcccagggcactccttgaagcagagctgtggggaaaagttggggccaatctcagatctccccgtcaacaccgggtctcctgccctcctgggccacagaaaactaagctccgtggatactgcggctgggtggggccgtgggggagaagaaatcacaacgagttaaaagatcattttctaaaactgttatgatcaggactcacataaccatatgacgacacatttcagagatgctctttatctcattaattaaggtgtcgtaaccagttcaaagtggaattctaagtactacacttacataattgattcaggaatgctaaaaggagttcatagatagatgcaaaactggccttttccctggaagatgaggagcaattcattgtccttccaaagatgagaacttgaatttctaccaactcaaagagcttttgcattgctatcaattatgtacaacttagagcagtggtccccaacatttttggcaccaggaaccagttccatggaagacaatttttccacagaccaggatcgggggatggcttggggacaaagctgttccacctcagatcattaggcattagggtgtcataaggagtgtgcaacttagatcccgggaatgtgcggctcgcaatagggttcgctcctgtgagaatctaatgctgccactgatctgacaggaggtggagctcgggcaggaatgctcacacacccctcacctcctgctctgtggcccagttcctaacaggccatgaaccggttccagtgcatgacccagggattggggacccctggcttatagaggtgtaaaatagttcaaaggaaataaaagatgcagagctccacagaatgaaataacctggaagagtgtacaagacgatgccttgctttccatggaaggcacctactaatttttctcaatgtttcctataaacatatataactgactgacagaaacagatccataatataaagaagacccctgtaaaccaatgagaaaaaaaatcaaataatccaacgaggaataggcaagagaattgaacagatgttttacagaagatatccaaatagccactaaacatatgaaaaggtgttgaaccacactagtcaacagggaaatgaaaatgaaaaaccacatgagagaaagtagttctgattccagtaatgctagagcagctaatatcagactagccctttggcagatggcaattataaacactggaaacactgtaagcacacacaacacccacacacaccaattgcaggcactggaacatgaccagaagtaggcaaacactagtaaggattattccgtgaaatattcgtctgaagtcacaccccagtgcatgtaatgggtgcagctagagtttaagcaggaaactgcagccctcctggtgaggagtgggatgcagggctgcattttcagagcagctggaaatgaagagaagatgtccataaaggagaagctcaccgaagggaaaccacacaatctgcaagtaaactccactgaaacctctggccgatcccttaggtgtgcatgggtagggaaaactccaaagggcccagcagaaagcaacacctgtaagtcgagagaactgagattccagctactgccaactgccaggcagacagacttgggagtttgagtcaactcaagctaactgctaacattgaaaaaaacaattaatgctctgctaagaaagaatgcaaaccccatagcctgtacgcatgttatcaacatcaggtgcacatccaaaattaccatggatgcaaagaaacatgaaaatgtgatccatagtcagaagaaaaagggatcaatggagatcaactccaagatgacctagatgcagatacagttatcagacaaggactttaaagaagttatgttaaacatgttcaaagacttaaaggaaaatactattataatgagtgactagatggggaatctctataagagacggaaaatatttacaagaaccaaatgaaaattctagaactgaaagtatgattctgaaatgaaaaacatcatttttcagagcagggtgagaatggacatgggactcagagctgagcaggcctggtgggccccaggagggagacacagaggactgggggatttcaaggctggcagaggccagagatggatccccagctgggactggacctgggcttatgggagcaacaggtgacccatcctccttcctgggggcccaccctgcccggcccctccagcccagcacaggcattggatagaaccgggagagagcaggccaggcactgaggcctctgccccaaatgcccacagcctggggaaaatgagcagatagatgggggggcaagtggatccccaggcacacccacacagtgcacacagccccacctgggccagagggggcaggaggctcgccacccctgctgtggtttctcccacacttgatgcaggtgatattcctctgagattgtggactaagagttggtgctggaaggggttagccatcttggagatgttgctatggggtgcagggattttgcatgtgagaaggacatgattatggggggagcggagggcaaactgttgtgggttaaaatgtgtcccctataaattcatgtgttgaagtcctaacccccaggaccacagaatgtgaccttgtttggaaacagtctttgcaactgcaatcaagttcagatgaggtcaccctggagtagggcaagcctctgatccaatatgactgctgtcctcatgaaaagggggaatctgggtacagacagcacgtggggagaacaccctgtgaagatggtgctgcttccataagccaagagcagcagagacggccggcaaagcccagcagcaaggagagagcctgggacagagtctcccatgacacagaggtgccagccccgccgaggcctccatcccagatgcccggcctccagaaccaggacggaataaacgtctgttgtttaagccacgcagtctggggtgctgtgttgccagggccacagttaacggatacgagtgttgtcctgagctgccagccccacaggctgcacgaggcctccctgccccagcccagtgcagactccccagccccctgggtgtgccatgggcagtgcggggcccctcactgcatcctcccccagcctgggaggttgagcccattatgagctccatggggtgaagccggagccagaagctgggagccgactgggagcctgcggctggaggatggatttccccagggacccacacgtgcacctccacctgtctcctggacattctctctgagggcagggctggtgtcagctcagggatccagcagggacacaagggtgggccgggtccttgtggagagcacatttagtgggagggacatgatttcccttcaaagtgcccattctggatgcttcctggtccacgctggacacttcctgttccacgctggacgcttcctgttccacgctggacgcttcctgttccacgcttgatgtttcctgttccatgctggatgcttcctgttccatgctggacatttcctgttccactctggatgctccctgttccattctggatgcttcctgttccatgctggacatttcctgttccactctgcatgcttcctgttccactctggatgcttcctgtgcgaaacctcctcgggcttttggtctgcccagtccctctggctgcatctcgtcccccgctacctcccacctccacatccgtccttgcccagctcctctctctctccagagtttccacctggcaaggtccctgatgagctcagtccaggctcccccagcacaggtaggagcctagcacctgcccttggacctccccaccctgcatgatgccagcatccccaggccccagggaggccccatttctctctctactgctggcccagtggccctggagtcccactgcaactcgggtgtgcccctgacctctgaggaagttaagtgtcctgtccctagccaggctatcccctctgctcagccccagggccctgccccttaccccttcccctcacctgcacgataggctctggccaactctgcccaggccctgaatgggcccctctggctcccctctgctgctacactgccctgcaccacctccactcagcttcagtgtgttcatccacctgtcccaagtcccctcggcccccaggagcacagctggtggccctggttcctggcagcccatcttgttccttctggagcaccagcctcagaggccttcctgtgcagggtccactcggccagccctgggaccctcctggtctcaagcacacgttctccctgcagccagacctgcccctgcctgtgagctcagacctgagccttggaacgtcttcccttctccatcccagctcgcctttgccagctgctcagtgggatgaactcacactcccctccctccaccatgagtgagagtcagctggagagatgcccaggccaaagcagccaccagggcccagtggggggccagaagcttcaggtgagaggcccaggtattgagaggctgagaccatgggcagaatggtcataatcgctgccagtctcagtccagccccagggactcagagacagagaaaagagcagcacacaaggtccgggctccccaccttctcccgtgagtatgggggagtatgggggcagccaccacccccatccccacacacccatgaggcagcctcggctctgtgtggactccccctcgccctctgacacagaaaccaccagaagaaaagggaacttcaggaagtaaggggtgccgctggtttcaatcctgttcttagtctttgcagcgtggagttcacacccctggggacctgggacctgagctgtgatttcctaggaagacaaatagcggctgacggcgggggcggggccgcccacatgtacctcgccagaacaggaagggttgagacccccacctcggtgagtggggtcagcacagggcaggggcacaggctcgggaggaggacagcctgggcgcagccgtcggcgctcctagacctgagctgctgaacaggctgcaagaggctggggagacgcgggcgcgaggccagccccacatggaagcccaagcggagccagcacgggggaggtgggcagccttcaggcactgatgcccacccagtgcgagacgacggggaccgtgggcaggggcttccaagccaacagggcaggacacaccagaggctgactgaggcctccaggacgaccgggctgggagcacgaggaacatgacgggatgcggcagaaccggctgtggggtgatgccaggatgggcacgaccgacctgagctcaggaggcagcagagcgagggaggaggagaggccccaggtgaacggaggggcttgtccaggccggcagcatcaccagagcccagggcagggtcagcagagctggccgtagggccctcctctcagccaggaccaaggacagcaggtgagccgggagcagagcagcgagggtgagtgtggcagcaggacagaagggtggaagccaaggagcccagaggcagaggcagggacaggggagggacaggggctgggctcagagccagctgatggggctggggcacctgctggcggggagcagggctgtggtcagcagcggagaggaggggagagctgtgctgagtgcacgggcgggaggagggaagagtccagggaggcccagaaaggcccagagtgcagcaggcctggggcgaggggaggggctgaggcccagcagagcagaggccactgaggagctgaggttccggagaggcttccagagcaggagcagtgcagggacgggaggatccgggagctcatccaggaggggcacataggcaaggggctctgttggggagacctgactggacactggggctgctccacagcatagggaacaagccaagtgctgcaaaaacaaaaatgaggccagaaaaacagcccaaacctggacagagggtgccaggacaggcaggggggcaacagtggcctgagtgacattgctgccccgggttgagggaggacagagtgagcagggggcaggcattggagttcagggtaccaggaccgagcagccacaggtgagcagggcaggtgggggtagaaggagcagggggcagctcctggaactcaggggaccagggcagagcagccacaggcaaacaggagaggggagggggggcaggaggagcagggggcagctcttggagctcaggggaccagggcagagacgccgcaggtgagcaggggcaggtgggggggcaggaggagcagggggcagctcttggagctcaggggaccagggcagagcagccacaggtgagcaggggcaggtggggggcagaaggagtagggggcagctcttggagctcagaggaccagggcagagcagccacaggggaggaggggcaggtgggaggcaggatgaacagggggcggctcctggaactcaggaaacaggggagagcatcagaaggtgagcagggccagtgggaggttgcagagcaggggacagctcctggagctcaggggaccagggcagagccgccgcaggtgagcaggggcaggtggggggcaggaggagcagggggcacctcctggagctcaggcgaccggggcagagcagcctcaggtgaaaagggccggtggggggcaggaggagcaaggggcagctcctggaggtcaggggaccagggcagagccgccgcaggtcagcagggccggtgggaggcaggacgagcaggggacaggcactagagctcagggcaaggcagccacaggtgagcagggctggtgggaggcatcactcagctcctagactttggcaggagctgggtagttgccggcagcagacagctgagagctggtgaaagtgcagtgcagcctcctggtgccgggaagggagtgtgagtccatcccactgagcagttggcaagggcgagctgggatggagaagggaaggcattccagggctcagggctgggctctcaggcaggggcaggtgtggctgcagggggaacgtgtgcttgagaccaggagggtcccagggctggccccagcggaccctgggcaggaaggcctctgaggctggcgccccagaaggagcaagatgggctgccaggagccaggaccatcagcacaatgaagctgagtggaggtggtgcagggcagtgtagcagcagagggctgccagaggggcccattcagggcctgggcagagtcagccagagcctgtggtgcaggtgaggggaaggggtggtgagcggggccctggggccgagcagaggggatggcctggctgagggcagggcgcttagcctcctcagaggtcaggggcacaccccacctgcagtgggactccagggccactgggccagcggcagagagaaatggggcctccctgtggcctgggggtcctggcaccatgcagggtggggagggccaagggcaggtgcaaggctcctacctgtgctggggggcctgggttgagcccagcagggaccttgccgggggaagctctggagagagggaggaggtgggctggtggccgagaaggccaggccagggctgggagggtgaggttgtggtgactgagcctccagaagtaatgcaggacactgggaggcagggggcatccaggcactcagggccctgacctgggctgctgcacactggggctaaggggaaaggaggggagaggctgaggaggaggctccaggaggctattccaaggcagggggttccggggccctggggctgaagggcgccgaccctatgcagtgtctggcccctctgctgcacagaagaaaagggccttggagggcagagggcaggctatgaccagggccctgggcaagtcaggcccactcactagcggagggccacgctggggcggcagggtcaggagcttcaggggactcgggggacccacgagaagccatctgagaacagtgtccactggtcaagccaggcacccataaaaggctggagtggggccaatgggcatgagccgtccctgaggtggcaccgatggccagagctgaggccaagctagagacactggactgtgctgactcccggcaggcacagagcgctgacctggctgccgagccccgccccctaggctgcaggggtgcctgcagaagggcaccacagggccaccggtcctgcaagctttctggggcaggccgggcctgactttggctgggggcagggagggggctaaggtgacgcaggtggcgccagccaggcgcacacccaatgcccgtgagcccagacactggaccctgcatggaccatcgcagatagacaagaaccgaggggcctctgcgccctgggcccagctctgtcccacaccgcggtcacatggcaccacctctcttgcagcttccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttggtgagaggccagcacagggagggagggtgtctgctggaagccaggctcagccctcctgcctggacgcaccccggctgtgcagccccagcccagggcagcaaggcaggccccatctgtctcctcacccggaggcctctgaccaccccactcatgctcagggagagggtcttctggatttttccaccaggctccgggcagccacaggctggatgcccctaccccaggccctgcgcatacaggggcaggtgctgcgctcagacctgccaagagccatatccgggaggaccctgcccctgacctaagcccaccccaaaggccaaactctccactccctcagctcagacaccttctctcctcccagatctgagtaactcccaatcttctctctgcagagtccaaatatggtcccccatgcccatcatgcccaggtaagccaacccaggcctcgccctccagctcaaggcgggacaggtgccctagagtagcctgcatccagggacaggccccagccgggtgctgacgcatccacctccatctcttcctcagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaaggtgggacccacggggtgcgagggccacatggacagaggtcagctcggcccaccctctgccctgggagtgaccgctgtgccaacctctgtccctacagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagagcctctccctgtctctgggtaaatgagtgccagggccggcaagcccccgctccccgggctctcggggtcgcgcgaggatgcttggcacgtaccccgtgtacatacttcccgggcgcccagcatggaaataaagcacccagcgctgccctgggcccctgcgagactgtgatggttctttccacgggtcaggccgagtctgaggcctgagtggcatgagggaggcagagcgggtcccactgtccccacactggcccaggctgtgcaggtgtgcctgggccgcctagggtggggctcagccaggggctgccctcggcagggtgggggatttgccagcgtggccctccctccagcagcacctgccctgggctgggccacgagaagccctaggagcccctggggacagacacacagcccctgcctctgtaggagactgtcctgttctgtgagcgccctgtcctccgacccgcatgcccactcgggggcatgcctagtccatgtgcgtagggacaggccctccctcacccatctacccccacggcactaacccctggcagccctgcccagcctcgaacccacatggggacacaaccgactccggggacatgcactctcgggccctgtggagggactggtccagatgcccacacacacactcagcccagacccgttcaacaaaccccgcactgaggttggccggccacacggccaccacacacacacgtgcacgcctcacacacggagcctcacccgggcgaaccgcacagcacccagaccagagcaaggtcctcgcacacgtgaacactcctcagacacaggcccccacgagccccacgcggcacctcaaggcccacgagccgctcggcagcttctccacatgctgaccagctcagacaaacccagccctcctctcacaaggtgcccctgcagccgccacacacacaggggaacacacgccacgtcgcgtccctggcactggcccacgtcccaatacagcccttccctgcagctggggtcacatgaggggtgggtttcaccatcctcctgccctctggggctcagggagggacacgggagacggggagtgggtcctgctgagggccaggtcgctatctagggccgggtgtctggctgagccccagggccaaagctggtgcccagggtggacagcttccgggagctgacctcaggacattgttggcccatcccggccgggccctacatcctgggccccgccacagagggaatcacccccagaggcccaagcccagggggacacagcactgaccacccccttcctgtccagagctgcaactggaggagagctgtgcggaggcgcaggacggggagctggacgggctgtggacgaccatcaccatcttcatcacactcttcctgctaagcgtgtgctacagtgccaccgtcaccttcttcaaggtcggccgcacgttgtccccagctgtccttgacattgtcccccatgctgtcacacactgtccctgacactgtcccccactctctccacaaactgtccctgacactgtcccccatgctgtacacacctgtccaacagtgtcccccaggctgtctccacatgtccgacactgtcccccatgctatcccccatcctgacactgtcccccacactgtccccacctgtccttgatgctgtgccccacggtctccccacctctccctgattctgtcccccacgctgtacctgtccccaatgctctcccccagcctgtccccaacactgtccgccatgctgtcccacctttcccccacactgtcccccagtctccgcctgtccctgacgctgtcccacatgcggtcccccattcctgatactgtcccccatgctgtccccaccttccccaacactgtaccccacagtccccaccttccccaacactgtccccacctgtccctgacactcccccatgctgtccccacctgtcccccactcaccccccacactgtccctgtctctgacactgtcccccatgctgtccgcacctgtccccgtcccccacgctgtccctacctgtccctgacactgtcccccatgctgtcccccactttccccagctttccctgtcccccacgctgtccctacctgtccctgacactgacccccatgctgtccgcacctgtcccccactctccccacctctccctgtcacccacgctgtccctacctgtccctgacactgtcccccatgctgtccccacctgtcccccaatctccccacctctccctgtcccccacgctgtccccacctgtccctgacgttgtcttctgtgttatccacatgctgtcactaccatggctctgctctccatgtccaggcctgggggcaggcagtgtagagccccggtacctgggtggcctgaaaggcagatgggccttgggagcagggctgtggcctgggtggcctgaggggtgggtggggctcaggggcagggctgtggcctcgctcacccctgtgctgtgccttgcctacaggtgaagtggatcttctcctcagtggtggacctgaagcagaccatcgtccccgactacaggaacatgataaggcagggggcctagggccaccctctgcggggtgtccagggccgcccagaccccacacacgagccgtgggccatgctcagccaccacccaggccacacctgccccctgacctcaccgccctcaaccccatggctctctggcttcgcagtcgccctctgagccctgaaacgccccccttccagaccctgtgcatagcaggtctaccccagacctccgctgcttggtgcatgcagggcgctgagggccaggtgtcccctcagcaggacgtccctgccctctggaccaccaggtgctcacacaaaaggaggtaaccggcatcccaggcccccactcaggcaggacctcgccctggagccaaccccgtccacgccagcctcctgaacacaggcatggtttccagatggtgagtgggagcatcagtcgccaaggtagggaagccacagcaccatcaggccctgttggggaggcttccgagagctgcgaaggctcactcagacggccttcctcccagcccgcagccagccagcctccattccgggcactcccgtgaactcctgacatgaggaatgaggttgttctgatttcaagcaaagaacgctgctctctggctcctgggaacagtctcggtgccagcaccaccccttggctgcctgcccacactgctggattctcgggtggaactggacccgcagggacagccagccccagagtccgcactggggagagaaagggccaggcccaggacactgccacctaccacccactccagtccaccgagatcactcggagaagagcctgggccatgtggccgctgcaggagccccacagtgcaagggtgaggatagcccaaggaagggctgggcatctgcccagacaggcctcccacagaaggctggtgaccaggtcccaggcgggcaagactcagccttggtggggcctgaggacagaggaggcccaggagcatcggggagagaggtggagggacaccgggagagccaggagcgtggacacagccagaactcatcacagaggctggcgtccagtcccgggtcacgtgcagcaggaacaagcagccactctgggggcaccaggtggagaggcaagacgacaaagagggtgcccgtgttcttgcgaaagcggggctgctggccacgagtgctggacagaggcccccacgctctgctgcccccatcacaccgttccgtgactgtcacgcagaatccacagacaggaagggaggctcgagcgggactgcggccagcgcctgcctcggccgtcagggaggactcccgggctcactcgaaggaggtgtcaccatttcagctttggcttttcttcttcttttaaattttctaaagctcattaattgtctttgatgtttcttttgtgatgacaataaaatatcctttttaagtcttgtacttcgtgatgggagccgccttcctgtgtccacgcgcctcctgcccccggtgggaagcacggtcaggaggaggctggtcgagctgcacctcgggggctccctgcactcgccccccgcctcctgcagccacacgcattgcccgagcggccctccctggcccctgtcgctacatggacccccggggcttctcctcttttctacatggatgcagtttctcctcctgctgggcacggtgctgcctgccctggtcactctgcgggggacagggcctccagggaaagctgggtcgaggctgggagctggctcaggctggccaggcagagccacagggagggccttccagaaccaaccatggtccgaagcgagaggtgggtgtcagatctgtgtgcgtcagctcaggaccacagcggggcagctcccacggcagacatggatcctcccaggcctagagaccaggaatctgagatcaggatgcaggcagggctggtttctctcaagccctctctccttggcttgtagacaccgtctcctccctggtcctcacatggccatccctctgtgtgcccgtgtcctaagcttctcttcttataagaacacacatcgcattagattagtgaccccatatgaacttaatgacctctgtaaagaccccatctccaaatagtcacattgtgaggccagggattaagacttgaatatatgaatttgtaggggccacaatttaactcataacagtccatgctatggccccccaaatttcatgttcttctcacatgcaaaatacattcatctgtctcagcatcccccaagtcttagtcctttcagcatcaattctaagcctaaaatctcatcaaactgtcaccctcatcaggcacaggtgaaacctggtgtgtgattcattctatggtaaaattcagcccataggacacatggtgggtgccaggaacgaggacaaggcaggagaggcaaaggtggagagagacattttcaaagataaagctgggcactagatcatgtagcaaggacggattttcaacagaaataactattgcaacagaagaaagagtccggcatgacctggactcaccttcatctgtgcagaggccacagccttgtaaagggaggtggtagggggagcagggtgggtgctcggggctcagtcgtcggggaagggaaaagttgcccagcgctggtcagcgtccccgggatgggacctgctgtgtccgtgccggccactgttgaggtcaggattctgtcctcccagagcctggagacacaggccccatccttcacaaaggggacacttcagggagcggctctcaagtcttgagaaagaccctcctgggtcacaggaaatgcacagacatcgggaacggatagaaggacgtgtggttgcggccctctcagcagacaccctgagaaagggaggtcggggttggtccaaacggtgagttctggtgcacggagctttctcaggcaggtgttgacggggcaggggtcggcctaggggtacggccagaagctgttagaaactgttagtgtctgctcaagtctttacaagccaaggttgaggccgagtggagaggctccgaggagcctggctggaactcagtcaaggacagggtcttgttactgcagtggctgcggtggctgcggtggctggaaaatgccgtcggagttgcctgtggcaggagagagaccatctcacccaggaaggaggagtggttggattcgtttgtgtggcatcgagcagctggagctgcaccaaacacggagttggggactaaatccccagactccaggccctgccatgccgtgggaaggctcgccactggagggtgggctccagggggcctggcctgaactgggtgctgaagcccagccctttaactctcaggacacgctgctgcagccccgcggggggtgagggagacagcacctggggtgcagggcgggcagctgctgcatcaccggctctatcccaagcccaaggatggcgtcccagagatgcaggagagctttgtccagagaaggtgccagccctcagggaccctgctggagagatctccaccctctgcccttcaaggggccctacgggcctccgggtgccctggtggggtgggctccagtccactgtctgaggatggacggcctggccaggataaggaaaggaaacccaggatggtgccgggctccgggtcattccgtgcactgagcaggctgagttgggaagaagcagatgcttcctgcagctcctgcccctgcagggcctggcgcctggaccaggttcccctagggaaattgggcccctccctgagccacccggggcccaccgccccctttccacctgggaccgagcatcctccagagggtcagccctcctgagggaacaccatgcccagccccaggaccctccctcaactctccagcaaggctgcactgtgggcggcccctgcacataccccagcagtccgtgctgtgatgtaacatgacatggtgtgacgtggtgtgatgtctctggtgtgacgtggatgtcatgtggcatgatgtgacaggacatggtgtgatgttgtatgatgtggtatgacagtgtgatatccgaggggtgatgtgatgtggtgtgacatgttgtaatgtccctggtgtgaggtggtgttgcacatggtgggatgtggtgtgacatggtgtaatgtccctggtgtgaggtggtgttgcacatggtgggatgtggtgtgacacagtgtgacatccctggtgtgatgtgctgtgacatagtgtgatgggtatgacatccctggtatgatgagctataatatgaaatgatgtggaatggtgtgacatgatgtgatgtgatgggacaaggtgtgacatccctggtgtgatgtggtgtgatgaagtgtaacaggctgtgacatactgtgatatggtgtggcatgtgacgtggtgtgacatgtgatgtggtgtgatggggtgtgacatccctggtgtgatggggtgtgaggtagtttgacgtggtgtgatgtaatgtgatgtggtgtgatggggtatgacatctgtggtgtgatgaggtgtggtgtgacatgatgtgacgtgtgacgtgctgtgacagggtgccacatccttggtgtgatgtgatgcggtgtgacatggtgtgatgtggcaggatggggtgtggcagggtacgacatccctagtgtgatgatgagtttcatggtgtgatgtggcgtgacatccctggcatgacatagtgtgatgtggtgtgacatggtgtgacattcctggtgtgactctgctgttgtgacatttgtggtcaccccagcatacagaggtctctgtggccaagggaagggggagaatggaacgatctgagcaggttgacctggaggaactggtggcccttgagtccacgaagcccaccctgctaggtgcccctgccccacgtgacccaagggggttgcagagcagcaagcaggactctggttagacaggaggaaggacctgccaccacgtggccttgtgaggagacacagagcgagcctgtgacctcggcgtccacccagcacagggtgctgctgaagcccctcctgtcatctcagcaggggtcccagggcaaggcccgaggcaggctgaagagaggggcagagtgaggatgctggggaggcaggggtgaggggagtgagagcccaggtttcagctgagcccctgcacagggaaggaacctagctgaacacccatctccccacacactcccaaccctgcctctgcccgaccacctcccagagggcacctcgaaccctctaacacccacactcagcaaggggtatggtgtccccaccgaatccagccagtgaggcccggcacagccacgcctgtgcccaccactcccatggccaagctccctgctaacatggtaggacagggccaggcctggaggagacagaacatcagtcccatggggaagctccctgctcacatggcagggcagggcctggaggagacagaacgccccatctggcatggtactcaggctgcacatgcctgccacgcacgggggccacgcgacaatgcctgccacgcatgggggacatgtgatgctgcctgccacgcatgggggacacgcaacaatgcctgacacgcatgggggccacgtgacacacacatacacacacgggcctcacaggcacacgaatgtttgcaaccccagcacccacccagcacactcaggcacaggctctccaggtgggtcacagcctcacgccttgagctactccatgtgccaggcccttcacccacgttcctgtccccagtgccagctgttgagccacaccgtcttctctgtggatccctcccagcccactcagcacaatggacatgctctctcccgtccagtgactgcactggcctcctcccctcagcacccacgtctggccatctcccaggaaacccggaccaccacgggcagggaccaccttcctcactatccacatggaccaccccacacctgaccccagatgcagtcacactatgtcctgcttcaatattgaaaaggggaaaagctggaggaggggaaagatgaaagagaaaaaagcaagacgggagagtcacattcttctgaggctttgattacatctcactgagcccccacgttgcatgaaaaggaggggtggagggagcaattacgcattcgccttgtgctcagtaaatctgcactttataagaaaataaacagagtagaggaagaagtcaaatatgcatttgtctcaggggcaggagggatgatttcttgtctcattttgtcccatgtcatgaagaccgggctgttaatttatattgtcagggtgagggaggccacctgggtagacctggcctatctgctgctgctctcagtttggaaacaaaaggaaacgcatgactttttttttttttcatgactcagcttcccacctcaactgttctttttggcatagtgactttagggtcctgagattttattttcctttcacaatggtcaagatcgcaccctcagtattcaggagagctggtccaacccagacccctgccgtccctggacactttcaaatacgtgctgcagtctctgacactctctcaccatcgaagaaactgaggccttggtgagcctgcaagcccctgctcatggggacaatgcaggctgaaacccgcatttctgaccccaaagctcctgttcctttcactcacccccacaccagctctttgagtccagagctttgtccttgcctgagtcctaccctcagggacaggggcccaacccagccaccaacacatcataccctgagagggtgccgggagcccagagatgtttggagagcacagaagccctggaagctctgtggagatgctgcacatttctctattcaacagatactcaccaggtggccagcggcagagatgccacatggcatggagctcgccttggccaacaggacaggtgtggggttgggaggccttcccagggcactccttgaagcagagctgtggggaaaagttggggccaatctcagatctccccgtcaacaccgggtctcctgccctcctgggccacagaaaactaagctccgtggatactgcggctgggtggggccgtgggggagaagaaatcacaacgagttaagagatcattttttaaaactattatgatcaggactcacataaacatatgacgacacatttcagagatgctctttatctcattaattaaggtgtcgtaaccagttcaaagtggaattctaagtactacacttaacataattgattcaggaatgctaaaaggagttcatagatagatgcaaaactggccttttccctggaagatgaggagcaattcattgtccttccaaaggtgagaacttgcatttctaccaactcaaagagtttttgcattgctatcaattatgtacaacttagagcagtggtccccaacatttttggcaccaggaaccagttccatggaagacaatttttccacagaccaagatcgggggatgtcttggggacaaagctgttctacctcagatcattaggcattaggatttcacgaggagtgtgcaacttagatcccaggaatgtgcagctcgcaatagggttcgctcctatgagaatctaatgctgccactgatctgacgggaggtggagctcgggcaggaatgctcacacatccctcacctcttgctctgtggcccagttcctaacaggccatgaaccggttccagtgcatgacccaggggttggggacccctggcttatagaggtgtaaaatagttcaaaggaaatgaaagatgcagagctccacagaatgaaataacctggaagagtgtacaagacgatgccttgctttccatggaaggcacctagtaatcatttggtccatttcagttcttcttaatgcttcctataaacatatataactgactgacacaaacagatccataatataaagaagacccctgtaaaccaatgagaaaaaaaatcaaataatccaacgaggaataggcaagagaattgaacagatgttttacagaagatatccaaatagccactaaacatatgaaaaggtgttgaaccacactagtcaacagggaaatgaaaatgaaaaaccacatgagagaaagtagttccgattccaataatgctggagcagctaatatcagactagccctttggcagatggcaattataaacactggaaatgctgtaagcacacacaacacccacacacaccaattacaggcactggaacatgaccagaagtaggcaaacactagtaaggattattccctgaaatattcatctgaagtcacaccccagggcatgtaatgggtgcagctagagttcaagcaggaaactgcagtcctcctggtgaggagtgggatgcagggctacattttcagagcagctggaaatgaagagaagatgtccataaaggagaaggtcaccgaagggaaaccccacaacctgcaggtaaactccactgaaacctctggccgatcccttaggtgtgcatgggtagggaaaactccaaagggtccagcagaaagcagcacctgtatagtcaagagaactgagattgcagatactgccaactcccaggcagacagacttgggagtttgagtcaactcaagctaactgcttgctaacatgaaaaaaacaattaatgctctgctaaggaaggatgcaaaccccatagcctgtacacatgttatcaacaacatcaggtgcacatccaaaattaccatggatgcaaagaaacatgaaaatgtgatccaaagtcagaagaaaaagggatcaatggagatcaactccaagatgacctagatgcagatacagttatcagacaaggactttaaagaagttatgttaaaaatgttcaaagacttagagaatatggttatcatgagtgactagatgaggtatctctataaaaaactgaaaatagttacaagaaccaaatgaaaattctagaactaaaagtatgattctgaaatgaaaaacatttggccaggcccagtggctcatacctgtaatcctagcactttgggggcccaacagggaagtatcacttgatctcaggagcttgagaccagcctgggcaacgtggtgaaaccccatctctattttattaaaaaagaaaagaaagagaaaaacattacccaagtttaataacagattggagaagacaaaagaaggaactgaaaacttaaagatgcatcaatagaatatatcaattatttttaatccaatccaaagaaaagagagaaaaatactaaaaaaggaaaaaagactcatcctgctggagaaggcgaagcattctaaaacatgtgaaactggagtccagagggggatgtaatacttccatgggaaaggtcaaccctaagctatatgcaaatgtacctgcataggctggtgtggtgggctgatggcatctccctggccaaatgtatgcccacctggaacctcagaatgtgaccatatttagaaatagggtctttacaaattaggttaaggacttgagatgatatcatactaaattttggatggatcccaagtccaaacactggtgtcctcataagaggagaggacacagacacacgtggagataagccacatgatgacaaagaagaagatgaggggtgtgtcaggagccacctgtgtttgtccatttgcattactgtaaagaaatacctgaggctgagtaagttataaaggaaagaggttgaattggctcacagttctgcaggctgtataggaagcatggcaccagcatctgcttctggcgaggacctcaggaaacttacagcatagcagaaggtgaagggacagcaggtatgccacatggcaagaatgggagcaagaggctgaggggggccccagacttaaacaactagattgtgtgtgagctgactgggggagaattcactcatcaccaaggggaagatgctcaatcattcatgagggatcttcccccttgatctaatcacctcctaccaggccccacttccaacactgggaatcatattgcaacatgagatttggaggggacaaatatataaaccatatccttccacccctggtcccccaaatctcatgtccttctcatgttgcaaaatataattatgccttctcaacaatcccccaaagtcttacctcattccagaatcaacccaaaattcccaagtcccaagtctcatctgaagatgagtcccttccacctatcagcctaggaaatcaaagacaaattgactcccaaaatacaatgagtgtgcagacattgggtaaacattcccattccacaagggagaagttggcaaaaagaaaggatctacatgccccatacttgtcagaaatccagcagggcagttattaaatcttaaagctccaaggtaatctcctttgactgcgtgtcccatatccagggcacactggtgcagggggtggactcccaaggccttggaaatctctacccctgtggctttggaggatgtagcccctgtggcttctctcacacgatagagttgagtgcctgtggcttttccagattcagggtgcaagctgccagtggatccaccattctggggtctggaggacagtggcccccttcccacagctccgctaggcagtgccctggtggggacattatatgggggttcaaccccacattctctttggcactgctctagtagaggttctctgtgagggctccatgctggcaggaggcttctgtctgggcagctaggctttctcatacatttctgaaatctagagggaagatgccaagcttccttcactcttgcattctgggggcctacaggcttaacaccagatggaagtcaccaaggcttatagtggcttgcactctccaaagcagcagcctaagctgtacttggggccctttgagccaaggctggagccagaggaaccaggatgtggagagcagtgtcccaaggctgcacaggcagcagtggccatggccatggcccacaaaaccatcctttccctcttggcctctgggcctgtgatgggaaagaccacctcagagatttccaaaatgccttcaaggcctttttccctttgttctggatatgagcacttagctcccttttagttatgctaatctctctagcaactggctgctccatagcctacttatatttgtctcctgaaaataccttttcttttctaccacatggccaggctgtgaattttccacattttttatgctctgcttccctttgttgatgaaaaaagccaaactccataaaacacttgaaaaattgattctgagccaaatatgagagccatgaactgtggcacagcctcaaaaggtcctgagaacacctgtgcaaggtggttgggttgcggcctgcttttatgttttagggagacatatcaatcaatacatgtaaagtatacattggtttgatttggtttggaaaagcaggacaattcaaagtggggaattccaaatcatggtggatttgaagattttctgattggcgattggctgaaaaatttaaattatctaaaaagttgaagtcagcgaaaagcaatgcttaagataagggggttgtggaagccaaggttcttgttatgtagacgaaggctccacgttccagagagaagagatggtcaatgtctcttatcagaacctaaaaggtgccagactcttggataaatctctcctgaatcaggaagagacctggaaagggaaaaagattctcaacagaatatacatttcctccacaagagacggctttgcagggcccttccaaaatgtgtcagagaaacatattctggcaataaatactttaatttccttccatgcctgccacctgtcatgtgatgctataccagagtcaggttgggatttgataccttattgctacaaagagtctgctttgtcagtcttaagctccctgttttaatgttaacactggtcagctgagcctaagctccaacagggagagggtatagtgagggagtccaaaccaccctccccttcctgtcatggcctgaactggttttccaggtttctttggaatccccttggtttagcattttattttgtcgtttacaccttttaaatataagttccaactttcagtcatttctttgctcccatatcttaccatagactgttagaagcaaccaggtcacaccttagaaacatctgcttagaaatgtcttccacagatgccctaagtcatcactcttaaggtcaaacttccacagatccctaaggcatgaacacaatgcagccaagttgtttcttaggatttaacaagcgtgacctttaccccagttcccaataagttcctcatttccatctgagatttcatcagcctggctttcacagtccatatgtctatcagcattttggtgacaaccatttaatagtctctaagaaattccaaactttccctcatcttcctgtcttcttctgagtcctccaaattcttctaacctctctgcctgttacctgattccaaagctgcttccacattttcaggtatccttatagcaatgttccactcctcaataccaatgttctgagttagtctatttgtgttactagaaaaaaaaaaaaacatgaatctggtaatttataaagaaaagaggtttgcaccaggcactgtggcaaggaagggaggattaactagctcacagttctgcagccattctggaaacacggccctggcatctgcttctggcgaggcctcagggagattgcaatcacggcagaaggcgaagggggagcaggcatgtcacatggcaagagggagcaagagaagagaagtggcacgtcccagacttttaaacaatgagctgtcacagggactaactgagggagaactcgctcatcacctgggagatggtgctaggccattcatgaggggtccagccccatgatctaatcacctcccaccaggcccacctccaacactgggaatcacatctcaacacgaaatttgaagagacacacatccaaactattgcaccacaggaagctggaagaggtggacggtcctcccctggagcactcagagacagccaccaacaccttgatctcagattcctgactcccagaactctgaaaaaatttttgttgttttaagccacatttgtgatattttgttacggcagccacagcacggatatagctggtaacagagttctttagcctccaaaatacaagcctggggtaaataactattgaatttggccacatggaaatcaggaagaatgtaataagcatcctcgatggatgggatgacctgggagatcgtggcaagtttaaagctaattggaagttggcaaccaaaaaatcctgtcttgcaaattgccaggaaattgccaagaaaacctttagaaaacatggttaaagatggagaaacccggatgaatccctggtttctgaagaggtgcttaggcattgaagtgagactgacgagacttcacactgtacccttcagaagggcagacactcacgagatcatcaaccacagctccctcgctgggaggcagacacagagctggaggcggcggccacaaactaggtgggcagagaggcgtcagcatcgggacttgcaggaggccctgggaaggaacagggagcggtggggcctggacagccctggggaaaggaagttacttggaggagaccaggggcttgcatttgggccaaaaccaaggacaagagatcagctggtcccagggaactctggagcccaacaccccaccacgggtgcaggggcctgacgacccaagagagggctgtgggcaccgggcaccagcctgtggggggtctgaaggctgctgcccagccacacatgtcctggttctgaacaaagggttcaagagacacctggaaacctacccttctgagagcagcctcttagcctcagctggtattggcccctggtcaccccacatgccccgacagtggggcctggcctcagaaaggggcccctccatttgtactttctatctgatccttgacacagtgctaacaccaaagaccaaacccgaatcttggttcacatactctgcaaagaaatgactaagactagttcttccggaggtcagttttagaacgtttattctgacttaattctgccttatctctgtgcaccaagaaaactatctgcacatctgtagtaaaatgtgaaggtaccttcattttgtttgtatactaaacttttaagaaatacctcactttttaaaacttggttttgtgttttgtatgcttataatattttccataatagatcattttaatgataaactctgaatcttctgacagaatgcagatcaatggattcctggccatcagggaggcgttgattgcaaaggggcctggtggaatatttggagagattctacatcttcttgcaactgttcatctggattacggtggtggttgcatgagtgtgcatttgttgaaactcacatgtcacaggatggattatactgaatgtaaactacacttgtgtaaatatgacttttaaaactttaaaaagttgggggatggttcactgccccggctcgaagccccctggccacgctgcctggccagcccacccccatccctgccagcgcttgcctccagcgtcccaacagcctcctgaccccctgggctgctctaaaccctcaggagcgcagccatctgggatcagctggatggagatggggagcccgagactcgtgccacaccacgtcctcccgcccccaccagccacacgcagacgtcaaagcagcactgtcctcgcacccgctgctcccacccaccctggcatggccattccaggcctggggcaggaaggcagacgctccccctgcccccagacacaagcattcctgcacacacccccagcacacacacgcactcccatgcgcacactgacacacacaggtgtgtgcagctgagacacagcccgttcccaggaagcccagcccccatcactgagggaaaggggcagcaccgtagggccacaggagtggcagctggacacagagccaggcgctggcgaaggcccaggccactgaggcaggctgccggcatggctgggcgtgaaggccagaacagggcaggaggggctgggggcactatgcctattgggcctaggtgggcacacgccgggcaggagaggaacagcccggcccctcagacaggaaggggtgggggcaggggccatttctggaggccagggcagggccagcaccccaaggaaaagcagagcagggtgagaacggacatggggctcagagctgagcaggcctgctgggccccaggagggagacacagacgactggggatctcaaggctggcagaggccagagatggagccccagctgggatgccaacctccttcctgggggctcaccctgcccggcccctccagcccagcacagcttggggcattggatagaaccgggagagagccgaccaggcactgaggcccctgccccaaatgcccacagcctggggaaaatgagcaggtacatgggaggggcaagtggagccccaggcacacccacacagtgcacacagcctcaccggggcccgggaagtgggggaacaggaggctcaccacccctgctgtggtttctctcagaatcatgggtccttccagggaactcagcattttcccctcagcctcccacacggcacctttctccagggccacaagcagggcatgggggccttggacagcctgggaacactcacccccagcctgcgttccctgagcctcacatcatagccctccagggccctggcagccagcagcccttctggtgtcttccacacgtggtgagcatctctctgagggcaccaggcccgacagcccctctccctccacaggacaaccagccctgggcacccagggtcccaggggcaggtcccagtgtctccctccccaaagattctatacaacccacccctccccagtggccactccatgcatgctggcctccaggggacaggcaggccaatggtgtgaaggaaattatctcgctcagagcagagcactgggtgcaaccagggacgaatgccatgggcgcctccaggaaggccaccgagcccgagcccagccttctccatgtgcccacgcccacccatggcatagacggggcacagtgtccccagcctccagcagcttcaaggaccttgcagagccaccagccacctccgcacagctccctgccagcccccagccaggccccagccttcatgtgctcgccttgaggagcagcccagcttgggacccccggctgcaggacagtgacctgggagtgagtacaaggtgaggccaccactcagggtgccagctccaagcgggtcacagggacgagggctgcggccatcaggaggccctgcacacacatctgggacacgcggcccccgagggccagttcacctcagtgcgcctcattctcctgcacaaaagcgcccccatcctttcttcacaaggctttcgtggaagcagaggcgtcgatgcccagtaccctctccctttcccaggcaacgggaccccaagtttgctgactgggaccaccaagccacgcatgcgtcaagagtgagagtccgggacctaggcaggggccctggggttgggcctgagagagaagagaacctcccccagcactcggtgtgcatcggtagtgaaggagcctcacctgacccccgctgttgctcaatcgacttcccaagaacagagagaaaagggaacttccagggcggcccgggcctccgggggttcccaccccatttttagctgaaagcactgaggcagagctccccctacccaggctccactgcccggcacagaaataacaaccacggttactgatcatctgggagctgtccaggaacccgacagggagccggacgggccacaccatccacaggcaccaaatggacgacccggcgcttcaggtatcccagcccaccgggagccccaatcgaggggccggcccaggcagcagtgagggagaggctgcctgggcccctgacagcgaggggactcctgggccaccctcacagcatcaaccaagcttcttggtcactgcgtggactctaggcatcccttccctgcatggggacacaggaaagctagaaacagcctaacgccgacctggagaaggcagggggctgggaatcttggctgggcccaagaccaagaaggtcagagaccccacgctgggcagggctaggctgggtgcagactgcctgccacccctaggacagggacagccaacccagagctgggagggagggtggggaggcggcagcagggagctgtcctgagctccactgcgcaactggctgatcttggcaagtctgagctgggcggactgaggggggcttggctgagtggactagactgagacgggcctaacagactgagctgaggcgagctgggtgggctgagagggctaccctgtcccttagaggacaggtggccaagctgggctgtcctgagccagggcgatcggggctggcccgggccaggcgggtttagctgagttgagtgagtggactgggtagagggaaatgagctaggctcagctgagctaggcttgagctgggttatcctaagccctaaggtggactgagctgggctgagctggacttatctggggggcagggcaaagtcaggctgagctgaggtggcctgccctgggtggtccaggattgagttaagctgaattaggctgacctggacttgactggacttggttgaaataagctgggccgacacaggagtagggacaagctacagttctctacttaggataaaatgggtgctcgtggactatccgggctgaaggagaccaagctggggtattacctgctgagcttacctgacctggcctgagttcagcagggctgcgctgagctggacagacctgagccaagcttagctggttgggctgagtaagctgggctgagctaaatgggattgagctgaggagggctaggctgggggagagacctgacgacggacagggttaaaagctggagtgagcaggccttaaattattgaactaaattgggctggggtgatctgaatttagctgggatgagctgggctgggctgaactgtgcccacgtgaactgggctaaactaggctcgcctgagtggactcagctgggttggtctcaactgggttcagctgggctgggctgggctgagctaggttagactggggcaggctgggctgggttgggctgggttgggctgggctgctctaggctaagctaacctaacctaacctgggttcagctggcctaggttgggctgggttgggctaaactgggttcagctgagatatgctaatatgggctgggctgggtcaggttgaggttaactgaactgggctgacctgggctgagctcaactgagttcacatgggctgggctggcctggcctggcctaaactgggtttggctgggctgggccaactggactgaggtggatggagctgggctgagctggcctggccgggcctgagctgtgattggaagacctgggctgagctggacagacctgagccaagcttagctagttgggctgactaagctggtttgggctaaactgggttgagctggggaggactaggctgggtgagtgacctgagatggacagggttataagaagctggactgagctgggcttggattattgaaccgaattgggttggggtgatttaaactgagttctgctgggataagctgatctacgctgggctgaactgagcagagctgaacctagctgggctgggctaaactgggctagcctgagtgggctgaactgggctgctgggctggactgggtaagctgggctgagctgggttgggtggaaatgggctgagctgagctaggctaaactgggtttggctgggctgggctgggctgggctgggttcagctgagcggggttgggttagactgggtcaaactggttcagctgagatgggctgatatgagctgggctgggccaggctgagctcagctaaactgggcagtgctggactgggctgagctagactgggcaactgtattcagctgggctggcctggcctcggctaaactgggttcagctgggctgggctgagcaggcctgagcaggattagttgagctggtcgtaactggatttaactagctaggctaggcttaactgactaagctgatctggactgtattcatctggatgaagctggggtgaggtggctactttaggtccagctttgctgagctaaactggaccgggctaaattgatctggactgaccattctcacctggctaagaggagctgagtcagaagcaagctggttgagctggctggactgaaataagagtttgctgcctgcaaggggaggtcctgggctgacctgggccaggctgaaccaggctggcttagagtgaacttcagagggcgactcccccggtaggccagtctcagctgaacttggctgtcccggtgggcagagcggggctggatactgtgattttgggggtacctagagcagacttcaagaccaagctaaactgggctccaggggcaggatgggctggggacttgggactccaggccaggggcgaagggccacgctgtacagaccgcactatctgggccagggttctgtggtgggagggactgactgcctggggcatcagggcaagtcttcccgccctcccctagaggtcaggggtgggcagagcaccatgggggtctggcaggtcaggtgagggctgctgtgatggggagatccaggcttggcactcaagagcccgaggagctgagaccacagccttggggggttggggtcagggttggagggcaggcagaccatccaccatgagcccagagagagtttgaagggggagggctctggggtcccaggccccatggggtccctgggtttcagcctaggggcatggcccagtgtctctgctcctgagtgcccaccgtgcagcacttgcagggggaggctggggtcatcctggaggcaccccccttcctgagcccagcctgatgatagtggctgagcaacagcttctggtgggggaatgggggccctgggagccgccctgggcctggggattgtggggaaaaaggcccagaatgagcctggccatctggatccctgccacggggtccccagctcccccatccaggccccccaggcctgatgggcgctggcctgaggctggcactgactaggttctgtcctcacagcctccacacagagcccatccgtcttccccttgacccgctgctgcaaaaacattccctccaatgccacctccgtgactctgggctgcctggccacgggctacttcccggagccggtgatggtgacctgggacacaggctccctcaacgggacaactatgaccttaccagccaccaccctcacgctctctggtcactatgccaccatcagcttgctgaccgtctcgggtgcgtgggccaagcagatgttcacctgccgtgtggcacacactccatcgtccacagactgggtcgacaacaaaaccttcagcggtaagagagggccaagctcagagaccacagttcccaggagtgccaggctgagggctggcagagtgggcaggggttgagggggtgggtgggctcaaacgtgggaacacccagcatgcctggggacccgggccaggacgcgggggcaagaggagggcacacagagctcagagaggccaacaaccctcatgaccaccagctctcccccagtctgctccagggacttcaccccgcccaccgtgaagatcttacagtcgtcctgcgacggcggcgggcacttccccccgaccatccagctcctgtgcctcgtctctgggtacaccccagggactatcaacatcacctggctggaggacgggcaggtcatggacgtggacttgtccaccgcctctaccacgcaggagggtgagctggcctccacacaaagcgagctcaccctcagccagaagcactggctgtcagaccgcacctacacctgccaggtcacctatcaaggtcacacctttgaggacagcaccaagaagtgtgcaggtacgttcccacctgccctggtggccgccacggaggccagagaagaggggcgggtgggcctcacacagccctccggtgtaccacagattccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggtgagccatgggcaggccggggtcgtgggggaagggagggagcgagtgagcggggcccgggctgaccccacgtctggccacaggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcaagcccctcacagaccgtccagcgagcggtgtctgtaaatcccggtaaatgacgtactcctgcctccctccctcccagggctccatccagctgtgcagtggggaggactggccagaccttctgtccactgttgcaatgaccccaggaagctacccccaataaactgtgcctgctcagagccccaggtacacccattcttgggagcgggcagggctgtgggcaggtgcatcttggcacagaggaatgggccccccaggaggggcagtgggaggaggtgggcagggctgagtccccccaggagaggcggtgggaggaggtgggcagggctgaggtgccactcatccatctgccttcgtgtcagggttatttgtcaaacagcatatctgcagggactcatcacagctaccccgggccctctctgcccccactctgggtctaccccctccaaggagtccaaagacccaggggaggtcctcagggaaggggcaagggagcccccacagccctctctcttgggggcttggcttctacccccctggacaggagcccctgcacccccaggtatagatgggcacacaggcccctccaggtggaaaaacagccctaagtgaaacccccacacagacacacacgacccgacagccctcgcccaagtctgtgccactggcgttcgcctctctgccctgtcccgccttgccgagtcctggccccagcaccggggccggtggagccgagcccactcacaccccgcagcctccgccaccctgccctgtgggcacaccaggcccaggtcagcagccaggccccctctcctactgccccccaccgccccttggtccatcctgaatcggcccccaggggatcgccagcctcacacacccagtctcgcccactcacgcctcactcaaggcacagctgtgcacacactaggccccatagcaactccacagcaccctgtaccaccaccagggcgccatagacaccccacacgtggtcacacgtggcccacactccgcctctcacgctgcctccagcgaggctactgccaagcccttcctctgagccatacctgggccgctggatcccagagagaaatggagaggccctcacgtggtgtcctccagtccaaccctccctgtcaccctgtcagcagcagcaccccacagccaaacacaggatggatgcgtgggctccatcccccactcacccacaccggaaccccagagcaggctacgtgcccctcacagacctcaaacccacatgtgcatctgacaccccagatccaaacgctccccccggtcatgcacaccaagggcacagcacccaccaaatccacacggaaacacgggcaccgggcaccccatgagcacaaagcccctccatgtctgaagacagtccctgcacaccgtcacagccatacattcagcttcactctcacgtcccagcccacctgcacccagctctgggcctggagcagcagaaagaggtgtgagggcccgaggcgggacctgcacctgctgatgacccgggaccagcaggcagctcacggtgttggggaagggagtggagggcacccagggcaggagccagagggaccaggctggtgggcggggccgggccggggtagggccaggaggcagctctggacacccacaggcctgggctcatagtccacaccaggacagcccctcagagcacccatgcagtgagtcccaggtcttgggagccaggccgcagagctcacgcatccttccgagggccctgagtgaggcggccactgctgtgccgaggggttgggtccttctctggggagggcgtggggtctagagaggcggagtggaggtaaccagaggtcaggagagaagccgtaaggaacagagggaaaatggggccagagtcggggcgcagggacgagaggtcaggagtggtcggcctggctctgggccgttgactgactcgggacctgggtgcccaccctcagggctggctggcggctccgcgcagtcccagagggccccggatagggtgctctgccactccggacagcagcagggactgccgagagcagcaggaggctctgtcccccacccccgctgccactgtggagccgggagggctgactggccaggtcccccagagctggacgtgtgcgtggaggaggccgagggcgaggcgccgtggacgtggaccggcctctgcatcttcgccgcactcttcctgctcagcgtgagctacagcgccgccatcacgctcctcatggtgggcacccacctccaggggcccggccagggcagggggttgggcagagccagcagagcgccctgacccacgccctcccctcaggtgcagcggttcctctcagccacgcggcaggggaggccccagacctccctcgactacaccaacgtcctccagccccacgcctaggccgcgggccactcacgctccaccaggcccagctttttctctgccagcgcctgagcctccctcgggctgcgccctgccctgggtgggaaaagggaagcagacaagaaaagggggcacaaggtcactactgtgggctgatggccagtgaacctgagcccagaggggccggctcagccgcaaggttacaggcgccgagagaaccaccagtcgcagcccccacccgaaaaccgtgtctgtcccttcaacagagtcatcgaggaggggtggctgctagccgttctgagctcatcccaggcccctgggtctccgggtcactcccattctgactgtacaatcaccaaaagccaaggagggcccggcacccagcccaggacacagctgagtctgcgtccagcccaacaccagcccacggcctcactccccagcctcggtctgacccttctagccctgaggtccaagtgtctggcatccccgtcccccaagcctcacccagaccttctttcccttcacccacccctcctgccacccatccacagcccccatcccttcacccacccctcctgccatctatcctcagcccccatcccttcacccacccctcctgccatccatccacagcccccatcccttcacccacccctcctgccatctatcctcagcccccatcccttcacccacccctcctgccatccacctgagcccccatcccttcacccacccctcctgccatccacctgcagcccccatttctgcagcctgaaggcacagggaagccctctgaggccaggccacaggacagttgagggcttcgggcccctggagtgggtagaggggctcccacagccagagaaggggtttcctgcagggacagcagctgccgacctcgtccctatgacctcgtccagcctctggcttcagcagtcatacttctttctctctgggtttcttagtaaagatccttttcacaaaccccacgtctccggagggctctgtgggaggtgtgtgtggccctggagtggctggcgggaggcaggacccctgaggacgtgcaggaggagccagaggggaaggaagggcaggggccattctggggtcctgagagccaaagtgcccaagcagtggttcccatcaatcacccctcagcaccccagagactccccagctcggccctgtcatacctggtctgctggtctccagcccagactcatgcctccttctcaggtaaagtcaaagcaacaatcaacatcgacccctttgtgggcaaaaccagaagaggcccatgctgtggtcagcacaggaggccccaagaatgcagctgcacagtcaccaaggtggaggctgatgggggcccctaggaccactggccacacaccctgatccagcacccactgagcacagacaaagctgactccccagcccacagccgcccaccagcctggacctcctgaagagctgagaggtgacccaggagcaggctggggccccagagccatcggggccacaggtgggcttgacccacaccagtcctcagggcaaatgtgcagcctccctggctggagaggcctgcttacaagggtctccacaacatcctaaaaatgggagagaacgcatgataggcatgacaaagggcagggttccctcatatacaaagagcactcagagatcactaagaagaaaggtgagcaataggttcttcatggaaaggaaaaacccagtggccgataatataaagaaaccattttaacaatgagaaaagtgaaaggaaggaggaggggatgaagggggtggaggtgcttcttggccctgactgagggcacgtaaatcattaagaccactttttagggccagttggcaaaatgccccaatgcaggagagtcctctcacagtgatggccccacagggagagcctcgctctgtgccaggagagccacgtcacatggagtctggcacaaagcggaatgaagcaagcctgcctcagtctgacagcggcacctgggccctccgccctgtcctctgctgcgacctcggagcagccgggcacgggggagaaggtgaggagcgacggctccctacggggtagaaaaccccaaagcgggcagcgctgaggccgactgggtccaaacaacaccagaggagggggcgtcgcaggacagggccaaggccacagccgctgcccagctcccctcacacactccctcattcacagacacacacgcaggcacacactcgcacatgcaaaaacacacaggttcacacacacagactcaacctctcatacacatttgcactcacacacaccaatcatgcactcacacaggctgacacgctcgggcacgctcataccaacacacacacagtctcaggaagccaggccctccatccaccccatcaccagcccagggtgtcgcaaacccacatctcctacaacagaccggccctccgcagccaaggtgccccggaccgggagcccccccgggggacagagctcagtgactttctctgccccgcaccctagatcatgagacctccatggccccagagcaagggcaaggagtcagctcactgccccactgtgtggcaggcgtcctcacgcacagaaaattccatcgcctcaaaggcctgagaggaagaccagatgagcacccacgtagaggagacagacggggcccgtggggaggggcagaggcccggattcacacccaggctcggaacagcgcccctgccttccacatggcctggcctcccgggagcaagaggatgccgtctcagggcctctccatccccctcttcattcccctattaacccacccgtgggtacaaccatggcccccaaaagatagagccacatcctagcccctggggccattgagtgcggcattatttgtcaaaagggcctttgcagatcccatcaagataaggatttcgaggtgagggcaccctggattgtcaaggatttcgaggtgagggcaccctggattgtcaaggatttcgaggtgagggcgccctggattgtcaaggatttcgaggcgagggcgccctggattgtcaaggatttcgaggtgagggagccctggattgtcaaggatttcgaggtgaaggaaccctggattgtcaaggatttcgaggtgagggcaccctggattgtcaaggatttcgaggtgaaggaaccctggattgtcaaggatttcgaggtgagggcaccctggattgtcaaggatttcgaggtgaaggaaccctggattgtcaaggatttcgaggtgagggcgccctggattgtcaaggatttcgaggtgaaggaaccctggattgtcaaggatttctaggtgagggcaccctggattgtcaaggatttcgaggtgaaggaaccctggattgtcaaggatttcgaggtgagggcaccctggattgtcaaggatttcgaggtgagggcgccctggattgtcaaggatttcgaggtgagggagccctggattgtcaaggatttcgaggtgagggagccctggattgtcaaggattttgaggtgaaggaaccctggattgtcaaggatttcgaggtgagggcgccctggattgtcaaggatttcgaggtgagggaaccctggattgtcaaggatttcgaggtgagggcgccctggattgtcaaggatttcgaggtgagggcgccctggattgtcaaggatttcgaggtgaaggaaccctggattgtcaaggatttcgaggtcagggcaccctggattgtcaaggatttcgaggtgaaggaatcctggattgtcaaggatttcgaggtgagggcgccctggattgtcaaggatttcgaggtgagggaaccctggattgtcaaggatttcgaggtgagggcgccctggattgtcaaggatttcgaggtgagggcgccctggattgtcaaggatttcgaggtgagggcgccctggattgtcaaggatttcgaggtgaaggaaccctggattgtcaaggatttcgaggtgaaggaaccctggattgtcaaggatttcgaggtgaaggaaccctggattgtcaaggatttcgaggtgagggcaccctggattgtcaaggatttcgaggtgagggcgccctggattgtcaaggatttcgaggtgagggaaccctggattgtcaaggatttcgaggtgagggcaccctggattgtcaaggatttcgaggtgagggcaccctggattgtcaaggatttcgaggtgagggcgccctggattgtcaaggatttcgaggtgagggcgccctggattgtcaaggatttcgaggtgagggcgccctggattgtcaaggatttcgaggtgaaggacaccctggattatcgagggggctaggtccgaggacaagtgtcctagctggagacagacgaggagacacagggatggggagaggcagaggcagacaggggtggtgctatggtctgagggtctgtgtctgcccgaaactcctgtgtgacagccgtcatcccagagtgagagcatgcagagctggggcctcagggaggtggttagggcctgagggggaacactcaaaaatgtgactcggtccctgatctcactagagacccaaaagaaaagggaccccagagagcagccctgccctctttccaccatgtgaggacgcagcgaaaagatgggggtctgtgaaccaggaatcggcccttcctggaacttgaccctgctgccatcctgaccttgaacttccagcttccctgagaaatgaatgttgctgctgaacccaccagtctatggtatttttgttattgcagccagaaatgactaagacgcagcagccacgtccccctggcgagggccgggggcatcccaaggttcataacaaaagctccagagcttccctgaaccgccaggtgtgtcttcccaggaccctggggcagccccaggctacctccctcctcctctggccccacctgccctgatccggcctcactgtcactccctggatttcacccgacagcctccgccggggtggcccggccccatggccagggcatcttccattcacgcccacgctttccaggactccgctgcagcagctcctctgtgaagcgcccctggcctcccattgccggtgccacccgagcccccagacatagctggcctcccccgactccagggccagcatcgctggcgggatctctccaacgcaacggccagctctctggtgacccacagtaggagtgccacctgggcagtgctggacagggtagagcaggcaccttggccgccctgacccgcagggctgcaggctaggagacggggtgcccccatgcccccaccctgggctgcagtctggggcccccagtggcccatggggcaggccgagggaggccaggcccgagtggctccaacccagcagcgcaagactcactctccccagcctgatgcccgccctgtggccccaaggccccttcaacgggagtccactcacaggcgcccttcccctgcgggtggtcggggaccctctctggccctgtgtctcccctttgccatctctgtctcggggtctctgagcctctaactgtgtctgttcctgtttccctgcagcgtggcccccaccccgccctgtggagccatgtggagccgtgaggctccacggccggtggggtcacagagccctggccacacacacctggccccaccacagccagaccacaggccagacatgacgtggagccgcgcagccgtgtctgctggggcaggaagtgggcgagtgaccccgtctgtaggccagacgtacgggcatgcaggccctcccctccagcccctcagcatccagccacatctgtggacacagccagcgcggcggagcagggctctgctaaggacagacggccatcaaggcaggacctgggccgggccagggctccctccccacagcagccctcttggcaggcagccagacgcccgtgagggtggacctgccatgagggcctgcacgccggaggccgcccactcagcactgcgggccctccagcagcctgaccaggtgggtcttggaggtctccaggcctccgtctccttctctgcacattgaggagtccagccaggctggtcctggccccttctggaagcaaaaggtggagaacaggcaccaagacaagagggaaggacaaaagaggtcaccacagggactccggaaccacagggcagggcttcctaaccaggcaggaaggatctgggcactgggggctgagccaggctggccaggcctaagctgggatgacccggcccttcctgggatacaaggtgaacagctttcatggctgagctgaggcctaagttgagccgaggcctaggctgagccgagccagagggcagaggagaagatgacctggagccaactgatacacgtccatgtgggctgccctgagctgccctggcctgggctgggctgagctaggctacactgggctgagctaggctacactggactgggctgagctgaactgagctgagctgggctgagctgggctgggctaggctgggctgagctgggctgggctgagctgagctggagctggggctgaggtggactgggctgggctgggctgggctgagctgggctgagctgagctggactgagctgggctgggctgggctaggctgggctgggctgggctgggctgggctgggctgggctaggctgggctgggctggactgggctgggctagattgggctgggctggactgggctaggctgagctgggctgagctgagctggactgagctgggctgggctgggctgggctgggctgggctgggctgggctagattgggctgggctggactgggctaggctgagctgggctgagctgagctggactgagctgggctgggctgggctgagctgggctgggctgggctgggctgggctgggctaggctgggctgggctgggctgggctgggctgggctaggctgggctgggctgggctgagctgggctgagctgagctggactgagctgggctgggctgggctaggctgggctgggctgggctgggctgggctagattgggctgggctggactgggctaggctgagctgggctgagctgagctggactgagctgggctgggctgggctgggctgggctgggctgggctgggctaggctgggctgggctgagctgggctgggctgggctgggctgagctgggctgagctgagctggactgagccgggctgggctgggctaggctgggctgggctgggctgggctgggctgggctgggctgggctaggctgggctgggctgggctagattgggctgggctggactgggctaggctgagctgggctgagctgagctggactgagctgggctgggctgggctgggctggcctgggctggcctgggctgggctggcctgggctgggctgagctggactgggctagactgggctagactgggctgggctggactgtgctgggctggactgtgctgggctggactgggctgggctgggctgggctgggctgagctgggctgggctagattgggctgggctggactgggctgggctgggctgagctcggctgggccgggctgagctgggctgagctagactgggctgagctggactgggctgggctgggctgagctcggctgggccgggctgagctgggctgagctagactgggctgagctgggctgagctgggctgagctgggctgtgctgagctgggctgagctgagctgggctgagctggactaggctggggtgagctaggctgggctaggctgggctgggctgagctgggctgggctgagctgggctaaactggactgggctaggctgagctgagctgagctgagctgagctggactgggccgggctgggctgagctgagctgggctaggctgggctgggctgggctgacctgatctgagctggactgggctgaactgggtgagcttaggtggactgagctggtctgggctgagctgagctgggctgagctgggctgggctgagctgagctgggctgagctgggctgggctgagctggactgagctatgctgagctgagctgggttgcgttgacctgggctgagctgggctgggctgggttggactgggctgggctgagctgagctgagctgggctgggctgagctgagctgggctgggttggactgggctgggctgggttggactgggctgggctgagctgagctgtactgagctggactgacctgggctaagctgagctgggctgacctgtactgggctgggctagactgggctgagctggactgagctgagctagactgggctgagctgggtgagcttaggtggactgagctgggctgggctgggctgagctgagctgagctgggctgggctgggctgggatgagctgtactgagctgccctggggtgggctgggctgagctgggctgagctgggctgggctggactgagctggactgagctggactggcctgggctgggctgggctggatgagctgaggtggctgctaatgtgggaaggaggccgtgggttgagtgtgactccacctgcagagccctgagcccagctgtgttcttaggggttctgagggccacgcagctctgttgcaccatgattctgtcttctctcttgcccactgcctgaaggaaatttggagtgggctgggcccagagctcccctgggtaacaggccctgtcctggagggcctggcagggacatggcttagcctgttggcctctagtcccgagacctcataggccacaggggtccactgtggcttgtttgggcctggggtggggctcatggagtggtgggtgttggactgagactctgaccagggacagggggatggggtcacagccaagccactccacccctaccccatgcacacagcactcagagcccaggccccctcctcagagcccccaccaaaatcctctctaggggcaggggaaagagcaagacatgtcccccacccagagcaggaactggggtcagggagctcaggggactcagccactccatggcagagccctgtttaatataacttgtgtctgggatggcctgggtcagaggccctatctaaggagcatgttcagaaactgtgtcgctgggatgagacagctgggtccaaccgcaggcccatggtgcaggagctgtgtaaccttggggctgtcaccaggcctctctgtgctgggttcctccagtgtagaggagaggcaggtacagcctgtcctcctggggacatggcatgagggccgcgtcctcacagcgcattctgtgttccagcatccccgaccagccccaaggtcttcccgctgagcctcgacagcaccccccaagatgggaacgtggtcgtcgcatgcctggtccagggcttcttcccccaggagccactcagtgtgacctggagcgaaagcggacagaacgtgaccgccagaaacttcccacctagccaggatgcctccggggacctgtacaccacgagcagccagctgaccctgccggccacacagtgcccagacggcaagtccgtgacatgccacgtgaagcactacacgaattccagccaggatgtgactgtgccctgccgaggtcagagggcaggctggggagtggggcggggccaccccgtcctgccctgacactgcgcctgcacccgtgttccccacagggagccgccccttcactcacaccagagtggaccgcgggccgagccccaggaggtggtggtggacaggccaggaggggcgaggcgggggcacggggaagggcgttctgaccagctcaggccatctctccactccagttcccccacctcccccatgctgccacccccgactgtcgctgcaccgaccggccctcgaggacctgctcttaggttcagaagcgaacctcacgtgcacactgaccggcctgagagatgcctctggtgccaccttcacctggacgccctcaagtgggaagagcgctgttcaaggaccacctgagcgtgacctctgtggctgctacagcgtgtccagtgtcctgcctggctgtgcccagccatggaaccatggggagaccttcacctgcactgctgcccaccccgagttgaagaccccactaaccgccaacatcacaaaatccggtgggtccagaccctgctcggggccctgctcagtgctctggtttgcaaagcatattcccggcctgcctcctccctcccaatcctgggctccagtgctcatgccaagtacagagggaaactgaggcaggctgaggggccaggacacagcccagggtgcccaccagagcagaggggctctctcatcccctgcccagccccctgacctggctctctaccctccaggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccacctacgctgtaaccagcatactgcgcgtggcagctgaggactggaagaagggggagaccttctcctgcatggtgggccacgaggccctgccgctggccttcacacagaagaccatcgaccgcatggcgggtaaacccacccacatcaatgtgtctgttgtcatggcggaggcggatggcacctgctactgagccgcccgcctgtccccacccctgaataaactccatgctcccccaagcagccccacgcttccatccggcgcctgtctgtccatcctcagggtctcagcacttgggaaagggccagggcatggacagggaagaataccccctgccctgagcctcggggggcccctggcacccccatgagactttccaccctggtgtgagtgtgagttgtgagtgtgagagtgtgtggtgcaggaggcctcgctggtgtgagatcttaggtctgccaaggcaggcacagcccaggatgggttctgagagacgcacatgccccggacagttctgagtgagcagtggcatggccgtttgtccctgagagagccgcctctggctgtagctgggagggaatagggagggtaaaaggagcaggctagccaagaaaggcgcaggtagtggcaggagtggcgagggagtgaggggctggactccagggccccactgggaggacaagctccaggagggccccaccaccctagtgggtgggcctcaggacgtcccactgacgcatgcaggaaggggcacctccccttaaccacactgctctgtacggggcacgtgggcacacatgcacactcacactcacatatacgcctgagccctgcaggagtggaacgttcacagcccagacccagttccagaaaagccaggggagtcccctcccaagcccccaagctcagcctgctcccccaggcccctctggcttccctgtgtttccactgtgcacagctcagggaccaactccacagacccctcccaggcagcccctgctccctgcctggccaagtctcccatcccttcctaagcccaactaggacccaaagcatagacagggaggggccgcgtggggtggcatcagaagcaggccagtgagacagggcctgcccagggccctctgcatgcctctggcttctgcctggggctcccaggagtgaaagaacagtcccacaaccactgtggggacacctggcacccagactcccacaagggggcagtgaggcccctgctcgtgccttagacatcttccgggcctccccaggggcccccgccttctggctgcctccctctgctctcagggccaaggtgaggtggaggccactgtcacccctgagggtccagtcaccagagggtaattgagagcaacaggtcacttggggaagccctgccacagagaagccctccagcccatgggacccaggacctggcctggggaggggcttttaaagagagggggaaagagagagaatcaacagatgaggggctgaaccagcagacagagatcaggcagacacatgggtagatcctaggacatataatgaatggatgggtggatggagggtgggtagatgaaggatggatgggtggtaaaatggatgggtgggtaaatggctggatggaggatggacggatggatatgtgatggatggatggatgaaggatgggtggatggaggatggatgagtggatgaaggatggaagatggatggactgatggatggatgatggatggatggatgatggatgggtgggtaggcggatggaggatggaagggtggatggaggatggaagatagatggaggggtgaatggaggatgggtggatggagggaggattgaggatagatgggtgggtgggtgggtagatctatggaggctaggtgtatggaagataattggatggagaattgctttatgaatggatgaatgaagagatggaaaatagctttatagatggatggatggatggatggatggatagatggaagaaggatgaatggatggaaaatagctttatagatatatgggtggatatttaagtgatagccttacattaatagatgaatggacgatgaatggatgggtgagtgggtaggagtgttactgatggaggggtggatatacggataatagctttatagatggatggatggatagatggacggaaggatagaaagacaggtgaatgactggatgtatcagcatatgacaagcaggtacagctgtacatgggaggtctatgccctgagaccctgaggaaaatgaggatgcccgtgctggtggccctcacctggccctcgcttgtaacccctcagccacattccctgggaaggcaacagaggcctctggtcttgcccattcaacctttggcacactgagtgtcagacccaggtctctgtcttggacccagatctccttgagggtgggtgtgtctggtcctctctggccccgggacccagtcactgaatacgtggctgggactgagacggggtggggtgggaggggcgggagggtacctcgggctcaagcttcccttggagaagcagatggtgtccactttctgccctgccaagtctctccctgaagtgccctaagaatgtcaaagacagaaggtcccagcccctcacctgggaccctgcctcctcatcctccctgggggagtctcaggccttagatggggacccagaccccactgtccccagaccccaaggaagcatagccgctgttcacacgagtctgggagtctgggcctggcaggctcttgctgtgttgcagattggcagatgccgcctccctatgtggtgctggacttgccgcaggagaccctggaggaggagacccccggcgccaacctgtggcccaccaccatcaccttcctcaccctcttcctgctgagcctgttctatagcacagcactgaccgtgaccagcgtccggggcccatctggcaagagggagggcccccagtactgagcgggagccggcaaggcacaggtgggagcccaggagggggatgagcccacagtagatggggtgggctgcagtgattggctaagaggagagcaccacctgctcccactgtggggggacgtgctctcctgggggcccttcacagacactgaggacacgcgcaggcccagggtcagggctgagcttccctccagtgcagtaacgaggattccgtccaggctcccatgagccaggccagggctgagacagagggcgttggcaaggatgctgctccttcaggctgtgacccctctgtctttgcagggaggaagtgtggaggaacctcttggagaagccagctatgcttgccagaactcagccctttcagacatcaccgacccgcccttactcacgtggcttccaggtgcaataaagtggccccaaggaaaatgttcacagactctgaatgaggagacgggggtcagggaaagggtggtggctttagactggagaacgcctgcttcaaagtccccctgggtgtcatggtggtcatggtgggcatggacagagggtacccctggtcccaaaatcaagaaatgacctgatcttgaatgaggctgaggcccaaggatgaatgctggattcaccagagaccatggcaaagaagcctgctcctaagaactacatgggatccctattcctcataacctagacagccctggtcctcctcactgggtcctcatcctgatcacagggccctggtcctgaccagtgggcccgtttaccgatcactgagctctggtcctactacttggtccctgttcctgatcacttaattctagccttgatcactgagccttagtcctgatcactgagtcctactcctgttttttgccctggacctcgtcactcagccctggtccttgtcactcagccctggacctcatcactcagccctggtcctggtcactcagccctggtcctcgtcactcagccctggacctcgtcactcagccctggtcctcgtcactcagccctggacctcgtcactcagccctggacctcatcactcagccctggacctcctcactcagccctggtcctcatcactcagccctggacctgatcactcagccctggtcctggtcactcagccctgttcctgatcactgagccctggtcctgatcactgaatgctggtcctgatcactgagccctgttcctgatcactaacccctgttcctgatcactgagccctggtcctgatcactgagccctggtcctgattactgagccctggacccagtcactggcccctgttcctgatcactgggccctggtcctgatcactgagccctgttcctgatcactgagccctggacccaatcgctgggccctggtcctgatcactgggccctggtcctgattactgagccctggtcctgatcgctgggccctgttcctgaccgctgagccctggaccagatcatggatccctgttcctgatcactgatccccggttcttttcttatacatattcattttgaaatctgattccttttctgagcatgtatcagtctgactagacactgagtcctgtctgatttctgagccttggccctcatgagtaagtgacctgcagtggtggagggaggcctccaggggagccgagaccctctcagtgcatgtactcactggtagatgaagaaatgaccccaatgacttgctccatttttccaggctcagaggggtgtgtaggccccaggaggacttggtggggagaggaccagcccaggccctgtgagctacacccagccccagcccctaaggggtcgccaggtctcgacttagcactggggagggggtacagtacaggagtggggacaggaaggtcgggggaggccatgctgtttgtattctcttgcttttctctctctcctgaagcctcttgtaccccatcacctgcagaaatatccaaaatagccctgtggggcggctgagtcattgtgaacacagcccaggccaggtgttccagccagagaactgctgttctgagaaacatgccccaaaaccgagacctggccaggtgtgcctggggcctgagcgaggggctgcagccacagggaggcccagccccaaccagcccggggtcagctagggctttccaggtccagggttaggcagaggtcagccagggtcagccaggatcagccagggtcagccagggtcatctggggtcagccagggccagccagggtcagccagggtcatctgggttccgccagggtcagccagggccatctggggtcatctggggtcagccagggttccgccagggtcagcacaggccattgtccccctgtccgggctctctaggcggcaggcctcctccatgggcagccctcacgagggctgtgcccaccacacagcagacccagggaagcaccagcactgagcatctggcagtgactgtggtgggcctcacaccctgcacgcacctccctcagctctccccagggcccttggccagagccaggacgcagtgcccagccctggggcttgagcggctgccctggcaggctgtgcccagcacaagcacggcccacaggaccacagaaggacctgcaccccacaccagggaaacaggggttctgggaaggggacattggaccaggggcccagagagacacagagacatagagagagacagggacagggagagacaagagacacagagacatagacagagacaaggatggggagagataagagacacagagacatagagacagggatggggagagagataagagatgaagagacatagagagagacagggatggggagagataagagacacagagacatagagagagagagacagggatggggagagacaagagacatagacagagaaagacaaggacaaggagagataagagacatagagacatagagagacagggatggggagagagataagagatgaagagacatagagagagacagggatggggagagataagagacacagagagagagagacagggatggggagagacacagagacatagacagagaaagacaaggacaaggagagataagagacacagagacatagagagacagggatggggagagataagagacacagagacatagagagagacagggatggagagagacacagagacgtagacagagaaagacaaggacaaggagagataagagacacagagacatagagagacagggatggggagagataagagacacagagacatagagagagacagggatggggagagacaagagacatagagacagggacaaagacagacacagagagagagatggggatggagagagataagagacagggacggggagggacagagacacaagagacagaaagagagagatgagatgagatagataagaaacagagacagagatgggagaaaaagggaggagatgggaacagggaaaaagagacatggagacagacatgcagagagaacacaacagaggcagagaacacacagggagagaaagaggcagcaagatgggcccaggaactcaggtgcaagcccctctcacacagtcatactcacaaacacacaccacgactattatacaacattcacacacaaacacacagaaacatacccatgctcacagccacacactaagtcactgtcacatccatacccacactcacacccaaacacacatggcccaggagcaaatggggagacctcagcctgcagctgggagcggctgagcgggtgctgggccagagtcggggcctgtctgtgggtggggggcacggcagcacgggcccacctgcacctacaaggcctggcccccgaggtcactgggccaccacccagccctcgccctgttccccgtctgtgctggacggggcaggcctctgagcctccaggaaacctgcagatccacacaggacctggaacatcgggctggggtgggtaacaacatgggagaggcgggagcaggaggtcccaggaccctgcgcactgcgaccccagccctgggggctgaagcccaggacagcctcaggtctcccaggagggactggacagtgggggatggtcagagaacaggacagccagcagggtgcagcccgaggacagggatggacgctgggaggtcaacaggacaggggcaggagctgtggagtgggcaaaggtcctggagggcctggagaacctgtgggtccgtgtttgtgggaaggaggccaggagcagcccagagtggccaggctggcaggggtgaggaggtgggggcagtgaggtgagggtgaccgagacagtgaggcctctggccagggaggggaccttggctgggctctgactgaacccagggctcctggagaaggggccccaggcggggatgaggatgtgggcatctgactccatcaacaatggggcttccaacacgcacagcctgggcctcggagacctgggccctgacccgcctccccctggcactgggccgggtgccgtgtgtggtccccagtccccgcagcacctcccccacactggtcacgttccagggcccctctgaagcacctgctgtgaggggatgtggggaggggacagggacttgggcctgagctgccgggtcgggggggagtcggggacccaggctcagcgtgtggctgcggaccagacagatggggatggaggaggacacgccctgtacccactgcctgccaaggggctggacccacgcccagtctaggccatgtcccccgaggcctgtgaaccttcactctgagccactaaaacattcaggagctttgaaagcagcccccgtccttgtcactatgcgatgactctgagcatcacgctgtccctgctggatccaccctccagccccagcgagggaggctgggccccgggcagcaggtggtgagggcagcgggcacagccacgctacagcacacacagggtctcagggacgcgtccaccacagcccgtgcacaggctcctcacggcactgagttcacccggggcgcgggccgtttgtcctcaggagtccggctgtgccctccgcccccagccctgtcctgctgaggctgcagctgggtcccggggcacagggcggccctgagcaccttgtcatgttggtccctgtcgggtgggctgctggctgtctgtggagctggcagagccgcggttcagccttggaggccggtcctggggcccagcagccgtggggagcactgcccagtcccgtgcccacagggaatcacctgggctgaggaagggcccacacgccgacgggatcggggtcaggcagcgcacgcctggcaccgagatcccacgtcccgaagtggggacacggcccaggggcactgttccgggagggtctcaagatggggtctcctatttcaatcttcactccttctgcacctgttagctgggaaccttctagaaggaggggtgtcctcaatcatggggtggttgtgagctgagcacagatcatgcaggaaggtacatggcttctccttcaccaggaaaacagtgcagagagacagagacacagagacagagacagagtaacagagaaagacagacgagagagagacacagagacacagacagagtaacagagaaagagagacagagagagacagagacagagacagagtaacagatagagtcacagagagacagagagagagacagagtaacagagaaagacagagacagagacagagacagagtcacagagagacagagacagagagagaaacagagacacagaaagagacatgcagacacagagacagagatgaggagttacagagagacagagagatagagacagagatagagagacagagacagagagaaagaaacagatacagaaagagacattgacagagacagagagaaaaacaaagacacagagacagacacacacagagacagaaaaagacagagataaagttacagagagacagagatacacagagacagagagacagataaagagagacagagatacagacagagacagagaaaaacagagatagaaacagagagacagagataaagttacagagagagagagcaagacagagataaagagagacagagacagagtgagagaaacagaagcagtaagagataaagagagttacagagacagagatagagagagatcaagaaagagagacagagatagaaagatacacacagagagatagagatacagagagacagagatagagagacatatagagagacagagatagaaagatacacacagagagacagagatacaaagagacagatagagagtcactgtcacattcatacccacgctcacacactcacactgagcttccctcaagccctgtcacttcctatggggcccacggcatgtccaagcctctgggccaccagcctcatggctcactgctgtgtgcccaccacaccccgcctcagaggtcccctctgtgagctgggcacgtgccctacactctgctcatgggtggtctggggaaacagggcccacccaaggcctggctcaggaaaggccccaaacacacatggcccagcagcaaacgggcagagctcagcctgcagctgggagcggcggagcgggtgctgggccagagccggggcctgtctgtgggtggggggcacggcagcacgggcccacctgcaccccccaggcctggcccccaaggtcactgggccaccacccagccctcgccctgttccctgtctgtgctgaccggggcagggctctgagcctcggggaaacccacagacccacatgggatggagagacagagatagagagagacagggagagacagagagagatagagagacagagatagagacagagatacagagacacagagaaagacagagagagatagagacagagagatacagagagacagagaaagagatagagagacagagatagagacagaaagacagagatagagatagagatgaaagacagagatacagagagacagagaaagacagagagatagacatgagagagacagagatagagatacagagagacagaaagagagatagagacagagcgatagagataagagaaagacagagacaaagagatacagagagtgagagagacagagagagagataagaagagagactgagatagagacagagagacagagaaagacagagttagaaaggcagagaaagacagacaaagagagatagagagaggagaagagaaacagagacagacagcaacagaaagacagagaggtatatacagagaggaagagacagagacagagacagactcagaaagacaaaaagagacagagaaagaaacagggagagagaaagacagatataaggagagatagagagaggcagagctacagagaggaagagacacagacaaacagagagacatacaaaaacagagacaccaaatgacacagacaggcagagacagacagagatgaagagacagagagacagagacagaggcagagagacagagagacacacacaggaagagacagatgagagagacagatatagacagagatacagaaagagacagagagagacatacacagggacacgaacagacagacagagatacagaggcagagagacagagatatagacagagacatggaaagacagagaagagagagacacacacacagggacacaaagaggctgagatatagacagagatacagaaagagaagcagagagacagagagagacacacacagggacacgaagagacagacagagagacagaggcaaagaaagggacacagcaaagggacaggcacagagggagggatagacgggaagagagacggagggatagagacagacacgggggagagatggatggagaaaggaggcacagacggagacacacagaaagagagagaggccaagacaggcaagatggcgggacaaagcccagcagacgggcttgacagagatgagtcagagacaccgacaatgggacagagacagagattcgggcagggagataccttcagagaggcagagagacagggagacagaagggtggccagagacagggacagcgggaaagatggagctggaggctcagatggagacgggtgtgacagagctgggagcagggaggccacagcccacgcagtccgggtgctgcacccaccacggcccccaggcccggagacccagcccccatcaccatgtaacctcaggccatgtccctggccctgctgagcctcagtgttctctctgtacagtggggaccaccaggccatgagggtgggggaggtgcgggcctgcaccagacaggccttgtaccaatcgggctgcctgtgcccaggccaccagggccacctccgctcagcctccttggggcttctggggtgggggttggctgggggccctgccagcgttggctcccctgcccttcctgccaacctgggggctgcccctgggtcctggtcccaaagatggcaacaagttcagaaccactgaattcaataaagttgacgtttgcagggtggtcccagtgtcagtaacccaagtgggcctgtcctgggggagggggcgggtgtccccgaatctggaggcctgagccagcctggccacgctgtggtgggggggtgtccccgaatctggaggcctgagccagcctggccacgctgttgggggggggggtgtccctgaatctggaggcctgagccagcctggccacgctgggggagggggcggggggtgtccccgaatctggaggcctgggccagcctggccacactgggtgggtggcggctgcagctgcaggtggagaatcgtgcaagctatttctggaaacagcctcagagggcaagaaacatgttttcggtgtggaacaaacaaccatttgcatgtgccctgagggccaagtctgcccagaatgagtcactcaaggagaaacagatcagagccctcacacctgcctgggggaggggtgggcgccgctccagggacctgctgttgggcccagagatgccgaaaactcagcccacccggccgccatggcaggacccactttcctcaccagcttgcccctaggtgggacccacaggacccctgggaagccctcagcagcccttgggcaggtcccaccctgcagagaacgcgaaggctcaaaggcccactcgggctgagaccgcagggagccctgggccgcttggatgcagagccctgaggcccgaggctaggctgtgggagggagcagcagtgagacccccactggccctcagggctcacaggtgccccggtgagggtgcagggagcgggggtgcctgccaagcaggaaggcggagggcccaggctgccgtggcaccatcggggcacactatgtgtcactggcccaaggagactcgcccatgaggagctgctgctggtggacgcaggggtgccctccagcctccttggggggctaggaagggagggcagggccaggcagaccctagggtgaggtaggaggactggcaaaaggccaggatggccaagggagagccacatgggggctgggagggcgcaaggttcgggcccggccaaagcgtgggtgccaggtatggtgcccaccaggaccgcgcggcgtgtactccagaaagaccctggggcgcaggacgggcttgccatgctgaggtctggaaagtaaagagaggcacttcacggcagcacgccagcctgcatgatctgtgctcacactcacccactacgagcaatgccctccttctagaagcttcctcactaacacgtgcacaaggaatgaagggaatggggtctcccgtctcacagccctccatgtaatggtgccctcaaccgaccgactgctcccgaccggccgcagcccttggccccgcggcccacctctgcctgaccccggccctgctctcctcctggcagctcagggattcgccactgcctgggctcagccggagcaaagcccgtgtcccccggcaccccacacagccgagtcacccctccctcacggcccccacctcctcggccctgccggcccagccacgctgagctgctcctgggcccccttcccagagacatcgaagccctgcaggttctccaggccctccgcccactccactacccctgcccgctcccagctgcaggctgagctctgcccctttgctcctgggccatgtgtgtttgaggccttccctgagccaggccttgggtgggccctgtttcccccaggccagccatgaacagagcggagggcatgtgcccagctcatagaggagacccccaaggcggggtgtggtgggcacacaccggtgagccaggggctggtggcccagaggcttagacaggccgtaggccccatcggaagtgacagggcctgagggaagctcagtgtgtgtgtgtgagtgtgtgtgagtgagtgtgtgtgtgactgtgtgtgtgaggtgagtgtgagtgtgagtgtgtgtgaggtgtgtgtgtgtgagcaggtgagcgtgggtatgaatgtgacagtgactatctctgtctctgtctctctctgtttctgtgtatctttcttatctctgtgcctgtctctgtctctgtctttctctgttactctgtctctgtgtctctctctgtctctctatctctgttactctgtctctgtctctgtgtctctctatctctgttactctgtctctgtctctgtctctctctctctgcctctctgtctttctctgttactctgtctctgtctctctctgtctctctgcctttctctgttactctgtctctgtctgtgtctctctgtctctctgtctttctctgttactctgtctctgtctctgtgtctctgtctctctgtctttctctgttactctgtctctgtctctgtgtctctgtctctctgtctttctctgttactctgtctctgtgtctctgtctctctgcactgttttcctggtgaaggagaagccatgtaccttcctgcatgatctgtgctcagctcacaaccaccccatgattgaggacacccctccttctagaaggttcccagctaacaggtgcagaaggagtgaagattgaaataggagaccccatcttgagaccctcccggaacagtgcccctgggccgtgtccccacttcgggacgtgggatctcggtgccaggcgtgcgctgcctgaccccgatcccgtcggcgtgtgggcccttcctcagcccaggtgattccctgtgggcacgggactgggcagtgctccccacggctgctgggccccaggaccggcctccaaggctgaaccgcggctctgccagctccacagagagccagcagcccacccgacagggaccaacatgacaaggtgctcagggccgccctgtgccccgggacccagctgcagcctcagcaggacagggctgggggcggagggtacagcgggactcctgaggacaaacggcccgcgccccgggtgaactcagtgccgtggggagcctgtgcacgggctgtggtggacgcgtccctgagaccctgtgtgtgctgtagcgtggctgtgcccgctgccctcaccacctgctgcccggggcccagcctccctcgctggggctggagggtggatccagcagggacagcgtgatgctcagagtcatcgcatagtgacaaggacgggggctgctttcaaagctcctgaatgttttagtggctcagagtgaaggttcacaggcctcgggggacatggcctagactgggcatgggtccagccccttggcaggcagtgggtacagggcgtgtcctcctccatccccatctgtctggtccgcagccacacgctgagcctgggtccccgactcccccccgacccggcagctcaggcccaagtccctgtcccctcctcacatcccctcacagcaggtgcttcagaggggccctggaacgtgaccagtgtgggggaggtgctgcggggactggggaccacacacggcacccggcccagtgccagggggaggcgggtcagggcccaggtctccgaggcccaggctgtgcgtgttggaagccccattgttgatggagtcagatgcccacatcctcatccccgcctggggccccttctccaggagccctgggttcagtcagagcccagccaaggtcccctccctggccagaggcctgtctcggtcaccctcacctcactgcccccacctcctcatccctgccagcctggccactcagggctgctcctggcctccttcccacagacactgacccacaggttctccaggccctccaggaccttctcacactccacagcccctgcccctgcccctgtcctgttgacctcccagcatccatccctgtcctcgggctgcaccctgctggctgtcctgttctctgaccatcccccactatccagtccctcctgggagacctgaggctgtcctgggcttcagcccccagggctggggtcgcagtgcgcagggtcccaggacctcctgctcctccctctgggatgttgttacccaccccagcctccccagcccgatgttcggggtcccgtgtgtatctgtgggtttccccgaggctcagagtcctgccccggccagcacagacggggaacagggcgagggctgggtggtggcccagtgacctcgggggccaggccttgtaggtgcaggtgggcccgtgctgccgtgcccctcacccacagacaggccccgactctggcccagcacccgctcggccgctcccagctgcaggctgagctctgcccatttgctcctgggccatgtgtgtttggagcctttcctgagccaggccttgggtgggccctgtttccccaggccaccgatgagcagagcactgtcggcttacagaggggacccccgaggggggtttggtgggcacacaccagtgagccctggagctggtggggggtgagtgtgtgagcgtgtgagcatgggtacaaatgtgacagtgacttagcgtcggggtttgagtgtgggtgggggtgtaagtgtgggtgagggtgtgagtgtggaagtgtgttagtgagtatatgaatgtgagggtgagtgtgagtgaggatgtgtgtataggcgtgtgggttgtgtgtataggaagtgtgtgtgttgtgtgtgtataggaggtatatgtgttgtgagtgtatgataggtgtatgtgttgtgtgtgtataggtgtatgagttgtgtgtgtggtgtataggttgtgtatgagtgggtggtgtgtgggttgtatgtatgtttcatgtatgtgttgtgtgtgtgtggtgtatgggttgtatgtgaatgtgtggtgtatgggttgtgtgtgtgcataggtgtatgtgttgtgtgtgtttgtggtatatgagttgtgtgtgtgagtgtgtgtataggtgtataggttgtgtgtgtgtggtgtatgggttctgtgtgggggtggtgtatgggtgtgtgtatgagtattatgtgtgtgtgtggtgtgtatgtgttgtgtgtgtggtgtatgggttgtatgtgtgtataggttgtgtgtgtttgtggtatatgggttgtgtgtgtgtgtgtataggtgtatgggttatgtgtgaatgtgtggtgtatgggttgtatgtgtaggtgtatggcttattagtgtgtatatatgtgtacgggttgtgtgtgtgtggttatggcttgtgtatgtggtctgtgcgttgtgtatgagtgtgtggtgtatgagttgtgtgtgtgtataggtgtatgtgttgagcgtgagtttgtggtatatggttgtgtgtgtatataggtgtatgggttgtgagtgtgtggtgtatgggttgtgtaggggtgtatggcttgtttatgagtgtgtgtataggtgtatgggtttgtgtgtggttatggcttgtgtgtgtttatggtctgtgggttgtgtgagtgtgtgctgtatgagttgcatgtgtgtgtataggtgtatgcgttgtgtgtgagtttgtggtatatggattgtgtgtgagtttgtgtatagatgtatgggctgtgtgtgtgtggtgtatgaattgagtgtgtgtataggtgtatgtgttgtgtgtgtagtgtatgggttgtgtgtgtgaatgtgtataggtatatgggctgtgtgtgtggttatgacttgtgtttgtgttctatgggttgtgtgtgtggtgtatgtgttgtgtgtgagtgtgtggtgtatgggttgtatgtgtggcatatgggtatgtgtatagatgtatggtttgtgtgtgagtgtgtggtatatgggttgtgtgtgagtgtgtggtatatgggtgtgtgtgtataactgtatgggttgtgtgtgtggtatacagattgtgagtgtgtgtggtgtataggttgtgtaagtgtgtatgggttgtgggattgtgtataggtgtatgggttgtgtgtgagtgtgtagcatatagtttgtgggtgtatgtggtgcatgggttgtgtgagtgtgtggtgtatgggcgtgtgtgtataggtatgtgggttgtgtgtgtggtatatgggttgtgtgtgtgctatatgagtgtatgagtgtgtgtaggtgtataggctgtgtgtgtatgggtggtgggtgtgtgtaggtgtaggagttgtgtgtgtgtggtgtatgtgtgtgtgtaggtgcacaggttgtgtgtgtggtatatgggtgtgtgtgtataggtgtatgggttatgtgtgagtgtgtggtatacagtttgtggtgtgattgtgtagtgtatgggctgtgtgtggtgtataggtgtgtgtgtataggtgtatgggttgtgtgtgtgtggtatattggttgtatgtggtatatgggtatgagtgtgtataggtgtatgggttgtgtgagtgtgtggtatatggtttgtgtgtgtggtgtatggttgtgtgtggtatatgggtgtgtgtgtataggtgtatgggttgtgtgtgagtgtgtagtatatagtttgtaggtgtgagtgtgtataggtgtatgggttgtgtgcgtgtggtgtatgggttgtgtgtgagtgtgtggtatatgggtgtgtgagtgtatataggtgtatggttggtgtgtgtgtggtatatagtttgtgagtgtgtgtggtgtatgggttgtgtaggtgtgtggtgtatgggttgggtgggagtgtgtgggacgtgactggataagttcgtgagtgtgagtgtgtggctgtgggtgtctgtgtgtctctgggtgtgtgtggatgggggtatgtgggtgtgagtgtgtgtgtgaggtgtgggtgtgggggtgcactgcgtgtcctccctgggggtggcccctgagagtcggggcctgagcccggatgtctccgcgactctgcatgtctccctctgcctccgtctctctgctttgtgtctgtctctgtcatccctgcctctgccccatccctctgggtcctagaatctgcccaagtctggggccgcctcccaggaagccccacaagtgtccaccaagggatgcacggaggacaaactgcagtgcacacatacgaggaggctgagtcaccagagcctccaccctagtcctgccctgactccccgggtcagggctccaggccccaagcaccgcccggctcccccctgggctggggcctgtatggggctgggagtctggaggctcagccctgcgggggaggtgtgagcaaacccgcctgcactgcgagccccgcacaggccatcccctgacactcagacacgcagacatgcacagacacacacacatacacacagacacacacagacatgcacacacagaaacgcacagacacacacagacatgcacagagacacacacacagagacatgcacagacatgcacagagacacacacagacatgcacagagacacacacagaaatgcacagacacacacggacatgcacagacacacacatatgtgcacagagacacacatatagacacacatccacatggatgcacagacacagagacacacacaggcaaacacatacacacacagacacataaagacacagacacacggatatgcacacacacatgcacgtggatgcacagacacacactgacacacatagagacacacacacacagacacataaagacacacacagacatgcccgcacacaggcaccccctcccgcaggtcacgcttgcagcccctggccactgtcctgccccgtgtcatgaacctgcctcccctgtccacaccacacacctgtccaccccacacacctgtccacactacacccctgtccacactacacacctgtccacactacaccccatccaccccacacacctgcccacaccacacacctgtccacaccgcacacctgtccacaccacacacctgtccacactacaccccgtccaccccacacacctgtccacaccacacacctgtccacactacaccccgtccaccccacacacctgtccacaccacacacctgtccacactacacccatccaccccacatccctgtccaccccacacacctgtccataccacacacctgtccaccccgcacacctgtccaccccgcacacctgtccaccctgcacacctgtccacactgcacacctgtccacactacaccccatccaccccacacacctgcccacaatacacacctgtccacaccgcacacctgtccgcaccacacacctgtccacaccagacacctgtccacactacaccccgtccaccccacacacctgtccacaccacacacctgtccaccccacacacctgtccacaccacacacctgtccacactacacacctgtccgcatcacgcacaacctcacacctccagctcatccaccactcactgcacacacgcttgcatctcacacgctcatgctcacactcatgcactaacacacacattctcccacctgttgccaagctcacactcacacatgcacacatggcgttgctgggccaggcttgggcacatggggtcagggaaggctcggagagcgtacgccttggcctctctggcggcatgtccgggtctgcggggcagaggtcacagttgctgccccacgacaccgcatgtgcccctgcagggcctgggaatggcaccccgcagagcccgcgctcagggccagctcgtgtcagcaccgcgtggaccacgtcccgaggacacctgggccagccagtgctgcgggctgcagcgagtgtgtgtgcacacgcatgcccatatatgtgttgtgtgtgcttgtgtgcatgggagggggtccctgggtgggccagggtctgcctcgggggctggagtgggaggcctgggcccctcagctttcctccaacccagcctcacttccccgcccctctcagctctgcgtggccaccagccagccctgggcttggccccggcatgaggcctgaggcagggccctggataacgctcaggacgggcacctgggccttctgggcctcctcgccaaggaccagactcggcctcagcgcctcacactcatcgggggtcatgccctggggcccagccaggacgctcgctgccccactcaggaggctggacacactagcaggtgggggggccgcagctccccctcccccacccccgtccagtctgaaaaacaagacctcatgggcaccgggccgcagctcccacccccaccccaccacacaggcacaaacacattcttgcaaatatttctaaaaatgctgaaaatgggaaccacagagcaggtgggacagtggtgtggaaacccccacccacctccgagatggcgatttgcattgggggaggtggggggaaggctggcacccaggcagctggtttgcaggattcctgactattcacactccccagccacaccccatgtccaggccaatgctgtggccaggcccagagtgaccaggccccagggcacttcccagaggactgcctggtggagggggtaacaagtcggaccttgccccaggggagctgggccagggaggagacccctgcatggaggtcccaggcatggcccccaggaacaggacccccagcaccctcggaagaggattttgtgggtcacctggggacagagcttcctccgtgcacctgctgggcccctcacagcccacctgtcaccaaacctctgtcctcccctgtgcccaggcctggccaacccaggcgctttcagcccgtagaccctaggtggggtcgcccaaccctaccccggcctcagtaccctctggggttgccccacgagaccaccccagaacagacctgcccaaccccagccctgcatcttcagtgggacacagaggcctccataggaccccaccccacacccaggggctgtccggggcccatcaccccagcagctgagaccctgggagatgacaccctgtgcctagaacagggtggaccacatggggggacattctgacccgtgtcccagccaggcaggacagccccaccccagcctcctagaggaggggtctgtgcccgcgcccaccccctcagtggaacctaagccctccagggaggactcaagtttgaggaaaggatccctgggaagacccccagggtgcagcccgggtgacaatgctcagggggcccttcctgcacatacagcctcccacaaatatagtcatgcacaccccacagagacacacagaacacacaaacacacagagacacacagacacatagacatacagagacataaagacacacaatacacacaaacacactaacacacacagagagagacacacacacacataggcacacacagagtcagagacacacagacacactaccacacacacagagacacacagacacacataggcacacagagtcagagacacacagacacagaaacacaagcacagacacactaccacacacagacacgcataggcacacacagagacaaagacacacgcagacacaggtacacaagcacagacatgctaccacacgcagagacacacacagagatagatacagacacacataaagtcagaggcacacagacacatatagacacacagaggtacacggcacagacacacacactcagaggctcacactcagccacagccacgtgcacacagctcacacggcccacactcaggtccacaagggctcacagcgtcacagaggcccccagtcccacagccagacaagcacaggccgtgctcacgctcacacactgacgcacacattctcccacccgctgccaagctcacgctcacacatgcacacgtggcattgctgggccaggctttggcacatggggtcagggaaggctcagagagtgagcatcacagacacagggtgggactggtgtccggggggtccatgaggagccgaggggcagccctgccacgcccacaggccccaggtctattctcaggcacccgcctggggctgggggcttccttctgggaacacgaggacctccgttctgcacggagacacacgtccagaaagggacaccccagggccacacccagacacacccagcccgactcgggcacccagcacacgccgggcacacaacaaacacaggagctggcacacgcctggccccaggccaggacagcagcaggcaactcggccagtgcacacagccgctcacacacaccacacatccccacaagccctcacacccttacatccccacactcccacacatccacacacatcctcaaacaccccacacatccacacacaccccacacaccccacacatcctcacatccccacacaccctcacaccccacaccccacacaccccacacatccacacacaccctcacatccccacacacccccacacatccacacaccccacaccccacacacaccctcacaccctcacactcacacacactctcacatccccacacatccacacacaccccacacatccacacacaccctcacatccacacacaccctcacatccccacaccctcacatatcctcacactcccacacatccccacacaccccacaccccacatccacacacatcctcacacacatacacacaccctcacacaccacacacccactccctcacacaccctcacacaccccacacatccacacaccctcacactcacaccttcacacatccacacacaccccacacaccccacacatccacacacaccccacaccccacacgtgcacacacaccctcacaccctcacacatccacacaccccacacaccctcacacatcctcacactcccacacatccacacacattctgaagcaccccacacatccacacacaccccacacaccccacacatccacacacaccccacacacacccacacatcctcacactcccacacatccacacacaccccacacaccccacacatccacacacaccccacacatccacacacaccctcacatccccacacatccacacacaccctcacatccccacacaccctcacacatcctcacactcccacacatccacacaccccacacatccctcacactcccacacatccacacacatcccacacatcctcacacacatacacacaccctcacacaccacacacccacactccctcacaccctcacacaccccacatccacaaccctcacaccctcacaccctcatacacacacccacacacacattctcacttcacacacccacacacatccacacacccacacatccatacacacccacattctcacacacccttacaccctcatacacccacattctcacacacatgctgacacaatcccaacttcatacatcccacactcacaccctcccacacattctcacaaccctcacactcaccccacacttccgcatatctccacactcccacaccttcacaaacatttacaagccctcacaccctcacactctcatgcacccctaacacttatatcctcacacacacatcctcacacatccccacacccttacactctcagtcacaccctcaccccctcacacccttacacaccctcacatgccctcatacacaccctcacacacccacacaccctcacccatcacacactgacttcacacgcattctctctcacactcacccacacaccctcatgtgccctcacaccgacacacccactcaccctcacacacccacaccctcatacaccctcacaccctcacatgcccacacacacaccctgacacacccacacacaccatcacaaccctcagacttcatgcattctcacacccacacaccctcacaccgacacacccactcaccctcacacaccctcacacaccccctcacaccctctctcacacacaccctcacacaccatcacacagccctcagacttcacattctcacactcaccctcacacacacacacccacacaccctcacataccctcacacccacaccctcatacactgtcacacactccacacccacactctcacacacacccttacaccctcacacacacactcactcaccctcagacacacacacccttgacagcttgcctgcagtctgtcagaggggtccctcagagggccaccacaccctgcggatcaggtgcccagaatccaccatccagcggctctgggcctttcccctctcagctcatgacctttgggtaccacggctcaggagtacccctgtgctccccagctgccaatccctgcatctccttgggcccctgctgacctctccagtggcctcagggtgacgtcctggccaggccctgtccctctgcagccacctctgcccactgccccaccacctgcccagggctcccccaggctcccacaccagccgtgggggtctctcaggcaggccggccaggtggcaccacggctcccccaagggcagcaggtcaggcgtgagcattgccgtctcccatcccctcctgctgagcccccacaggagcctggcagcccgatcctgtcaccatagtgagggcagctcctggcccaccaggcccagtccacaccagccggccgcaggcagcgtgtctgggagacaccccaggccgcccaccgcccagcaggggacaagccagcccccagacccgtgccctgcacagggggacggggctcagacccaggctgcccttgacagcaggagctgtggtgggcccacggtggggaccactggggacaggcctgggggcacacaatgctcctgaggggcctcaggctgcgtcctgggttggggcactgttctgtgagtaggtgacatgtcaccttgaaagggcttctatttcactaagagaaaaggtggaggctttcctgggggagggcggtgcggtgttgtgtgggacagtgagagagggaccaccagcacagacaaaggagaggaaagtgcagggggggtgggggctgcagggacagaggcttggggaggcgctggaaccgcagggcgcgggcctggggggcccacacgccacctcgagggaccgcacctggggaccacagacgcaggcccactcgggctctggagggccctcctggggctgcctggccacgctctctctctcctggtcccagatcccctccacggcccctccccacccgtccatccagaagttgcccagggctggtcagaaggggccacatgacacccccaggacaggctggaagtggagggatcgtggtcccgcagttcaactcccacccggcactccccactcaacatcacttaggacagttatattgtttcgggttcttttttttctgtattaaaagcattaacttccaatactgcttttataaaacacacatgcactgtggtgaggacgttttgttaaaatgaaagggacaagccggggctggacggggaagccccctggtggggggacacgggaggggaaccctgcactcacagaaaagcccctccattctttgcacgtttcaaatgttgtattttcaaatataattaagcgacgtgggaggaagggcaccgcgtgctaggcaggagcagccccctcctgggagggagatggcagacaggggacagggtgggggacagggtgggggacagggtgggggacagtgaccaggtgaggaaagatgcgggtcagggactgggggtgcaaatggggaggtggtgggggacgaagcccctccaaacctgacgccccgccgcttcccgagcccggggttcagggcttcctgttttcctgtgtgattatgagctcctgctcctgccctcgccccacgcgcgagtctcccctggaaggatgtgcaagcttttcacaagcaccacagactcttacaacccgggaccacctgggaccccaggcggtcaggaccagggccaccccacacggcaggcaccagcgctcctgacctgggctgcagaacagcctgtggtcaggcaggggctcccactggcccctgtcctcggcaggcccttccccaggagcagcgtccgggagctcaatacaggcttgggggctgcccgtccacctggggaggatctttgcagggccctttctttctcactaaacagcttgcctgtagaaaggagaattcgaagggatttaaatccagtatttttactggttttccccggggctagccagggtgtctgccccacctgctggtggaaacgaagttcccactctggccttctccgttagggctttatttcatggaggttgcatatgcccgcctccctgcaatgcgatggtgaggccagggactgcggatggggcaaggcctggaagggtgtgactgtctgtgaggtggggatgggcctgcagagggacgtccgggaatacacggaggcgtctcgcaccgacaccggggttcactgtgacgggaggggctagagaccatctgagtgggctggaatgggggttgtcgcacacccctcgggggtggatgtgggtgcccagcaagagaagcagacccggccccacaggaggctgcagatggaagcttcagaggcggctccggggctgccacaaaccccgcccctccacgtgcctccctgtcccgggagccgcccctctgacccccaggcccttccccggacgtcccagctgctccacagcccaggcttctcccctcctgcccccatggaacccccaccctgggctgtctgggcctgcctagccggccgtgtggggtcccccaggcccgtggcccaagcacccatctccgtgtccagcgcccagcgcactcggacgtttcacacgcgggcctctggggaggacccccaggcaccgccagcccaaccccggcggccggaaactggacccgctgcggcagccgctgaggctctgctgcccccgtgtggccgacagcagcatcgaacgccgccgaccacgcggcgcttcccgggctcggggcaggggcaggggcacgggcaggggcacgggcaggggcaggggcaggggcaggggcaggggcaggggcgctctcggggccggatcccggctctgccttgggctcagggctggggcccggtccgtgtccagcactgtgatcccctcccctccccagcgcctgccgcggagatggctgtggcatccgcgaacaggcgtcagcttgtggggctctgtggtctgggatcccagcctctgccaaagtcctgcattccctgggtgtggggacgctgtgacctggggacgctgtgacctggggacgctgtggcctgggggccttgcagggctgcacctggggcagatggggaagctggcctgggctcctcggtggggccccgcgccccccacttctgccggcagcatccgatgctccctgaccctggtcaggacccttcctcctggcgtggcccagtgtccccgcagaagccccagaacgcggcctgcccgggagccggctcgggcctggggcctgcgggtcttcactatggtcgcgaatggacccacgggatgctgcatgaggcgcacgagcttgaggcaccagcctccggccactgtccctggaggacaagggacgcggctccggagcagagggtcctcccctggggatgccctcccggcggctgggtgtggggctgggggctgtgcccggaagtgggtgggtgggagaagcctcctgagcacagaggacagcagccaggcccaggcccaggccctgcaggcccccaggggctccagagccccagagaggaggaaggcctccgtgtgctcacaatcagctcacaccccggggaggaacctcagagggtcgggacaaggaaaggaaggccccggcccaacatcggggtctgggcgctggtgggacagggcaggctcagccttggggccggtcagggccctgttggggttcgggtccccctgccaggtccgcgtctgcagccacagcccctcaaccccagcagggaccccagagaccggctcgggaccccctggtggccgtcttgtgccactgcagttctgctgctgagaggttcccggggttcccggggttcccggggtccctggcccggcagcctcctgggctcccaggcaggcgcgctctgccgtccgctcatgcggggacagcggacctcagaggcaagcctcaaagacgcgcccagatcaggatcccaggaacccagctcacatacaaatcagaaaagccctaaagaagcagaaacaagaatcagtgaaacaagaaactatagaataagaacccaaacaaaagcaaaatgtcggcgttatcagacatagaatatgcaatgtgtgcttaagagggtttttttgtttgttttgttttgagatggagtctcgctctgtcgcccaggctggagtacagtggtgcgatctcggctcactgcaacctccgcctcccgagttcaagcgattctcctgcctcagcctcctgaatagctgggactacaggtgcccgccaccacgcccgactaatttttttggatttttagtagacacggggtttcaccgtgttagccaggatggtctcgatctcctgacctcatgatcttcctgcctcagcctcccaaagtgctgggattacagcgtggccaccacgctcggccaagagattttttaaacttacttacagaagctattcaaatattactgcaaaatgggaaattactgcacattgcattttgaaatgacctgagagttttacgaagaacttctagaactgaaaaccgtaatagatgaggctaaaataagaatggatgggacaggcagcgcagaggacacgcaggagcaggagctggtaacaccgaagaaagagcaggagacgccacccagcccgagcgcagccccgcggaggctggaccgaggctcccacaagggcttcttctgcccaaaggagaaacagagtcgggggaggcagtggctgggaattttccaaaatcgctgaataacaggatgtgtcaggatcaaggccaagtcccaagcaggataaataaaagcaaaccgcgtccacaccttgacgcttgccgatggaactgccaacaccagagacaaagagactttagaagcatccaaaaggaggccgggcgtggtggctcacatctgtaatcccagcacttttcgaggcagaggtgggtgggtcacctgaggtcaggagttggagagaccagccaggccaacatggtgaaacccggtctctattaaaaacacaaaaattagctggacgtggtggcgggtgtctgtggtcccagctactcaggaggctgaggcaggagaatcgcttgagcccgggaggcggaggttgcagtgagctgccatcgcgccactaccctccagcctgggagacagagtgagactccatcaaaaaaaaaaaaaaaaaatccgtcagggccggcccaggcaggtgcactcgcgcggccacagactccagagccggactcgggagccccccggcggccgtcccgtgccactgcacgttctcatagacaggagagtctcaagaaccctggagcaaacaagacgcctggagcagcctcccagcatctactcacctctgccggccgtttacacccgaaagccacccctcaagaccaggacaacggtgacactttcatacaaagggcacaggcacttaactccgcacgctggctgctggcgcctcctaagagtgtgtttagaaatgttaaagaaaaaattattccatgatagttgttcaatgcggaagcaggtgtgattcaggaccaccgccacaggagcagggaccatggccatgggggagagagatggggctcagttcttaacacagcatgggctggcagggatcgacagccaaggagggagctgggtaaactcggaggacggacattcccaagaggaaatattggggggaaggagggttctggctaaattagcccaggaagatttttgctgaagacagaccagggtgatcagacctgggagatggtggaagatgaggaactcaggatcaagggtgatcagatgtcaagagtgggtctttaacctgacttaggggggttctttttttttttttgagacggagtctcactctgtcaccaggctggagtgcagtggcatgatcttggctcactgcaacctctgcctcccgggttcaagcgattctcctgcctcagcctcccgagtagctgggattacaggcaccctccaccacacccagctaatttttgtatttttactagacagggtttcaccatgttggccaggctggtcttgaactcttgacctcagatgatccgcccacctcagcctcccagagtgctgggattacaggcatgagccaccgctccgggccccaccgggtactttttaaagcctttttcttacaaggaagtgcaggctggcctaggagaaggttccagagcccgactgtagtttggccaagcagagaatctttgtcagtccaccctgtttaaagaaagaggagacattctggtttccctccaacaatataagtacattttcttgttgggtggcctttcgttcattaagaaccagctggattttctgttgggactgggtagaagaggacattttgccgcatggtgctagcagttggacattcaaagaggagagactctgaaaataaacgaaacacaaaggttaacacttagaaatgcagtttccgaacccagtgggcaccaggctggaagatttctagacgctgggcctgaagcatcttcagctgcagccaggtaggcagctgaagggccttcctgatttgcaggtcaggtgttgcagaagctgcccgcacaggatctgtggggatgatttctctaaagtttacatcaacttgtcccatttcagctcacagggcttcaggaacagagcagttttaaatttgactgattccaagtcagagggtgagggaaaaattggaaaaattagtttgcagagttgttgcctgatattagagaaaactagaagaattctgaaggggccagcccctccacacctgtgggtatttctcgtcaggtgggacgagagactgagaaaagaaataagacacagagacaaagtatagagaaagcacagtgggcccaggaaaccagcgctcagcatacagaggacctgcaccggcaccggcctctgagttccctcagtatttattgattactattttcactatctcagcaaggggaatgcagcaggagaacagtggggaggaggtcagcaagaaaacgtgagcaaaggaatctgtgtcacaagtaagttcaagggaaggtactatgcctggacatgcacgtaggacagatttatgtttctctccacccaaacatctcagcggagtaaataacaaggcagcattgctgccagcatgtctcgtctcccaccacagggtggtttttctcctatctcagaatagaataaatgtacaatcgggttttataccgagacattccgttcccaggggcaggcaggagacagtggccttcctctatctcaactgcaagaggccttcctcttttaccaatcctcctcagcacagacccttcacgggtgtcgggctgggggacggtcagctctttctcatcccacgaggccatatttcagactatcacatggggagaaaccgtggacaatacccggctttccagggcagaggtccctgcggctttccgcagtgtattgtgcccctggttcatcgagactggagaatggcgatgacttttaccaagcatactgcctgtgaacactttgttaacaaggcacgtcctgcacagcctagatcccttaaaccttgatcccatacagcacaggtttctgtgagcaattgtttagggtacaggtcaaaatggaatctcttatgtcttccttttctacatagacacaataacagtctgatctttcttttccctaaaaattcaagatccagtccagtttgtagataaataacaaaacctcgtaaacaatgagcagggctgaaatctcatcacggtgccctgcagttttgcattgaatcatttttttctccacagtcactcccacatttccataaatgttgatccaaataagagtgatatgtttgcaaagtcagtctagtttcactatacttggcctgattgtttacataagtgcaacaagaagcagttgaccacattcgctctctttaaatttgctttgctggaggctgggcgtggtggctcatgcctgtaatcccagcactttgggagactgaggcaggtggatcacgaggtcaggaattcaagaccagtctgcctaacatagtgaaaccccgtctctactaaaaataaaaaaattagctgagtgtggtggtgtgcacctgtaatcccagctactcgggaggctgaagcaggagaattacatgaacctggcaggcggaggttgcagagtcaagatcacgccattgcactccagcctgggtgacagaatgagactccgtctcaaaataaaaaaaaaattgctttgctggagcttttcataaagaatctcagattgaactgtaaaggcctcccggggctgggaagccacatcaaggacatgccatctgacttggcacagggtacctatagatctgggtgagttcctttctgctcagtccccaaaatacagaggttgctgggctgccttactcaacctgcaagactgggaaccctcaggccaatttttccaagggggggtttactggctccataaagtcaactctagttccttaaagctgtgtggtcgtatctgaagataggatattccggtcaaagccttggtaatatcatcagagtctgtaattgtgccgttacaaggagaacagattcttactgaacttttacaaataactctactgtcataaaaataagtgtagggaaaagagagatcaaaccgttactgtgtctatatagaaaaggaagacataagaaactccattttgatctgtaccaagaaaaattgttttgccttgagatgctgttaacctgtaactttagccccaaccttgagctcacagaaacctgtgctgtatggaatcaaggtttaagggatctagggctgtgcaggacatgccttgttaacaaaatgtttacaggcagtatgcttggtaaaagtcatcaccattctccagtctcgattaaccagggacacaatgcactgcggaaagccagggacctctgccctggaaagcctgggtattgtccaaggtttccccgccctgagacagtctgaaatatggcctcatgggaagggaaagacctgaccgtccccctagcccgacacctgtaaagggtctgtgctgaggaggattagtaaaagaggaaggcctcggccgggtgcggtggctcatgcctgtaatcccagcactttgggaggccgaggcggatggatcaccaggtaggtcaggagatcgagaccatcctggctaacatggtgaaactctgtctctactaaaaaaaaaaaaaaaaatacaattagctgggcgtggtggtgggcgcctgtagtcccagctactcgggaggctgaggcaggagaatggcatgaacccaggaggcggagtttgcagtgagcccagatcatgccactgcactccagcctgggcgacagagcgagactctgtctcaacaaaaaaaaaaaaaaaaaaaaaaagaggaaagcctcttgtggatgagataagaggaaggcctccgtctcctgcatgtccctgggagcagaatgtctcggtgtaaaacctgatcatacattcattttattctgaggagaaaaccgccctgtgtctggaggcaagatatgctggtggcaatgctgctgttactcttcactacactgagatgttagggtggagagaagcataaatctggcctatgtgcacatccagggatagtaccttctcttgaacttatttgtgacacagattcctttgctcacgttttcttgctgaccttctccccactgtcaccctgttctcctgccgcattcctcttgctgagatagtgaaaatagtaatcaataaatactgagggaactcagaggcccgtgccggtgcgggtcctccgtatgctgagccctggtctccttggcccactgtgctttctctatactttgtatctatgtcttacttcttttctcagtctctcgtcccacctgacgaaaaatacccacaggtgtggaggggctggcccccttcaataaaaacactcactactggttttggggttctggagggattaggaagggagaaaatagttgtttcctctctgttcacaaagatgtaacttaccaaattgctgcaaactattgacagcttaagggaaaaaagttttctaaaatctgaaaaacaaaacattaaagaaccagcaatgtttccaacaaaaagtcatttaaaaattatcctcggccgggtgcagtggctcacacctataatcccagcactttgggaggccaaggcgggcagatcacgaggtcaggagttcgagaccagcctgaacaacatggtgaaaccccgtctgtactaaaaatacaaaaaaattagctgggtgtggtggcgcacccctgtaatcccagctgctcaggaggctgaggcaggagaatcacttgaacccgggaggtggtggttgcagtgagccgagatcgcgccattgcactccagcatgagcaacagagtgagactccatctcaaaaaaaaaaaaaaaaattatcttcctttgttcattcagtcccatgtaattgaatcttgttctgtttgaagctggattagtagtctgatgacatcagttttttcattccatttctgaaaattcttacacagtccaatggtatgatcttaaagctatcagcagcggtctgtatttcggagtaactgtcagagtctttttcatgaatcttgaagaatagccacttttgtctacctaattgcaaattactttagtaaagaatcaaaggaaaagaataactgaatggcaaaggcttaaaatggccatttttaaagatctgatgagagttcattataataatgatacaattgacaaggaaatctggttatttctgtaacatacaacactttaacacaatatctgaaattatggctgataaaattataccaggacatatccgatttctaggatttccacataatttctgaagcattcattaatgacatatccaaaaatatgatttaaagatgtagtatcaaatactatttgttttctttataactttacttatcaaataagcccaattagaccaggcacagttgctcacacctgtaatcccagcactttgggaggctgaggtgggcagatcacctgaggttgagtttgagaccagcctggccaacatggtgaaactccatctctactaaaaatacaaaatttagctgggcgtgatggcacacacctgtagttccaactacttgggaggatgaggcacgagaatcacttgaacccatgagacggaggttgcagtgagccaagatctcaccattgcactccagcctgggcaacagagtgagactgtctcaaaaaaaaaacaaacaaaaaaaaaagcctaattagtttaaaatctcttttttgagacaggctcttgctctgtcacccaggctggaatacagtggtgcaaccattgctcactgcagcctccacctttcaagctcatgctatcctcccacctcagtcttcggagtggtggggattacagacatgtgccatgtcaccgggctaatttttatttttttgtagtgacagggtctcactaagttcccaagacttgtcttcaactcctagtctcaaaggatcctcccaccttgacctcccaaagtgctgggattatgggcatgagccaccatgcccagcctacaatccaggggtaaggccattccaaagcatccaagctgactatattgaaatgaccccaataggccacctcaagtatttactagtgatagcagaccaccttacccactgggcagaagctctccccttcccacgcgcaacagccagtgatgcagttaaaaccctgttagaacacatcatacccaggttcaaactaacagagaccactgattcagacaatgggacccactttaccgtgctcattaaagggctaacccaagcactacaaataaagtgggaataccatactccctggcatccaccctcaccaggaagagcagaaagaatgaaccagactctaaaaacccacctacctaaattaattctagaaacccggttaccatgactaagtgtcttcccatggccctataagagtctgaactgctccctgaaaagacatcggcctatccccttatgaaatgcttcatgggttgctttatttaagttccactactcacctcccaacatttgagacaaacgatgagtttcttaaaaactatgtatccagtctgtcttctatcctctcctcccttgaattctcagttcaacaccagccccgagatcacattcttatcagaagttggaaaggggaaaagcttgaacccacctggaaaggaccttatgtgatgctcctaacgactgagacggcagtcagcccgctaaggagtagacccaccatacccagtcaaaaaggagtctccctctccaaagtcacggaccttcatcccaggaccaacccccaccagagtaacgtgaaagaaaaaagcctaattggcctgtccgcatttcctcttctctttcccttagctaccccacatctcattattaatgtaaccacggcaaagtcaccccaaatcattacttttgatgcttgtcttgttacaccttgcggagacttgggacgtcaaacgcagctctctacttcagaaaaatgtctttgcgaaaaaaaattacctttttcgtgaatcactgacataatgaaaaacaacatgaagcacaagttatcttgatggcacacaaaaatccttgtttttcctaagccaattacttaaaacgtaaaaaaaaaaaaccttccggcctccgcacccaggcctggggggcggcggggccgcgtatggagccccccacctcccggagctgccagcatggccagcaccaccgccccgctacacacaggtacccctaggatggcgtgagcactcccccggcgatggacccacctgtgacgctctggcactttctgctgcagctgagagcaaggcaacggccacagctcctggacttcatgggatggtggtggttgcagaggaaggtggcctagccgtgggggcgacgcaagaacaagaccaacgtgaattacgacaagctcaggcgggccttgccgtactactgtgtctggaattggtcggttcttgatctcactgacttcaacaacgaagccgcggaccctcgcagtgagtgctacagttcttaataggcggcatgtcccgccgtttgttccctcatgttccgagtttttgtttttttttttcttctggtgggtttgtggtctcggtggttcaagactgaagctgcagaccttcgtggtgagtgttagagcttttaaggcaccgcgtctagagttgtttgttcttcctggtgggttgggggtctcgctggtttcagaaatgaagctacagacctttaccatgagtgtcacagctcacaaaggcactgtaaatgcaaaaacgaagcagtaacaagatttattacaaacagtgaaaaacaaagctttcccctatagaagacgaccctaacgggttgccgctgctggctcaggcagcctgcctttattcccttatctggccccacccacatcctgctgattggtccattttacagagagccgattggtctgttttacagggagctgattggtccgttttgacagggtgctgattggtgtgtttacaatccctgagctagacacaaaagttctccacgtccccactagattagctagatacagagtgtcaattggtgtatttacaaaccctgagctagacacagtgctcattggtgcatttacaaaccttgagctagatacagagtgctgattggtgcattcacagtcccttagctagacataaagattctccaagtccccaccagattagctagacacagagcgctgattggtgcatttacaactcttgagctagatacagagtgctgattggtgtatttacaatcccttagctagacataaagattctccaagtccccaccagattaactagatacagagtgccgattggtgcatccgcaaaccctgagctagacacagggtgctgattggtgggtttacaaaccttgagctagatacagagtgctgattggtgtatttacaatcccttagctagacatacaggttctccaagtccccaccagattaactagatacagcgtgccaactggtgcatccacaaaccctgagctaggcacagggtgctgattggtgtgtttacaaaccttgagctagatacagggtgctgattggtgtatttacaatcccttagctagacataaaggttctccaagtcgccactagactcaggagccctgctggcttcacccagtgtatcttgcacctgggctataggtggagctgcttgttagtcccccgctgtgtgcccacactcctcagcccttggacggtcaatgggaccagacgcagtggagcagggggcagcgctcttccgggaggctcgggccaggccggagcccatgccggcgggtggcggtggggggcggcggggaggctcaggcatggcaagctgcaggtctcgagccctgccctacggcgaggcaggtaaggcccagtgagaaatggagcacagcgccggtgggccagcactgctggggaccccggcgcaccctccgcagctgctggcccgggtgctaagcccctcactgcccagggcaggcggggcctgccactccgagtgcggggcccgcggagcccacgcccacccagaactcgcgctggcccgcaagcgccgcgcacagccccggttcccacccgtgcctctcccttcacacctccctgcaagccgagggagccggctccggcctcggccagcccagacaagggctcccacggtgcagcggcgggctgaagggctcttcaagcgtggccagagtgggcgccaaggccgaggaggcaccgagagcgagtgagggctgccagcatgctgtcacctctcacgactatgacgagaacatcatccgcaaggtgagcggccagaagttggtctacaagtttgtgtcctatcctgaggtcgcagggtgctccactgagtgaggactgcccgccccacccagaggtgtcggttacttcaccatggcagttgtggcccctgctgctgcacatgccgccccagggggcactgcctcaggaaagccaggcacacccaagggtgcaggaatggcaggccctggcggtttggcgcgcaacagccggaacaagtacatgcgctcgggcctctgttccaccttcacatccagtctctgcagccgcagccaccccctcagcctcggcctgctgcggtgctccccaacgcagctcctgcagtccaagcccctgggaggcctgcctggaggctgaggaagccggcttccctctgcaggtcatcctgaccccgcccgaggccccaaacctgaaattggaagagccgaatgtggagccgggcttgcgccgccctttgcccccggaagtggaagtggaagggcccgaggaagagctggaattcgcgggggagagagggttcgtgccagaaaccgccaaggccgagcctgaagtccctccacaggagggcgtgccagcgtggctgccgaggtccttatggacaccgcagggcaggcgggcggccacgcggcttccagccctcagatctcccagccgcagaagggccggaagccccgggacctagagcttccactcagcccgagcctgctaggtgcgccgggagccgaacggaccccaggatcgggaactggctccggcctccaggcgccgaggccggcgctgaccctgtccctgcttcctacgcacacgttgaccccggcgctgctgacacccagctcgctgcctcccagcgttcacttccggagcagcctgagtcccgctgcgccccgcagcccggccaagctctcctgccagcttccgtccagtggcggcgcccaggtgcacatcccttccatcggcgtggctggcctctcgacccccgcggtgctctcgccagggccccagaggccatgaccaccaccagcaccaccaccccttctggggtccctccatccgtgctctctcaaggagaaacacagttcaactgaaagactcatgctctgattgtggtggggtggggatccttgggaaggatttctcccaggagtgactctcattaactcctccacagaaaacactcagcttccacagcttctctcttttctctcttttctgtccgtcccccagtggctgccctgacacgtctcctacttcaatggtaggggcggtttatttatttattttttgaaggccactgggaagcgcctgacctaacctattagggtggtcaggacgtctcccccacctccccgcttttttccccaagacaggacaatcggggtctggcttgagaacgacctttctttcttcattcctcggcctgcccgtggggagatgagggagccctgtgtccattttaggatgtgagtagaagttagtttcgttttattattcctggccatactcggggtccaggaagaatttgtaccatttaatgggttgggagtcttggccaaggcagaatcacacccttggaatagaaatttccacctcctcaacctttctctcagacagcttatccttttttaaccaactttttggccagggaggaatgtccctttgttcttcttccccctgagaagccattcctttgtctgccaaactccctggggtcctgcctgtttcctcccatggaggggttttgtgggggtggttcctgtctggggggcccctccagccagtactccaggtctccctgtctctcccctgctgccattttgatagtataatctatttttaaatggggcttttcaatagaggagagggagtcatctcttcctatatttggtggggtggatgtgaaggaagggatgtggggggcaatcttcctgccgcctccccctcaggggtttatttttgataacaaatgtgtattttcagttccctccctcccagccccccaatttcctgcaggtaggtacaaaggacactttcaatgtccctggagttgggagggaggaatgggggacataaagcctgtcctgtctctattctaggcaggaagagtgggttcaaaagactcctgggcttccctgtcagccctggcccagcccaggccttgggacctgggggttggtgatttgggggacggtgccgactttaaccacataagatcccttttccacaatccttttacaactttttttttttttttttttttttgagacaaagtcttgctctgttgccaaggctggagtggagtgcagtggtgcaatcttggctcactccacctcccaggttaaagcgattttcgtgcctcagcctcccaagtagctggaattacaagcatgcaccaccatgcctagctagtttttgtattttttgtagagatggagttacaccatgttggccaggctggtctctagctcctggcctcatgtgatccgcctgcctcagcctcccaaagtgctgggattacaggcatgagctaccacgcccagcctaacatttcataatttttaaaaacacgcttcctcatagtacagcttctcatgttaataacagacccaaatatgtttagcttttcaataccatataaaaacaagatgccaggccaggcacagtggctcatacctataatcccagcactttgggaggccaaggcagaaggctcacttgagcccagaagtttgagaccagcctgggcaacatagcaagatcctgtctctacaaacaaattaaaagttagctaggtgttgtggcccatgcctgtagtcttagctactgggaggctaaggctagaggatcgtttgaacccaagaggttgaggttgcagtgagctatgatcacaccactgcacccagcatgggtgacaagtgagaccttgtctctaaaaggtaaaatttaaaatttgtttaacaaaagaatagaaactgaatgtataacttctaaatcagaagaagaaagattaagtgaggaaaataactcctaaagaaataagaaaacgatttaaaagatactcagaaaaagcaagacaaatagaaacacaaaataaggaggtagaaataaataacgagtaatgaaaataaaaagacatggactacattctccagttaaaagatggatgctcttaatccagctatgtggtttttcaagagacacacacaaaacaaaatgacacagaagagttaggagggaaaatcatgggaaaagataaaccaggcacacagtagctcacaaaactcacaagtttgtggcattttactgtcaggcaaaattgatgttttgggaaaaagcattactagagatgttttaaagggcatgaaatactgattattgtaataacatgtagcacacgaagcacttacaatggcctgggggctgctctcaaccccttagttaaattaactccccattttacaggtgaaggaagccaagcacagaacagtcaggaagtattttctgaattttcatgtaagctgtcttttcaatcatctgccttatgatttgtgcttccgaatttttattttataactttttccctgctccaacatcaataagtgatcctcctttttttagcattaactttatagttttgcaattcacagatctataatctggctcaagtccacgcacatatgggataagtggtggaggcccagtttctattattccctgtatagtgagtcgattttgccaacaccatttataaacgatcttgtctcattgatttgtggtgtttcctttttatcttatattaagaatctgtatgtggtagcagtaaacattgttcatattcaccaatagccagtggttctctacttccaggagcacagagttactcctccctcaccccttggccttgtcattcgttctggccaatgatatttgagaagcgatgtatggaatttccaggtctaagcattcaatggccaggatccctctccactcctagcttccctgctataactgtgatgataaccctcttagttcatagttttctatccttgtaatttttcaacttgtgtcttcttttgttttaattataaagttgctcttggagtgctcgtttctttgtttgttcat

SEQ ID NO: 111 - DNA, 407661 bp, Homo sapiens
gatccacggcaggcgcagggcaaagccaggcccattgccaatgcaccagccctccctacaaggctcctaccacctggccactgctgcagcccgtccatcgctctaagcctgacccccaaccctggctgcagccgcctgccctcctagcgcagccgctctcctaccgctctggtgtaccgcagtctctgtcactgccgcccacccgcagtgaggcgagccatggtgttgcaggctctaggtgtctcctcctcctggcacagagcagctgggcgggcaaagccagaaaagcctagaaaaagatgtgaggggtggaagggttagagcctcaacttgtcatgccggccactgggtggcaggggccagtttcagcaaaggcactcacacccaccctccaaagtccagcctctccttttggcccaagctgggcaggaactggggtctgggatgggtgctggagacaccacagcatccagctccccactccacaggaaccattgggcccactggggctgcactcctcagggagcaggagaagcagaaaaattcagacccagccagccctccacacccaggtgccaattcctgttccggacgcctccacgcacagggccctgtcccccgtggtgtccccaggggtgcctggcagcctctgaggcacagacccacagtacacaggcccaggaaccacggtgggtgtgggggctctgccatgctcaggattcccacgcaaatgctgcgtgccctgctgcactccagtatgaccaagagtgggtcgccctctggagtgtggggtcagggagaggagaaccactccttccttggatgccaactctgttgaccgacaccagcagtgcagcccctgatagcaccgaactcgcccccgctccacggctagtcctgccctcaatagcgccccccacctccgtcccccaatgccgccagtagcgtataaccgatagtgccctaacctgtcctcctccatgggcattgcagccccagagagcacccataacccaccctccctgccatgggcagtgcagccctgtacagtgctaccaaccggtacccctaatgcaggcaatgacaccctggatagcgccctcaacccaccccacactgcgaaaggtacagccctggatagcccctgtcctaccactctggtcgtcctgtagtctctgtcaccaccaccaccaaccacagtgaggcaagccagtgggccacaggctctaagacccagcagccaggcatggagcagctctcgctgatggccggctcctaccactctgaccacgctgctgtctgtctccgtggccatcttctttcactacaaaggaataaaactaggtatcaataagaaaagcaattttggaaacaatacaatcacatggaagttaaacaccaccctcctgaataaatgactagtgggtcaatgaagatactaagacagaaattcaaaaatttcatgaaacaaagggtaatgaaaacacagtataccaaaacttgttatgcagaaagcagtacaaaggcagagatttacagctataagtgcctaccatccaaacaaaagaaaaccttcaaataaacaatacatcttaaagaactagtaaagaacaaactaaactgaaaataagaaaataaataagatcatagcacaaacaaaattgaaataaaaaacagacaagattaaacgaaaagttggttttctggaaagctaaacaaaattgacaaacttttaaccaggctaagaaaagagacaagattcaaataaataaaatcaacagattaaaaaaaggagacattacaactaatacttcagaaattcaaaggatcataactggctactatatgccaataaattggaaagcctagtagaaattggcaaattcctagatgcatacaacctactttggttaaacaatgaaaacatccaagaccagaacagattggtaacaagtaataagattgaagccatcagaaaaagtctcccagtaaagaaaagcccaggaactgatgtcttcactgctgatggcttcacaccaaacaatttaaagacctagtacgaatcctgctcaaactattttgaaaaacaggagggaatacttccaaacttattctatgagaccattattactgtgataccaaaatcagacaaaagcatcaaagaaggaaactacaggccaggatctctaatatggatgcaaaaatcctcaacaaataccagtgaatcaaattcagtaatacattaaaaagataattcatcatgatcaagtgggatgtatccctgggacccaagggtcactcaacatacaatgtgatacatcatatcaaccaaataaacgacaaaaacagtatcatcacgtcaactaaaaccgaaaaagcatttgatgaaattcaacatcccttcatgctataaatcctcaaagaaacgggcacagaagaaacataccgcaacataataaaaactacaggaaagacacccacagctagaatcatatggaatggggtaaaatggaaagcttttcctctaagatctggaacatgataaggatgccccctgtcaccactgttgtttaacatagtaccagaaatcctagctaaagccatcagtgcagcccctgatatggcccccaacccaccctgccccctaccaccagcagtgtcacccccccaatagcacacccaacatacccaaactgccctgcctccccacaccatgggcattacagcaccccatagcgccctcaacccgaaactgccacccccccgacagccgcacagtgcagccccggatagcacacttagcccacctcactgttgccagcaatacagtctgggatagtgcccccaaccggctccccaccaaaggcagtgcagccccggtttggcccccaaaccaccccccccccgcccggtgcaggcagcacagccccagatagcacacccaaccggccacccaagacggggaatgacgcctgagatagggctcccaacccgtcccaggccacccacagtgcagcctggatagcgcacttaccccgacgtctttctacgctctggctggctgcagtgtccatcgctgccaccaaccacaaacagggctgcaaacaggaaggattttattcaccgtccatgcggccccgagttgtcccaaagcgaggcagtgtccccaaggtctgtgcagagcagaacgcagctccgccctcgcggtgccaccagcccgcctgcccgggtctctgctgaggagaacattgctctgccttcgctgtatctccgaagtctgtgcagaggagaactcagctccgccctcgcaatgctctccgggtctgtgctgaggagaacgcagctccgccctcgcaaaggcacacagcgctggcgccggcgtggcggagaggcggccagcggcggagaggcggccagcggcggcgcggtggagaggcggacagcggcggagaggcggacagcggcagcgcagcggagagacggacagcggcggagaggcagacagcggcagcgcggcggagaggcggccagcggcggagaggcggacagtagcggagaggcggacagcggcggcgcggcggagaggcggacagcggcggagaggcggacagcggcggagaggcggacagcggcagcgcggcggagagacggacagcggcggagaggcagacagtggcggcgaggcgcgcagcggcggcgcaggcgcggagaggcgctggcgccggctctggctcggagaggcgcaggcccaggctccattccccagctgtgaaagggtaagaaccgagggtggctgagactcggggttgttcagggccgggtgggctctggacccagcaggcccggcacccaggtcagggctccaggggaggccaggtgggcgaaggccaagaaggggctggggctggtcaggaagggctcctggtgaccagagcactttgcgtgagccagcgtgggaggaaggtgggctggatgagccagggaggcgccgggaggggccttggcagaggcgaccccctccgtcacccccaggccactgaaccctgggtagcgagaaccgacaggggaggctgcagacagaggagtggaggctccccggcttttggggctctgagtagaagcatctagggggtccctcaagaggcccccagacgcttccccatggtgagaaaagaaggcgcagagaggggcacggcgccggcgcagaggggcacacagcgagatttgctgtgagttcttttattgccccaagtgtacctcatcttggtagatttctattggctttaaaaatgtgtgtgttttgctgttggggagtggggtattatacggatgtcagattttgctggttgactgttcagatcttttgtaaatccttgctccttttctgcctagtttcactctgtcacttacactagagtgcggtggcacgaacatgactcactgcagccttgacttcctagggtcaagtacttcccctggcttaacttcctgagtagctggtactataggtgtgtgccgccacacctggctaaatttaaaattttttggagagatgaggccttgctatgttgcccaggctcgaactcctgtcctcaagctatcctttgtttttgcctcccagagttctgggattacaggcatgagccactgtgcccggcctctgcctagttttaacagttgctaagaggaggatgttgaagtagatgtcttcttggtgggttaatccttttgtcattaagcagttgttatggtcacttccttttcaccccattggtgaaggaggggtccctgccctaaagtgtaggagatggctgaacacgacacctggcgtggatggatgagattgacagcagtgttttagtcgcatatacccacagctcagaggaggacactgcatgccacacagggtcagatgggcaccgcactctgtagcggagtgagggctgcgggctgaggaagcaggcgggcttggtagtaacaagagcacacaatgaccaatggttcccgagggggaatgcaattggcttgtttgaataaattcatgggctcgcagacaggtgaagtgaaacttcttaggctgaggtgcaactgttctggctgataaaagaactagccaggtggggagcctttcctgttgggtggcagggtagggggtgtctggtagaaacaggaaaacccacggctaggcctttggggccctgtgaggctcaaagatgtcaaggcagcataggaaattttagatcttaaaattcagcgaagaccctctccagctctggtacattattttgcttgaagtctacttcatgagatattaatatattcactcctgcttccttaaaaaattaatgatttcacaggatatctttctccattcttttactttcaacctacttaggtccttaagtgagtttgaagtttcttatgaacagtatttagttgggccatgtgtttattataggctctccatcaatctgtcttttggtttatttagaccatttacatttaaggtgcttattgttacataattgcttatgtctgatgtttttattatttgcttttttgtttcctttttctttccctccatcttgatctatttctgtataatgttgttgcgtgtatctctttgtatagtcttaaagtgtttgctctggatgttacaatatgtgtattgtaatatagtagtctactggtaccagtatttaccacttcaaagtgtggaaacctgccttgcatttatgtctctttaccttttccacttgtataaatcactggcttgagtattaggtggtggtatagtttttgtttcagtcgtcaaatgtgattttaagaactgtggattgtctcgcgtatgtatccacatttctcatctttcctttgtccctcctcccatagtcccatattcatcccttctgcataagaactttctatagccatttttttattttgatttttttgttttaattttttgtattgtggaaatgacagaacatatttccgtagccattttttagcatttctaaattgaccagtgacaaattcctatattctcttcctctgagaatgtctttatttctctcttcatttctgaagggtagtttcatgggatatagaatttgcctttcatgtattcagaggttttcagtattcgtataatcaaacctgatagttttccttttggttttgaggttgtgtcttgtttgggtgagtctcctacccctttgactacagaaatgccctttcattttaaatatcctcctattatgaaacacatttccacattttctaaatttttaatttttagctgagaaataaattagtaattatttaagtattaattacttttatcttgttattaattattggttttatttatttacatgtagttggcttacatttagtttagtttaacttaattactttaaagtaatgtataaatatctgcagtttgtacctcatgttctcactcataagtgggagctgaacaatgagaacacgtagacacagggaggggaacatcacacaccaggttctatccaggggttgggggcaagggaaaggagagcattatgacaaatacctaatgcatgcagggcttaaaacctagatgacaaattgataggtgcagcaaaccaccatggcacatgtatacctatgtaataaacctacatgttctgcacatgtatcccagaacttaaagtaaaatttaaaaaaaaaataattaattaaaaatatatatcttcagtttgtaaacgtcccgacaacgcaggaacagagttaaaagagtgtgtgtcgtccttagctgctcccaccccatcgtctcctccctagccaacccagccgccagtctggcgtgcgccttcaaggtttcttcctagacactggcaaacatagatcactattttctgccacatggtatcttttaaacacacacgattgttttgtgcagaaactttctatttttacctctcataagtgtcctgtggattctttccatgtcactgtggtgtgtgtgcgtgtgtgagattcaagttcagcttgctaatcttgtagaaagaattacactccacttcccctgtgctctggccctccctaacacagcagcccatccctggaggctgatggagccccttgagcacctgcttaccatttctgtttgttctgtttattcaggttttctgcctcctgctaagccaatttatacattccaagaaaatcttccatttcatccaggtgaaacagaacctactggaatgaagctggcctcccatggaatgaagctggcctcccgtctccttgatttgaagcagcttctccacgttggttattatgccatttttctaaatctaacattttaaaatttgtgccttttctttctcttttgcttgacttctcagaggtttttttaacggtcttttcaaagaagtggttttcggttttatttatcaagtctacttttattatggctgttttaaaattaaatacatttatttcttgtttctcttaaaaaagcttcttgtatgtttacttagtttatataattttatatgtcttctgttgaagcatattaacaaacacttccagctataacatttcccctgagaactgctttggacacatccagatattttgataggtcacacacttattgtagtttgtttctgaaaagtttttcattttagtttttattttctcttttactcaaattatcatcagctttctccttttatcctgtttctgacaaattaatctgaggatataaatctctccctaaatgtcaattttgttgagtttcataattttaatatgtaataccctattgctattgagttccaggcatttcataattttcattgtgaaaactaactttgtttccaaaacacactttttcttcttttttgagacagagtttcactctgtcgctcaggctggagtgcagtagcacaatctcatctcactgcaacctctgcctcctaagtttaggtgattttgttgcctcagcctccctagtagctgggtttacaggctcttgccactatgcctggctaattttttgtatttttagtagagacagggtttcgtcatgttgcccaggctggtctcgatctcctgacctcgggtgatccacccacttcagcctctcaaagtgctgcgattacaggcatgagccaccgtgcccggccccaaaatgcacttttaacatggtctttgttattgcatgtttctaattttgttgcaccctggtgagagaatgtgatttgtgtaacagcaattcttgggaaaggggctgaggcttcctgctcctttagcacagctaaattttcccaaacgccatccatgagcttggaaagagcattgtactctgttgggatgggctcaaatctctctgtaaaaatgagtgttcttctgttgttgttgttctgttttttgtttgttttgttttgttttttgtctcagtcgttttgtttgctcagatcttttgatgatccggataatcttttaatttatgcaggatgtttctctgcttgtgcaggctggtgggattggggactggagagaggataagtgtctgcttgcccaggactggcaaactgtcacttgccctggttgtgccttgccaggagctcccgtgcctgtctctgagagtgtcatgagcgcagcggtggtagttgtgtggtggatgcatttcccctaggttggggggtgggtggctggtcctagctctgtttgttgttgccgatgagacacagcacacttctgcttcctgatggatcttgtcagtcatttgacttcttcctggtctgggctcctgagctggccctctgcaggccaagcaggaatggagctggctgctacaagagttccttcactagagggcatctctcctctctcctcccacacatgggaacacaagggtgggctttcctccacccactgtgatccgcagcccggctttcccctcctcaccctctgctctcagacagacttgcttttccctggtgtctgtgagaggtgattcttcatggtgccaagaatgtggatttttttgagagcaggcactctcacagatatttgcacacccatgttcaaagcagcgtgattcacaagagtcaaaaggtagaagcattctgagggtctatgggtgagtggatgggcaagcgaaatgtggttatgcatacagtagactgttactgaatctttaccaggaaggagattcttttttttctttctttttgtggaaaatgcggtctcgctatattgcccaggcaggtctcgaactcctgggttcaagctatcttcctacctctgcctccctaacagctaggataataggcgtgagcctatgatattacccagccaggagggaaattctgagaggtgtgccaacaggcatgaaccttgaggacattgtgctagatggaataagccagccacaaaaggacaaatacattgcgatttcacttacatgaggggcccattatgggcaaattcaaatacagaaagagcaatggttaacaaaaggaggaagttggtgttcaatgggtatggtttccttttgcgaagatgaagaagttctggagatggacggtggtaggggatatgcgacaatgtgagtgcacttaatgccagttataacacggggagtgcgtgtgcacacggctctgggagttctcgtgcagcactcagagctcagcgtgggcgagggcgtcacccctctgggggcgtccatggggccttggagaagggaggctccggggcaccagagcagtctaccgggagaggccgggccgagcgcttgttcacccccagccctcttagggaactttcacatgcttctcccactaggcctaggcacccctccccaccctccctaccctccctaccttcctggttccctgaccctcggtgactgtgtccttcaagactgaactccagagtccccacccgaggacccgcagtgcccagcccccgcgagctcacggggtgtatgcccaccccgaggctccaccgcgcctgtgtgctgggaagcctggctccatgggaccctcgggctctgagcgcgccgtcgctgcagctgccagcagctcctgaggaagtggctcgaggccctggggtgggccaggcgtgcggtgggcccgctgccctcacaccggccctggccgcacacaggaggcgcaatcagcagagacgttggacagggttggacactggctgtctctttcgggcctcggttttcacgtctgaaataaaagcgagcatcctggccctggtgctgtgcctctgccgcggtagaggtttccacccctatgagcccagtgcgccttccaggcttgagggagagggagtgtgcgtgcctgtgaacgcgtcacactcgtgtgaacgcgtcatacgcttgtgaaagactgtgcgtgtgcacacgcgtgtacatgcatgtgaacgcgtcagggtgcctgaggatgcacacatgcacctgtgagtgtgcgcgagtgcgtgctcagaggacagctctcagcaggctggggatctccttcctctcactcctgagggttttgggggaccagcccccgtctccaggtgctgtgggatgccctggggcgagctcgcaccgctgtgctcgggctccggctttgtggggacccggccttcccagcccgcaccacggggagttccacgcagcacccacgaggtggcgccgcagactcgctaccgcggagcgcggcggctcccggctcccagcagccttgcctacagctgtggccagggcgatccctctcaggcccaggccgctgctgccaggaagagcaggaagaacagccagtcacgcctggtgatgcctctgaagtgcttatgctcccaggcatgggctgaccgcaacgtacattctctccttttatgcccctactatttggaacgctgtatttttttcatttttatttttattttttgttgtaaatctgccacttaaaaatacccagggtggagctaaaagtacagacactgctcaacttacccctggctgcggcccgataaggccgctgcgagtggaaaatgactgagtccacctgactaccgaatagcacagcgtaggggggcccaccttggcctgctgagaacactgccctgagcctgcggtgggcagaagcatcaacacgaagcctgttttgtagtcaagtgtcggatacctcatgtaatcattgactgctgtactgaaagcgaaaaactggccgtgtgggactcacacgagggtttctgctgactgtggatggcttttgcatcactataaagttgaaaactgttaagtggaactgcggtaagtcagggctgtgtgcactagagacctgagttctgctgctccatagctgtgtgactttggacacatatttgagcctgagtgtcttccacacaaaatggatttcttagcataacctacacatgtgtacgtgcctgtgagcgtgcacgtgtgtgtttgcatgaacacatctgtgtatgcacgagtgtgtgcacatttgtatgtgtctgtgtaagtccgtatgtacatttgtgtgcatgtctgtgtgtgcatatgtttgtatgtgtgtgtgctatgcatgtgtgtgttaaggccctggggtggagctgaggagttgaggggagatgctgggagggcagccagcaccaggcgtttgttggccaggagagaagctgccatccaggtgcactctggagctcgtgcttcagtggcacaaggctttgggagtgaggaagctgggggctggggcagggcagtcctgcacctcaggggaggtgcagagtgaggccaggaggatggaaagagtgccagagaatgggggaaatctgaggcatcaggaaaggaagacacaggccatggagagggcagctgggccctgggtgaggccggccctcaggaaggaggtgccataggcaggggagtgcccagatggagagcccaggggtatggacccacgggtgtatgacagtgggggtactcctgaaacagagcagtgttatccaacaagcagggttgggacagctagttatttcatttaaaaaaacaggtcaatgtcagtcctcatactgtggtttaaaataagctccagatggactcatgttttacatgtaaagaaaaaaaggcaaaaagaaaataaagaaaaggcttgtaagcaggtagttaattggaggcaatcccaggatgcaggagagaggggaaatacttttagacctaaaatttgaaaaatatagtaaaaatgattcccatatgtgcctctttcagcttgctctaatgtcagcatcataaataaccacagcataagtatcataaccatgaaatgaacatagatataatgttatttgttaactcatttaaaataccatatggatttcactgatttttcccgttgatgactttttttatgttacaagataaaattcaggtttctgtattttatttggttatcctgtccttaatatctttaaatctgtgatagtttttcacttttgtttctctttcatggccttcaaacatttgaagtttactgtccaggtatgttgaagaatgtcctcctagttgggtttgtatatgatgtttactactgatttaattcacaccattaatttttggcaagaataatacagacagatgtatcctcagcgcttcacatcagatgttacataatgtcaacatgtcttataggtggtaataaatgaatatgatcaatgaaatcccatttgaaaggaagttttggacaaaaataatgaaaacaactgcttctatcactctttctactaggtcattgcagacgtcattaggaataatctgtttcttccttatcgaatatgtactttattttaacaaactttaatctttttacagtctactgcatcacagcgaaaattgaagaaataatttagttcacttttaaatggcaaatgtttccataataaccatttgccactgaaatgttgatagcctgaagaaagaaaaagaatgggatttattcagccatggtagtatcttcacatgaacagcttttactgagtcaactatttggataaataaatagaattttctactacttagaatgttgcaaaattcaaatggagcagtgtagcatgcactgagctacctctactgggaaagttaagaaccactgaggctatataaggattcatacagtgagtcactatttctggaaacctgggattctggtgcctcagttgaaaagagtccaagaatcaaagtccaaattattcaatgatttttttttagaactgcaaaatgtccaaatagagcagagacgctaaaactgagtggccaccacattagctgtctgtaaaggaagcagctggtaaaatctagtaaacactgatggtcttgttgaggtttttgtttcatgttgaatcactgtgggaggtaagttataatcctgctgacagtaataaactgcaaaatcttcaggctgcaggctgctgatggtgagagtgaagtctgtcccagacccactgccactgaacctggctgggatgccagtggccctggtggatgcaccatagatgaggagcctgggagcctgcccaggtttctgctggtaccaggataagtagctgctgctaacactctgactggccctgcaggagagggtggctctttcccctggagacaaagacagggtggctggagactgtgtcattacaatttctccggtggtatctgagattggaaataaaacagaaatgcactcatgtaatctagatcaaaccagctgtctttgagtagagccaaaattgttcatctactttgaattttaattatatttcttgctgagcagagaaaactcctgatggagttttcactgatgtgcaaaaccacctcatattcccctcacctgggagccagagtagcaggaggaagaagaagctgtgctggggcttccatggttccatctgggtcctaactgagcagttcctccccaaggctctgacccaggcattgatatgggccctggaaggtagggcagctgggagggacatgcaaagcagctggggtgggagctgggcttccagctgcagataccacctgcttcttcctctctgcactgagcatcctgcgccaccttggttgtcaggtcagaaaagtctgttggctcagtctgagtgtagaactcctcccttgtgctcacagaatttcactcctgtgcctttcttatcttcaatcacctaaatacacccgtataatgtttggcacaagtctgttaagaacaatataaaaggctgtgttttcatttctctcttcctgtcctcaatatgcccagtcatctccctaagtgcattattggatcgatggaaatgaagagtctgttagaacttaatcttccagatacacattttttttttttttttttttttttttttgagacggagtctcactctgtcttccaggctagagggcagtggtgcgatctccactcactgcaagctctgcctcccaggttcacgccattctcctgcctcagcctcccgagtggctgggactacaggcgcctgccaccatgcccaactaattttttgtatttttagtagagacggggtttcaccgtgttagccaggatggtctcgatctcctgacctggtgatccaccagccttggcctcccaaagtgctgggattaaaggcatgagccaccgcgcccggcccagatacacctttcatttgcttattagtaatgttttctgagggtcctgaagctttccattaacccagatacataccctctttgagttaaaaacttctgtttacagtcacatgtcctggcagccctgacatagatgctccatggcttcccgattgcttgaaattaatcaagtaacttaacttccctgtgtctcggtttccatatctgtgtaactgtgacaatagtggtacctgccttacagtgctgtagacagtttaaagaaaataagataaaacatttacagtagtattcaggacattatgtgtgtggcaattaattttgttttcattgtttaaatgttcagcactacagtcatcatcattataaatatacttaccatggaaaatagtcttaaatctaatccaagaatgttttatccacagtcaaattaaattctaaggcattttcttcagtaactgtacacaactcttaaaatcctaatgatttgatcttaatctgtgctaaagtactcagaccttcaatcattcccatccatccctgtctaacgcattacttctcatcatccattatttaaatgttaccctataaacagttcccatgtcctgttgctgtccttctttcttatgtaatctttattctaccttgttatcttttatgttattcttgccccaggactgacaataaggaaaaactaccatcattacttgtagacttgctccagtataattttttcaggcttgttgtcttggaaatgaggactgtgtcttgcaaagaaacatattcattgggtcaatgtgttatgaaataaaagattttatctacttatgatccaataattaatttagactgacttgaacagatttttaatgacaaaaaggagaagacgatataagagaaaaatttaatacaatagaaaacacaagctaatataacacttgcttcatggatttttacatgtatattagacatatgctgggtatatgtgtgcaatgatgatctaaaaactgaatgctaagtagcttaaggaatgcctgcattacactgagtcttgcccacttttccagttatgaaaagaaagctacagcactatttgtatgagtatcaaaccttctagatgctgtgatagaggtagagaagatttactgagaccaaagccttggaagtagtagatgcttgttctatgatattatgtggttgtggttgttgttaggaaatacagtgggagtgaaagcaaggagaagatttacaagctctgctcttcctcatactcacaaccccctctagagatggacagatgttggtccaggaatctctgacacctcttagaagccttttgctctttccagaatgtttcctgacaagtattgttttgagtcacagattaggtgaaactaggtgtagaagaaaggactagagcaagggaagaagttttccatcccagacagttgtaggaacagggaaattgaatttttcatagatttatgtgatacttgtatcatgttggggagagaggcatcaaaccaggctcattactgaaagaattattatgttatttaagagagaaagaactgtgaatttcttgtcaaatagatgtttaaaattcaaagctactgatttttttttttttttttttttttggagatagaatctcactctgtcacccaggctggagtgcagtggcacaatcttggctcgctgcaacctccatctctccatttaaagcaattctcctgcctcagcctcccaagtagctgggattacaggtgtgtgccaacatacccagctaattttcatatttttagtagagacggggttttgccatgttggcccggctggtctcaaactcctgacctcaggtgatctgcctgcctcggcttcccaaagtgctggaattgtaggattgagccactgcgcctgaccctactgatgtattaatattattcatcttcttgaatacaccaagtggtaaagtgcaaatccacactttaaacttgagatttctactcctatgtgaattatactagtgaggaacaaaaaaattctctattggtggggagatgatgtttgacagcggtcagtttgtgaagcagaggcttatgtcacaggactttttacagtattacatataaacatggtgaatggcctcaaacacagaagaatcagcttttttcatgaggcatactaccaccaagaaagaactgaattgaaacctgtgactacttgatgaagggtgtataaagaagagggaaagatttgggaggccaaggcaggtggaccacgaggtcaggagatcaaaaccatcctggctaacatggtgaaaccccatttccattaaaaatacaaaaaagttagctgggcgtggtggagtcccagctactcgggaggctgaggcaggagaatggcatgaactggggagtcggaggttgcagtgagccaacattgcaccactgcactccagcctgggtgacagaacaagaatctgtctcaaaaaaaaaagaagagggaaagaaaaatgacacaaaacacaatatcataaacggaaaggaagaagtcattacacagcctacaggagtcaaaaaataaagagaggatattatgagtaatttgatgtcaactgacttgacaaaagtggtgcagggcaggttcttggcttcactcaggaaggaatgcagcgtaagctggtggtagaagaaaacagctttactgaggtggcagtgttacagctttgtgactgttcttgtgaaacagagctaccacataggcgtgccaagagcagtagcgtaggggcagttttgcactcatatttatccccacttttaatgacatgctaataaaggagtgggttattcagaaatagctagaaaatgagcaataactttcaggtgttgccatggcaatggtaaactgatatggcaatggtgggcatgtgttatggacaggtgcttccagtgtctcttccttgtgtcagccagtcttcaatctggtcctgggttgagtcccacctacctcctatctcattgctccctcagagattagatactcctccttaatcttaaggggactgcagaagagcagagtcccttttctgtaagtgcttcctgctgactttatgggggcaggccttccctagcctttgaggagtaaaaatctttggtacctgaactaaggggcccaatggcacgatgcattcatttgtggggtcagaagacagaatgggttggaagacttatgacagaccgtatcatctttacatgaaatttagaagacataaactttactaggatgttaaacaagaaaattataattggaagagagggaaaaattaatgctcctaggtccacctacggaaccatgttattaatctatgtgtttgcaaaacaacagccttaagttttctgttttataaatggaggttgtggtgtccaccttttgtggctgtaggaccttgtaagaaacagttttaatcctgggcagctgtacccaactagtggcttcctgaagcctaacagtaattaagagtaattaagaatatctgataatggctccttattctggttattattgattcttgggggatcattttgttgttgttgttgttgttgttgttgttgttttttctttgagatggagtctcgctctgttgcccaggctagagtgcagtggcacaatcttggctgggctcactggaacctctgcctccagttttcaagctattttcatgcctcagcctcctgagtggttgggattacacgcatgtaccattttcatgcctcagcctcctgagtggctgggattacacgcatgtaccaccatgcccagctaattttgtaatattagtaaagatatggttttgctatgttggcaaggatgatttcaaactcctggcctaagtgatccgcccatctcagcctcccaaagtgttgagatgaaaacatcacaggagctgatgaaaaaggaaaaggagacagcaatgatcccaggcctttttaaagggagaacaagctgaaagcagcaaaacacaacagttaaatctctaagacactaatctcagaagttttaaaagaaactcattattgtatcacaggcaaaattttttgttttacttgtttttttttttttgagatagagtctcgctttgtcacccaggctggagtgcaatagcgtgatcttggctcactgcaacctccacctcctgggtttcagccattctcctgcctcagcctcctgagtcgctagggttacaggtacatgccactgtgcctggctaatttttgtatttttagtagagacgaggttttactatgtttgccagactggtcttcaactcctgacctcaaatgatcctcccaccttggcctcccaaagtgctgggattacaggcatgggccaccatgcccagccttaaagctgtatttttattaagtaaagcgtagaagaaaaagtgtaaataaagtgacagaaggaaaacacaaggctgttatggaaaatgataaccttagggcagaaaacaagaaaaggcaaaccaagatttccatagggtgaggctccaatccacaatcctcggacgaatgtcaatgctaaaaaccttggagcatccagggagtggccaacagtactaaatgctgaaaacccagagtacacgagtatcagcctatgaatgtcccacaccaaatgccaggaaaccctggagtatccaggggctgaccagtgcagaaaatcctggagcctcagtggggtggccaacaatgagctccaaaggcccggttggggccatagaacaatgtgactctggcttcttagagtcaacagaacaggagaattcttacatccaagtgtcctgccttaaacaattgcacaaacataattagtagggacccaaagaaaaaactgcaaagcaaacacatatatcggggcagaaaataagataaaatggctgatggataaataaaatgtcattagaggagaaatgactaagagaaagatcaatgaggatgtagtcaggtgtgctatgggggacttcaaatggactatttagccaaaggccttatttcctggatcatctgatatagggaaggtgggtagatgggacacttacaggtgtgcaggagccaaaatggtgccaagcagtctctaacatgaggcctgcatgaagatctctccaggctccctagcttgggtgggttgagctcccacgggtgaactggtgcatggagcggctggcctgcatgaagcagtggctctgtggccacttacctatctgctcagctccactgcctgtcaggaaagacgatggctcttcaaacagcctttggccagtcttaacagctctgcaatgttagcaactatgtagctttaatcgctgtagcgccgatctcgccctctctcactgatcgctgacttgccacttctccaatagctgtctcgcccattgctgatcgctatgtccatcttctcacaaaatgccatctcttgctgtctcttgctgtcttgcttctccactgtttctgctgtctcaccaccacatcaaacactgcctctcaccatgtcccatttatcctccctccttattaaacatccatctgcatgtccaggcctggcatccccaggctgatgtctctgtcctgggccaggtactggagagtattgttcctccaacttcaccaataagccatggttctctcaaatcaaaccttcttagtgtgccaattttgccaagaaggtttgctgtgcactggttgccaactcacccaaatctagtgagacagaacacccatgcacaaccagttacatgaagtggattactacttacagagtcagcaagagaaagcacaaagctgcctgggcctgattgactctagaccttgcataacacaaaaggaccgcagctgagggaccctggaatgcagcccaccctgggttttgtcttagaatcacatgacacactgggctacagtgttgaaggaattcctgtttctagtagggacagaaacagaacccaggctgttctggccaatcatgccctatctcagaatgttacagttccagaacattctacagttattcctgaaaactacaatcaagaaaaggaaggagactgggttaattcgtgactaaatggaaactgttctgcaaataccacagtgaaatcaaaactcagtatttttgagactgggttatttcacttagtgtaatgtcctctagttccatccatgttgtagcatgtgtcagaatttccctttttaaaactaaataatatggaatagtatgtatattaccacatttggattaccagttccctcctttgtgaacatttgagttgcttctacatttggctactgtgaataatttgcttctgaatgtggatatacaaatatctcctcaatttaatgtcttccattacttgggtatatgtccaaaagtggaattgctgaattatatagtatttctatttttaatccttcgaggaattgccatcttgtttcccacagcaggtgggccatttacatcaccacgacagtgtccacaggagttccagttccctaaattctcaccaagactggtcaccctctgttggaaaaaaacattctaacaggcatcaggtgggttttgttttaatttttctaaggattaataatattgagcatcgtttcctatgctagttatctaaatatccccaaagtatcttctttagggaaatgtctattcatatacttttctcatttttaatcagttattttatttttactgttgacaagtagaatttatttttgtatagtagatattattaaccccttatcagatatgattttcaaatattttcttctattccacatgttgcattttcactgtgtaggttttatcttttgatgcccattttaaatttttatgtagtccaatttatttttttttctacttttgcctgtattttggtgttaaaggtgttagtatttaaatgtctgtaaatattcacttactacgctgagaatgtcacacttcaccttctctctctgatggtggagctaagagtgttacactctcccattttgtcctaggggacagtgaagctaggtgagaacccagtggcttttctgagcttatttgtcttgcgtttttggtgacatggattattgttcacatcagcttcctctggcaagtccacctggaaagcattatatttagcaagaaaaaaggaggctgtgaatgatgtcactgtaagctgtttatattccctgttgcaaatgtcaaatccgtgaagcataaagggatttactagaggatattaaattccttagaaattgttgaaaagccttaagcaacaggctccaggcaaagcctctggaacaattccaagaatggcactgctggcgcaggctggggaggagctcctgctgcctgagactccacattcaagctgtctcctgcaggaaagagagcagctcttctcactactgccccccgaaggacagctgctccgctatcaactgctagagacctgacccctttctctgcagacctgactgtgttgattacatcttcatttcagtcttatgtagattcatctgttttcatggattcaggggctatttctgcccaagtccaccctgtggctttctatcataactacacatctttctacacttgaatttctagtcattactagtatcaacagcaacatgctagaacctcacataaagatttcctttacaaagaacatcatgctccccacgtagaattgtgctccccaaaatgtggggaaagtccaatctgttcagcccaacaccatgtaggataaaaggatcttctctcatgagccgttaatctgtctacttattatttaatttgtgggctaaactataaagattggtaaaaatagcactttgaattcttttggcaaaagggtgtaaagaaaagattaaattatttaacatgactcatttcgttattgtcaccagcttctttcatatttattttattctctagtttctggcaatactttctctatggtagagtctggaaaggctactcctcatgtccttggcttcctaagtcccagatgtggtgaagaatgcccatcaactgtgctactacagagtgcttttggattgagatgagggaggagaaatggctgaactcactcaaatgtgatcattttcttggtctaggtcacagccaggcaacacagtcctctgggcacaatatcatcacttgccatgtttctatcaaaatgaaagtatctttcttgactgtggaaaacataggggtgggggcggggagggtcaagtaatagcaaaaggagtacttggagttgcctgagctgccactctggtttccccaaatgttttcaatccatttcattcatgataataaacacctttctgcctaaccagtcataatgacttttctcagatccaactgattcagtgataaacctatagagaaaaaataaatacacttctccatgtttgagctgaccaggatgctgtccctggtgtttgcacctccatatcccactatgcgtttcatcttctctttgcctcactggtgatccaagtacagggaatgcttcacatgactgtgatccctagaacttcatcctgatgacggttgaaatcttctctgagttttaccagtggaaatggcaataaatagaaacattccagaaggtcccctaggttccatattttctgtacttcctctctaaaatatgtaaaatcaattatgtttgctcttgcttttatggactatatctatggccccagcacacatcctaatgtcctgtcttgacaatttatccagtattttaataaatgtaaatggtcacatgcttatcatatcatttcttccaatttcatggaataatttcacatcaactctttggattaagagccgtcaaccagaaaaccacagccctgaataaatagaaatagagtatttcaagctgttcatttggcataacaatgatgagtctacagctcattttcaagatataaatattctgtttatgggagtgacagcaccattcatacagttactgtttcagagcctccaccatatctgacaggacagcaattcaatagcagaagggtttgtgtgccagctttgcttgactaataacgggtttttctctgtccatagggaaagcacatgacaagagcatgagctacacttcacttcactttttttgaggttaataagttgcttgatccaaagctatattacagaagaacttcctgactctgatgaaagctcttggaaaatcctcaaataatattttatgcagaaatataaccaaaaaggaaggcaaattcatatataggaaaataaccagtgccctcctcacgttacatgaggtctactagtatcacccgacaccagctgttagtctgggccctgatgtgtggcgcaatgttaggggttcaagagacgttattcttcttgacaaaataggtgttcagaagagccagtagccctgtatgtctcagttagttgaaactcatattattgagtccccacagggacctccataaccttggttcaggagacaccttggaaacctgggaaaggtgattgactgaagtccatctgttgaatcatcctcattattaaaagcctcctactcattaacggcatttcgattaatattcacttggaaagcatgtttttattttggctcatttttgaaacgtctagtcatagttctttctgaatcactttgtctgaaatcatcctgttgcatttcttttaagggctgatgatctgtcaaaagcaacagccaatattattacattgctgttctctttgcaatgttatcatcagatgtaatccttgcaggttaaccactgttacgaattttacatttccagggatttcttgacaatggcactgatgtgacgccatccagcatctatttgtgagaactctatttgacaaatcatcactgtgggtgtgaacataatggagactttcataggatgctatggttaatattcaactttagtcaaaatttactctagtcctacccttggagctctactgggtttgaaaaatattttagataaggacaatcatttcatagagttttaaaaataaaggctaaaagaaattttctgtagcaacagtatgaactatatgtagccagcatacccttttttaatggaatataacaaaaattatttaaatgtatttaatttaaataattgtataaatatgcatatataataaataaacgtacttaaatataaatactatacatgtatatttgtagccaacatttcatcagataaatataggtagcttttatgtatcttatacacatatatgcacattttccacaaataaggtaaattttaattttttattgaatactagttttaattttgtcattaattttctcttaataacttcataatttaatactaaatgttcacatttataccaccaacttaagaaaaaaatcgtgtgtgtaggtagaggtgtaaatactgtatcaggaaggctttatgcataatgattggtaactggttaaatacacaactcagtggctgataacagtaaacatttgttttcgtgttcatggatgttcacgttcacaatcatctggctgatcaagaaagggctcagctgagtggtttctctgcagggcactgagctcatcttcagcctacagatatgaattgtctgaggacgaggctgaacagcagtgactacacatgacacaatattcttatggcaggtcacaggagtgaacaacatcccaaaccaaactgcacagttgaatttaagtccaataatttctaacatagcttcacatattttaaatatattcctttatttcaatgagtacaaattttgaagaaaatgtttactccatttaattgtagaggtgtttgatcattccatggacaaataattatgctttcaacctttacaattctgaaaagatttgcaaatgtaaatttgcattagtaagaaaataaagctggatgtgttttcaacatgtggctttaaatatatatatatattttaatggcctcagtgggggaaaatcattttaacttatgtaaatatccctttttgcctctcttgtgtcctataaagttgcccaacaagaggtcctcccatgagatttggaaatcagaaaaggatgactcaatattctccattggtacctaaggcagacacaggaacagaggtgagggctggagaaacacctagaaggatgctgcaggaagctgagaacatcaacactcccacccctaaacttccagacaggactgaggaccacatggttagatagcccatacttcaagggcagatgctttctgttttctgagtgagcgccattcaatcctgcttctaatatcaactttcctgactactatatccttggctttgaaaggttgtggtctgaacgttaatcataggcattggttcattcttgttatacccaaaagagccaagaaacccagtggggaaaggcactcagggtgtaaaatattgtttctagaatgcaattgaaataggccctgttatcccatggaactaaggtttatggttttttgaataaacagaaattgactcccccagtcttaaaactcaagatagttacatttgtcttatctgagttcttttttcagtaaaccaaccatcagggctcccagatactatcaaggagctgaaacatacatatcactgaatccggacactgagacatcagaaccttcacccattatgattgcataactgacctcttgcttcctgttgaccaaattatcttccttacccaccccccaaattcctgttttcccacatttcgtccctgttatataaactcttaattgtagttgatcagggagatacattcgcaaatggtgtcccatctccacggctgcagtacctgattaaagcctgtttcttggcaatacttgttttagagattgactttctgtgtggtgagcagcagggtgtacactgaatccctggcattttagtaagaaaattctctgcaaccttcactgctttggcttcttgtaacctgaattcacatttaactgcaacttctgagataacttgatataattctaggattcactttgtccaccactgcttcccagtctgagcttgccagctcccaacccttactagtgccagtgaactttctcaaaatgcaaaaggtaatattttccctttttcataaaacactaaccttctcttcgtacttccaatatattgaagaccactgagttttcctgtgtgtccaatttggcaaacatttctttgcaaataaaacattaaatttagagattctgctctacattttatttagacttcagtagtttagactctaattttctgtattaagacaattcctgcttagaatatctatagtggtttcttctctgttatttgaattccaaccaaagccctaaactagactccttaggtgtcaagatctctgcctttattacatcaggagaggcattgctatgtctgtgcagctggggcttacaaagcaaaaggaattgggttgcagaggtgatttcaggtccccctctaccaataccatcagagtgtggctgcatctgaggaacactctcaggcaatgaaggaatcaggaggagcagctggggcagcccagccttacacatctgcttccctgggggtttttgttcgggtgtgtaacactgtgggagggaaactataatactgttgacagtaataagttgcaaaatcttcagactgcaggcagctgatggtgagagtgaaatctgtcccagatccactgccactgaaccttgatgggaccccactttgcaaagtggatgcagcatagatcaggagctcaggggctttccctggtttttgctgataccaggctaaataactgctaatgccctgactcatccgacaactgatggtgactctgtctcctgtagatgcagagagtaaggatggagactgggtcatccagatgacacatctggcacctgagattggaaacataaaaacaaatatccatacaattaatcatgtagtaagagaatttccctgaagggccaggctgtactgagcacattggctgagtaaattcctagtgttctccttccttacctgggagccagagcagcaggagccccaggagctgagcggggaccctcatgtccatgctgtgtcctgactgggtctgactcctgcatgaagtgtggccagcctattaataaggcttcagtgcaggaggttgtgctctgggaacatgcaaatgagcaggggatggggctgactgggcacagctgcagagctggctcatctcagtaactcagcaccagctcagtgtccccaggtgtcccaggaaagaccagggtagcacaaatttgtctgcagtgaatgtgtttctactggagagtagtttgttatgagaaacattttttatgtatttttttgaaaatttgaaatattcctcaggagtcgacggagtaatgtatttcattggtgtatggggattatttagaatatcttgtttgtaggaaatacatagtaaaatgttaaacagtatgattctcaggacttcaaaagactctcatatgattcgggttagggaaggaggtactttgtcctatacttgcaacatttctgtgagctttaacattgttcctttctaaaaatattaaaaataaaatttattgacatgatgctatacatatttgtaagtattaggtaatggtgttatgccattgttcttatcactataagatcaagcaatttactacagatacagagagatgataccgagtttcctcaatgcatgcagcactcacacatccaccattatcaagagctacaggtctctttaatacccagagactaaattcacttcaccttattcttgttttgggcaccttcattgtctaccttcttttctgtcattgagtattactttccaaagttcttctctcttattgagggtgaccactgcatggagcatgtccctgtcatgcaccaacaatgccactttcttcttttacgttttatcagggacatcatcctgacccagacaccagcctccctgttaacatctttaggaaagagacaatcccttatcaagcaattgccaacttacatggagaaatcagctggatccatatgaacctggacatggatttgcactcattatatctcacatctctactgtgccaaaaatgtcccagcctggcttagtagcaggggacgtggatccaactacatcagcatcagtgggctgcagcctaggactccacaaaattttactgatgcctgactaggggagacaaatcacagtgctgtagcccaagcacaaaccttcctgctgttttgtaagccacctgaattttaagggaacttgcttatattgggagaaaggaagaaagctccatttgtcctctaaatgtttgctgaaaatgaactgacaaaagaaagactaataagagaaaaggcaagcaaaattcacttaaagtgcagtgggatatcataacggtgtgattactcagataactcaatgagatccagtttttcatacttcctttctagcgaagaggtaattgggaagtgtaggcaacctggagagaatagatgaggatagaagtgcatcctcaaaagaacaggcctgtctggataaaacatcaacttctaatctcttctatttttgattcctattttgtgttaatcttccctgatataaaatttcccaggaagaattttcttgacaatcagtttccttctggagaagctgcttttaagcagataaaggagtgagataaaggagtggagtgagcataccccaacagctaaaactcacaagttagaggatttataagtcagactctaagtctcagattttgtaccgctctcttgcttcataaaaatactttgttattttttaaattttactttaaagaaggacaattttggagaatatattaatttttggtggaatgaataatgtccccaccccaaaagatatccaggtcctcgtctctggaacccaagttttataggagttattaagaaattattttaggcagatagagaggaaaaggcatccttggtaagattttgtttcttttaaagcaactccagacatgtttcttgtctaataggaaagctccggctcttagagccaggctggcaagatttgatatgcaaatgaaggccattagaaactgggtccaccctaacatggctattcctaccttcttcttccttacccctacatgtgcctggcaacatggctgcccccacatatccccatgtgcgtagaacattatgatgccctacatgtgcatattgaaaggctagggtgggagggccagtttttgctcaggctatgtgaataacatgcctggtcaaaccaatcccttgagccctttgcaaatcagacaccacctccttcattctcctcatataagcagccacttttccaccacagatggacttttctctttgttggaatcccctgtccctctgtctctgtacagggtagctgtttagccattttattattccttccttcttacgtattaaacttttctctccttaaaaccactacacatctttctgtggcattttatccaaagcagtgtgagacagaaagaaccctgctgttcctccagtcattggagccatatcataaggattctaccttatgatagatagcaaaaaatgaccttgatagatgtaagttaaggactttgagaataagcttcctggttatccagatgaaatcaatacaatcacaaaggtccttaaaatagaggaggaagattgcagtcagggaggagctgggacaatggggacggatgttgtttgaggaaggaaggggccatggaaccagaaatatgggagcacattgaagataagaagcagagaatccagttctctcctctggagcctccagaaggattacagccctactgacaccttagcattagctcagtgagacttctgacctgcagaactacagggtaatacatttatgttgtgtgaagccaataagactgtggcaatttaaacagcagcgttggaaactaatgcaaggggaagaggtgtctttcagctcactgagtgcgtggctgtcctctgttcttggaaatatttccaccttgttatctggtgtcagacaagagacagagaaaattttttttctgagagaagagctcgtacaaaaattctttttagctagaaattctcttgggaaaatcccatgattatctcttatacgatctgggtatcacggagtttaggggtcagaactcacagcacatgataggaagaagagggttttgttagtttgttttcatattaggagggaaaattagattttcaggacacaatctgagagggacagactgagtcagagctattgtaagagaaagaggagatgtggaaggagtcagagcaatgaaacatgtgtccctgcttccaaatctaaaataaagtcattgattttagaaggtgaagcaaagctcttcaccttccatcttcttatgaaggatcaaattctacccagagttcctgtccctcctttactcccctgacattgcattgtggagctaatcacatgtgccttaatccctgctcctgtcccgggctgggagaggctcactgtcctcaccatgcccagcaggctagagctcatgccctaggtaccaaaggagaagaggatggtttctgtacaggaggtaagagctttaccacatgttacatttcactataattctaagtaaagttgtgtggagagaagagaacatatgggcaactctgtctggtagagttggaagagggcagtttctgagagtgacaatgaattcacatttctaaattttcagatggcaaatgctagctttagcaattgtggaaatgtggactttgagtttaagaacaagacagactttcagatactgcaataaatgaggagacatttggaatagggtccttagcccagggctaaggtcaggctggcagtgcctgagagctgccaggcactggccctgggctgtggaggaagcagctgctctcctgagccacagggctgagaatctgagaggaaccacaggccctggccacatggctgcctggcaggggcttcagggaaggaaactgctcacaaattcaggggagctgcattaagcatatatcccccagcctggcaagagtaaaagtctcagagacccagaccttagggctggtgctgggatcctgggctggctgctgtcagctctgccctccctcgtgctaaatgactgggaccctgctggagccaaaaacagacagtcagcaaatgtccttaaagtctttactcagccagactctattctgcttggtaagaaaagaaacacacgctacacaaataagcataaaattatatgtatctgtaatatgaatttctattgtgaactttacatattgaatacatatttaagaaataagttgtatttatatatttgtatatactacgtatttatgaataaatatgtgatgcatgtttatatataaagagatacaactttggttgctagtatatggtacagttttaaacttcaataaattgaacatgaacattgaaaatgagcactgggtgcaccacctcatggccctcctcactccagggcctgagggtcataaagctcaggaccctcttccatgttccccctgggctgagagaagtgaactgcccattgctgaggatcatgagtgacctgaggggggtctacggaatcacagagcagcagatgcccaggaaatggatagtgggtctgggccctgaatggagggacgttttgtttccagagctcagcatagacaagtcctcctctgaaaagccttaaggaacatgctcctggcaaagcctctagaacaattccaagaatggcactgctggtgcaggctggggaggagctcctgctgcctgagactccacattcaagctgtctcctgcagaaaacagagcagctcttctcactactgcccccagaaggacagccgctctgctattgactactagaaaactgacccctttctctgcagacctgcctgtgctgattacatcttcatgtcagtctcacatagattcatctgttttcaaggctacagggtttatttctgcccaagtccatcctgtggctttctatcataaatgcacatctttgtacacttgaatttccaggcattactagtatcaaccacaacaggctacaatctaaaataaatattttctttacaaagaacatcatgctccccacgtagcattgtgctccccaaaatgtggggaatctccaatctgttcagcccaacaccttccaggaaaaaatgatcttctctcatgagccattaatctgtgtacatattatttaatatgtggtctatattataaaggtggctaaaaatagcactttgatttttttaaagaaagggtgtattgaaaagactaaattatttaacatacatatatgaatggctcatttcgttattgtcaccagcttcttctgtatttattttattctctagtttctggcaataatttctctatggtagagtctggaaaggctattcctcatgtccttggcttcctaagtcccataggtggtgaagaatgcccatcagatgtgttactacagagtgcttttggattgagatgagggaggggaagtgcctgatctcactcaaatgtactcaatttcctggtctgggtcacagccaggcagcacagtcttgtgggcacagtatcttcacttgccatgtttctatcaaaatgagagtatcttccttcactgtggaaaacaaggggtgggcagggtgagggaatagcaaagggagtacttggagatccctaagctgccactggtttctccaaatgttttcaatccatttaattcatgataataaacacctttctacctaaccagtcataatcgcttttctcagatccaactgattcagtgataaatctaaagagaaaaaataaatacacttttccacgtttaagctgaccaggaatgtttccacctccatatcccactatgcgtttcatcttccctttgcctcactggcgatccaagtgcaagtaatgcttcacatgactgtgatccctagaacttctacctgatgactgttgacgtcttctctgagttttaccagtggaaatggcaataaatagaaacattccagaaggtcccctagggtgcatattttctgtacttcctctctaagatatgtaaaatcaattctatttgctcttgctttatatgaactagacctatggccccagcaaacaaactaacaccctgtgttgacaacttatccagtattgtattaagtctaaatgttcacatgcttatatcatttcttacaatttcttgggataattgtcatgtcaactctttggattaagaatcatcaaccaggccaggcgtggtggctcatgcctgtaatcccagcactttgggaggcagaggcaggcagatcacgaggtcaagagatcaagaccttcctggcccacatgttgaaaccccgtttgtagtaaaaatacaaaaattagctgggctacaggtggtgtaccccctgtagtcccagctactcgggaggctgaggcaggagaatagcttaaacctgggaggcagaggttacggtgaagccgagatggcgccattgcactccagcctggcagcagagtgagagtccgtcttaaaaaaaaaaaagaaccatcaaccagaaaaccacagccctgagaaaacagaaatagagtatttcaagctgttcagttggcgttaacaatggtaagtctacagctcattttcaagatatatatattctgtttaagggagtaaaagcacccatcacagttaatgtttcagagcctccaccacttctgatggtatagtaattcaacagcacaagggtttgtgtgacagctttgcttgactaataatgggtttttccctgtctatagggaaagttgcacctgtgcacaagacaagatcataagctacacttcgctcttcttttttgaggtaaataacttgcttgatccaaagccattttatggaagaatttcctgattctgatgaaagcacttggaaaatcctcaaataatattttatgcagaaacataaccgataataatggcaaattcatatataggaaaataaccagtgctttccttatgttacatgaggtccactagtatcacctaatacaagctgttagtctgagccctgatgtatcatacaatgttaggggttcttcttgacaaattagatgttcagaaaagccggtagccctgtaggtctcagttagttgaaagtcatattattgagtccccacagggacctccataacattggttcatgatactccctggggaagctgggaaagctgactgactgaagtccatgtgttgaatcatcctcattattaaaagccccctgctcattaatggcattttgattaatactcacttggaaaacatttttttggattgtggctcatttttgaaacatctcatcatagctcttccagaatggctttgtctgcaatcatcctgttgtgtttcttttaaggcctgatgatctgtcaaaaccaacagccaatattattaaaatcctcttctctttgcaatgggatcatcagatgtaaccttacagattacccacggttaggatttttacatttccagggcttccttgacaatggcactgatgtgactccatccagcatccattgttgtgaggactctatttggcatatcatcattgtgggcatgaacttaatggagattttcataggatgcaatggttaatattcaacgttagtcaaaatttcttctagtcctacccttggagctctactgggttggaaaaatattttcgtgtaaggacaaccatttggtagagttttaaaaataaaggctaccaataaattttctgtagcaagagtatgaactatttgtggtccagaatacaattttttatggaatgtaacaaaaattatttaaatgtattcaatgtagataataattttacaaataggcttatattgcatatataatagaagaaacacaattaaacataaatactatatatattgtagccattttaacaaatatatatttacttgtacatatcttacatacatttatgcacatttttccacaaataaggtaaattttaattttttattgaaatattagttttaattttgtcattaattttcttttaataactttataatttgattactaaatattcacatttataccaccaatttaagaaaaaatacatgtgtgtatatataggtagaggtgtaaatactgtatcaggaagcttttatgcattaatgattggtaactggctaaatacacaactcagtgacagaaaacagtaaacatgttttcatgttcatgggtgctcatgttcacaatcatctggccgatcaaggaagggctcaggtaagtggtttctctgcatggcactgagctggtcttcagcctatacatattaattgtctcaggacaaggctgaacggcagtgactacccatgactcaagattcttctggcaggtcacaagagtgaacaacatcccaaaccaaactgcacagttgagtttaagtccaataatttctaacatagcttcacacattttaaatatattcctttatttcagtgagtacaaatttttaagaaaatgttcactccacttaattatagaggtgtttgatcatccatggacaaataactatgattccaacttacagtattgaaaatatttgcaaatgtaaatttgcattaataagaaactgaagctggatgtgttttcaacacgtggctttaaatataatatacttaaatggcctcatgggagaaaattcattttaacttacataaatatccctttttgcctctcttttgtcccatagagttgcccaataagaggtccttccatgagatttggaagtcagaaaaggatgactcaatattctccattggtacctaagacgtctagacacagggacagggatgaggactggagaaacacctggaaagatgctgtaggaagctgagagcatcagcacccccgcccctaagcttccagacaggactgagggccacatggttagatagcccatactttaggggcagatggattctgttttctgaggaagcaccagagaatcctgcttctattatcagctttcgtgactactatatccttggctttgaaaggttgcagtgtgaacgttaattgtaggaattgggtcattcttgacatacccaacagagccaagaaaccagtggggaaagacactcagggtgtaaaatattgtctgaagaatgcaattgaaataggccctattatcccatggaagtaatgtttatggttttttgaataaacatagaaattgacttccccagtcttaaaactcaagatagttacatttgtcttatctgagttcttttttcaggaaagccaccaagaggcctccagatactatcagagagctgaaacttacatatcactgaatcaggacagtgagacgtcagacccttcacacactgtgattgcctcactgaccttctgctccctgttgacaaaattaacttcattacccctctctaattcctgtttgcccacatttcttccctgctatataaccccctaattttagtttgtcagggagatacatttgagaatggggtcccatttcctcagctgcagcacctgattaaagcctgtttcttggcaatacttgttgtcttactgattggttttatatgtggtgagcagcaggatctacaccaaatccctcgcacttcagtaacaagattctctgcaagcttcactgctttggcctcttgtaacctgaaatcaaattcacctccaacttctgaataatttaacataattctaggattcagtttgtccatcagtgcttaccattctgagcttgccagctcccaaaactttctggagccaataaactttctcaaagagcaataggtaacattttccttttttcatgaaactctaagcttctctttgttctttcaacatattgaagaccattgagtttttctgtatgccccatttagcaaatatttcttagcaaataaaacatgaaatttgagattcatctctatatttttatttagacttccatggtttatactctatttctctgtatcaagacaattcctgcttagaatatctatagtggcttcttctctgttacttgaattccaagtgaagccataaactagactcctcaggtgtcatgatccctgccttttttaaatcaggagaggaactgttatgtctgtgcacctggtgctaagaaagaaaaagaaattgggatgcagaggtgacttcacatccccctctaccaacaccatcagagtgtggctgcatctgaggaacactcttagccgatggagacatcaggaggagcagctggggcagcccagcctcacacatctctttccctgggggtttttgtttgggtgtgtaacactgtgggaggggtactataatactgttgacagtaataagttgcaaaatcttcaggctgcaggctgctgatggtgagagtgtaatccgtcccagatccactgccgctgaaccttgatgggaccccactttgcaaactggatgcataatagatgaagagcttaggggcttttgctggtttttgctgataccaggctaaataactgctaatgccctgactggcccagcaagtgatggtgactctgtctcctacagatgcagacagggagaatggagactgggtcatccggatggcacatctggcacctgagattggaaatataaacacaaatgtccatacaattaatcatgttgtaagagaacttccctcaagagccaggctgtacggaacacactgggctgagtaaactgctagggttctccttccttacctgggaaccagagcagcaggagccccaggcgctgagcgggcaccctcatgtccatgctgtgtcctgactgggtctgactcctgcatgaagtgtgaccagcgcattaataagtcttcagggtaggaggatgtgctctgggaacatgcaaattagcagggggcaaggcaggctgggcacagctgcagggctggttcatctcagtaactcagcaccagctcagtgtccccaggtgtcccagaaaagaccagggtagcacaaatttgtctgcagtgatgtgttctactttggactattttgttatgagaagtattttttaggtattttttgacaatttgaaatattcctcaggagtcgaaggagtaatgtgtttcattggtgtatggggattatttaggagaatattcttgtttgtaggaaatacatagtaaaatgttaaacggtactattctcaggtcttcaaaggactctcacatgattccgcggttaggcaagggggtactttgtgctacatttgcaacattactgtgagtttaacattgtttctttctaaaaaaaaattaaaaataaaatttattgacatgatgctatatatatttgtaagtattaggtaatggtattatgccattgttcttaccactataagatcaagcaatttactacagatacacagagatgataccgtgtttcctcaatgcatgcagcactcacacatccaccattatcaagagctacaggtctttttaataccagagactaaatgcgctgcaccgtattcttgttttgggcaccttcatagtctaccttcttttctgtcattgagtatcttttcctaaagtttatctctcttagtgaggtcggccactgcacagagcatgtccctgccatgcaccatcaatgacactttcctcttttacattttatcagtgactggggacatcatcatgacccagacaccagcctgcttgttaccatttttaggaaagagacagtcaatctcttatcaagcaatttcccatgtacatggagaaatcagttggatccagatgaaactggacacgattttcactcgttatatctcacatctctaatgtgccaaaaatgtcccagcctggctcagtagcaggggaagtggatccaactacatcagcatcagtgggctacagtctagggctccacaaaattttactgatgcctgactaggggagcaaaatcacagtgctgtagcccatgcacaaaccttcctgctgctttgcaagcgatctgaattttaagggaacttgcttatattgggagaaaggaagaaagttccatttatcctctaaatgtttgctgaaaataaactgacaaaagaaagattaataagagaaaaggcaaacaaaattcacttaaagtgcagtggaatatcacagcagggtgattacccagataactcaatgagattcaggtgtttatatttcctttctatagaattgggaagtgtaggcaacctagagaaaatagatgagaatagaagtgcatcctcaaaagaacaggtaacagcctgcctggataaagtatcaacttccagtctcttctatttttaattcctgttttgtgttaatcttccttgatatacaaattctcaggaagaatcttcttgacaattggtttccttctggtgaatctgcttttagtcagataagggatatttaggagaagcctttttgtgcatttgctgctttctcaatgcctttggttttatataatcatcataccaatgcagcatactttgggatattattttctggattcttttacttgcaacccacatgccaaaatcctgttccagagagatgcagctacagattgaaagagcagttgacccctgaacaacgtggaggttggggcactgaccactggtgcagttgaaaacctgtgtagaacttttgctttcctaactaagaactaatagcttacttttgactggaagacccagtgataaaataaacagttgattaacagtttttaaaagttatttatattatatactctattcttccaataaagtatgctaaagaaaaaatgttattgagaaaaccataaaaattagaaaatatgtttacaacttactaagagcttgctcacaggtgacacacatagaagaaaatataggtgggtctgcaaatttcaaacctaatttattcaagggttaactgtaccatgatgaatgtagcagtccccatctgtagtgtagggctttcccctttgctgtacctctgctcacttccaatgaccatatatatgtcttatgtcctttacagtcttgggcaaagagctctgccttcatgcattgctggccaaatggcctggaatgtgtatctcttatgaaactgttatggtttgactgtgtcctctagaatcaatctgttgtgaagttaattctcagtgtaacggtattgccaggtggggcctattggggtgtgtttaggtcatgggtgtggtgccctctagtggaatacattaatgccaatataaacagggattatgggactgggatctctctctctctctcttctgcttgtctgtcatgataagagatggccttcctggctttgaaggactcaaccctccaggcatcatcttgaaagcagagaaagcagaccttatcctgcctatgccttgatcttaaatttcctattctccagaagtgtgaggaaatacatttctgttatttatgaattacacagtgacaaggaatctgttatagcagcttgaaagagaacaagagagacagctcacaatcagtgaggacacgatgaggtgtatacataccccagcttcctcatctctcaggtggaatagcccagaggaatttaatctatgttttcacatgtggttgaccttcagttatcctgagtcaggtgggttgttgatgtgtcttttaccattcatcttctgttccctccctcactttcctcctttcctcccagtgtaaatttgctgcctaaacaggaatcctcattgctggtggacccaaactaagacagtttaaaaaaaaaatcattattcttttgtatgaggggtatttctcatctgaattcttatcatttcattttctttgacatttggaatattcaggaagcacttaatttttctttaccaatttattttagattggatttatgccatgattttttttttctgtgtgttaaaaccaaaaattaagttgtaggccaccaaccaggtgaatggactcctcttttggcagagagaacttcaaagaaatctgaaaaactaggttaggccatgactggcaggtaggtttagatgtgcctcattatgctcttctccctttggagttcagacacaactgaccagcattatcactactacagagatctttggactgacaaaacagatgctttatagcaataagataccatactccaacatgacagataatagcccctaaagaaaatctaaatattttatcctaaaattatttctttgacatattctgcagtggccctgcaaagctgcctgttgtggggggaaatttgcattctgcagagaaactcctcccattactatgtcttttccaaagagtctgactttttttaaaggtctgataagcaacattcaccatctactttatctgctacccacaggattcatctatgtgacaagaatcttggcttccacaccccattatctaaactcaagcatttctttatgatgaattcaactccttaggcagactttaactctttcaactagtggcccatcaggaaagctttgaatccacctatgacctggaagcccctgcttcaagatatcccacctttccaagacaaacttatgtatatctgatatgtattgatttatgtctttgcctgaatttctgtgtctccctaaggcgtataaaaccaatgtgtaatccaaccaccttgggcacgtgtttgcggagcctcctaatgttgtgtcacaggccataagccttatctttggcaaaataaatctataacttgattgagacctttctcagatactgttttgtttacactgggtcacaaaatttaaaaatcctctaaaattatctacacatcaataaatctacattagcaacagtggagtgagcacactccaacagataaaactcacaagttacaggaacctgagtctaagattttgtccacctctcttgattcataaaaatactttgtgattttttaaattttactttagagaaggacaattttggggaatatgtttattgttggtgggatgaataatgtccccaccccgagagatgtccatgtcctcatctctggaacccaagtgttataggagttattaagaaattattgtaggcagatagagaggaaaaggggtgcttgtgaaggttttgttatgtttaaagcagctctagaaagatttcttgtctagcaggaaaacactggctcttagatccaggctggcaagctttcatatgtaaatgcccgccattagaaactgggttcacccaaacatggtgattcccaccatcttcttccttgtccccacataggcctggcaacatggctgtccctatatatccccatgtgtgtagaacattatggtgccctgcaattgcatattaaaaggctagggtgggagggccagttttttctgcaggctacctgaatgacatgcctggtcataccaatcccctgagccctatgcaaatcagacaccaccttctccagcctccttatataaggagccacttttccgcagcacatggggttttccctttgttcgaatcccctgtccctctgtctctgtatggggaagctattttcatcttccttcgtacttgtgtattaaacttttctctccttaaaaccactccactcatgtttgtgtcattttatccaaactggcgtgagaccaagaaccctggtgttcctccagtcatcggagccttatcataaggattcttccttacatagtgaaaaaagaacttgacagatggaagttaaggactttgagaataagcaacctggttatccagattaaataaataaaacccccaaggtccttaaaatagaggaggaggcttgcagtcagagaggagctgggacaatggggaaggatgtggtttgaagaaggaaggggccatggaaccagaaatgtgggagcacctggaagataagaagcagaggatccagttctctcctctggagcctctagaagaattacagccctactgacaccttaacattagctcagtgagacttctgacccccagaactacagggtaatacacttatgttgtgtgaagccaataagaccgtggcgatttaaacagcagcgttggaaactaatgcatgaggaagagatgtctttcacctcaccaagtgcatgcttgtcctctgttcttggaaatatttttaccttgtcttctggtgtcaattatgacacatcttctagtatttaaagatctgctaccctaaaattctatttccagtaaaagtattatttagaaatgaaggtcaaattgagaagtcctcagctgtagaaaaactaagagtattggctgctagcagatccactttaagcatagccaaaatgattcctaggaaggtaaaactaaagatcaagaggggatattaaataatttagggacaaaaggctatgaaaatgagaagagagatgaatataatgcatttctaaatcatatgtgatatttgtatcaaagttgtaacacagttttgttcccaatatttgcagagaaattacttttaaaaaaccacctatttacaatgggggaggaaaaatgatataaaagaaggtaaaagtctatatttattttaaatggtaatatattgacaccaatgtactatgagaagctgtgcatataaaggcaatataccatgacaaccaatttaaaaatcactataaaaagagataccccaaaattaggtaaaattaaaatgaaattgtaaaaatgttcaagtaacccaaaggaaggcagcaaaaagaaaacagagaagcaaaaaaagatacagcaaaaaagtagagtgcagacttaaatcttaatatatcaataattactgatatattaaatacgtaaattatgaaatttttaaaaagacaacagttggtgaatcaaaaagaaatgttccaactgtatattgtctataagacactcacatcaaatacagcaatataagtagattgaatataataggaaggaaaatggtatactatgcaaacattaatcaaaagaaagaatcattagcaaatactattaacagacaaagtagactatagagccaaagaattttaccagggatagaaagttacattacataatgaagaaagtcattttggaaagaagacagagcagttctaagtgcgtagacaccaagcaacagagcaatacagtgcatgtggcagaaactaacagaacaattacacttggagatttcaaaaccccttcttaatctttgataggacaactcgacagaaaatcggccaggatagagaagaactcaacaatatcatcaacccatgggatctaactggcatttatagaacactccaacccataacaatagaagttcacatttctttcttccaagtgcccacagaacatataccaagataggacatattctgcccacataacgtttcaacacaattgcaataattaaaatcacagtaagtgtgttctctgaccacggaaggatcaaactagaaatcaatattgaaagtataaccccgaattcttcaaatatatggaacttatacaacactgttctttccaaagaatcagcctttgatttgcttggtgtttagtgttgctttttctgtttgcagttttattggtttctgccctaatatttattatatattttgctcacgttctacttcagatttaaattgctcctctttatgtagtttcataaggtgggagctgtgattattgattttatgccttttattttttgaaaaacacttctatgcatatgttaatatatgtgcatacacacgcataaatatgtgcaggtgcatatgcatacatgtggctttattacataaattaccctgtaagcgctgctgaatacctatgtgtattttctttcctctgagctcaaactccactcacttgcaaacctggccacttaatctgcatgtttattagcatctcaatctagaattgaacaaaaataacaaactccttttattttatcctgattttcttggctgctaatacatttaacatcagtaaatcagaatctatctaatagattaagtccaaagctgccaggccactcctaatctgactcttctcacataaaggagtataaatgacattaatttaaaaatatgatatcatctgcttatgtctccaataatcttcactgcccccagactagtttatgccagggttcactttgcccagatgagtatctcttctccttctcacagcccaactggagtcattactctgctaaaaaataaatatgaccatgggagtactttgctttaaaaaattcacagaatgtcctgctgtacttagaaagcatttgctcctcaaacagaaaatgaaggcgtccttcatttcacatccgtcatatgtggtgatctttaagatactgggagaaaacagctctgacctgccccctctcagactttctcttttttcacttggttaagtcactctcctcatagtgactttctatgtccttcccgtgttcatactgtgttcctcctaagagccttgattgtcatgaacctcgatgcccttcagaaacttctcttcaggtcagttcttctcctcatccaggccagtcacctcctcagaggaagcagcctctgcctccccaactaactgactccatttccttattaaccacttcctcttcccttgccatttttttttcctttatgatccttatccttttctagaatcttcctgttgatttatgtttaattaaacatggccttttttttttcaccagaaaagatataggtaaatgagagtcagacactgactttctcagggatgcagcctacacacattcctggtccagcataattgctcaatttatactttactgaatgaatgaatgaatgaaaatttaatgagtaagaaactctcaaagacataatcaacactcataacctatacacattgaaaacaacccactgaatgtacaacatggattattctgagtaatgagaagtatgaacagcagtgtgctgctcttcatagtcagaaagaatgagaggaaattgaagaaaggaattgttttctcagctgcattttgcatttgccagagagttaagaaagacatccaaagtccatgataatcaggtatgaggattcttatctgccttaaaaaacaagcaaataggctttgcaatcacaaaaaaaaatgcaataaatgtgactaccctatcacttaactctattgcctcctgttcacaaaaacagattgtattagttagctcttcttgcaaaacaaaccagctccaaacacaatgccataaaatgagcatgtacagtcttccctcagtatgcatgggaaataggttccaggacaccctgcagacattccaatttttggagactcaaaacctttatgtaaaataagcaatatttgtatataacatacacatatcctcctgtacacttcacaccacctctagcctacttataatactaatacatgacttaacttgtgtggattcattcaagtggtactcagcacatggcaaagtcaagttttgctttttggaattttgtggatgttttttctaaatatttttgatccaggtttagttgaatccatagatgcagatcccatggacagagggctgactgtattgctccttataattctgagggtcagctctgcggttcttccatattgggctggctgtagcctctggttcagttgtgactggagggtctgatgtgacttctttaacttatctagaagctggttcgatgtacaggttggacaacacttggtatcagtttacatgggtcagggagatgggtcctgttctccaacctctattaggtttgttcccagatcaactcgggggttcaagtctattcattgtgggttgtttgggagaaattccacacagaccgttggtaatgactaagctgaactgctgtcatttattgctgtcagcagttattgttatcctctgaaatgcatcttatataatcaaggtctccccagggtggctgaacagtgcatctcagctcagcccatccagtcacttccctggatgcctgcaggtgtgagaaaggcaatatgctcagtcacaggaaaggcaggggcccaccctcgtgctgaaacctgcatacacagctttcacacagtttcgttccaaaatacaaaaacttcattttctttatacttaaaatagttatacaatttctttctataatgtccccatgtttttttaaataatttgaatgttcagaactggatatatttattatttctgtgttaggtgatcttagtcacttatggcaagagtgagttaatagagacaagatacggattagccatggaacaatacagaagtgtgtggattcagataggataaagctcaaaggggtgacaagtaaattcttttgcagaaacagattctcatagatcaccactagttaaggtccacattcaaggtgcgatgatgcgtcagccacattttgtaaatggtcagctctgcagagtaaacttggccagcacattgcaggaccaaaactaccgataaaggtatggggaagataaaccatcacagaaataatagtttgaaggagttctcagttatttatacttggatgttcagcagaacgctacaatgaatgaagctacaacctaaaaattttaaaccttttaaagaggtttcccttttttcagggtgtttctcagcaaataatcacaaaaaatttgtggataaactacttgaacaattggctgcaataaatcccttccctgtactcatcctttggttggcatcattctaaatggactctggtgttgcccatgtgtcttgctctagctaataggataatagcagatttgacacaagtggagtcttggaaagggcttgcacatcgaaactttcctctctctcgcagtgcctggaaaccctaaggtcacaatgagaataagcctgtgcccatctgcagtcaatgtcagtgacatggctgctcttaggtctactattttttcttaaaatgtgtgttaagtttgttgtggccaggtaacaaattaccacaaatttatcagcttaagaccacacccatttatcatctcttaatttctgagtcagcagtcggcacatggctttgttgggtcctgcccactggatttcacaagactgtgccacagtgtagactgggcttcattctcacctgagactcccctgagaacacagatactttagagctctttcaggtagttgcagagctcattccttaacacctctatttcttaaggcttcaatttctaactggctcttggttcaaggctgctctcaggtcctagaggctgtggacaattccctgccatgtgatgcttacacaggcaatgcccacatggctgtttgcttgttcaaggccagcagaaggtttcagagagtgtctctttccagtctgctatgacagaggcttatagaatacaatacaatgattggaaagacatctcacaacctctgccataccgtatgggttagaagcaagtctaggttctgcctgttctctgtggaggtagattatacagttctgtgactcactggggagagggttctgctagggtgttctggcatctttagtttagtcaaatatcaggtacttgtactgagtgtgaaatctatcctgcatctactggcagtgactagtcctgtcacccctgggaacatctggggaggcatactttataagagatgttttaggataacccagctcctgttggtgaagtataacatttgcaaaatatcctaatttttgtgatttctaacatgtcttcaaggttacttaattgtaatgatcataagccaattatctctaaatatcctcgaaatttatatttaatagtggaaaaatgaattattaaggagtctgctaaataagactcagggaaataatgtcaatacccaattgctgccgcccactgctagactatgtgagaatattttcatgaacaatagaacagatactgcatgctagacactgctgtgagcaccactggcctgccacctctagaaacgtttgcagaatgagggcaattgttatgagtctccaaatataaatataatatggaattgttttgtttgttaaataaaactttaattatttctatcattatataacatcaaacttgattctgtcttggatccaaatattattagagcattcctttaaatgtggcatatataaagcatatggttctatatatttattactggaatataaaaatcagttagtatcaagcattgcaagctctgactatcatttgttcagtttttacccttcactttccaaataggtgtgatcatgtcttgtgcatttattcatattcatttgatacacattgttatgttcttgatatgcatttttcttatatcacaaagttggcattcctttttttatttattattattatactttaagttctagggtacatgtgcagaagatgcaggtttgttacataggtatacgtgggctatggtggcttgctgcacccatcaacctgtcatctaggttttaagccccacatgcattaggtatttgtcctaatactctccctttctttgcctccctcctcctgacaggccccggtgtgtgatgttcccctccctgtgtccatgtattctcattgttcaactcccatttatgagtgagaacatgcagtgtttggttttctgttcctgtgttagtttgctgagaatgatggtttccagcttcatccatgtccctgaaaagaacatgaactcattcttttctatggctgcatagtattccatggtatatatgtgccacattttctttatccagtctatcactgatcactttcccactttctgatgtgggcatttagtgctataaatttctctcttaacactgctttagctgtgtcccagagattctgatacattatgtctttgttctcattggtttcaaagaacttatttatttctgccttaatttcattatttatcaagtagtcattcaggagagggttgttcagtttccatgtagtggtgcggttttgagtgagtttcttaatcctgagttctgatttgattgcactgtggtctgagagactgttatgattgttatttttttgcatttactgaggagtgttttacttccaattatgtggtcaattttagaataagggctatgtggtgctgagaagaatgtatattctgttgatttagggtgaagagttctgtgtatatgtattaggtccacttagtccagagctgagttcaagtcctgaatatcattgttaattttctgtctcattgatctgtctaattttgacagtggggtgttaaagtcttccactattattgtgtggaggtctaagtctctttgtacatctctaagagcttgctttttgaatctgggtgcccctgtgttgggggcatatatatttgggatagttagttcttcttgctgcattgatacctttaccattaagtaaaattcttctttgtttttttatttttgttggtttaaagtctgttttatcagagactagggttgcaacccttgcttttttttctttcagtctccttggtaagtattcctccatccctttattttgagcctatgtatgtctttgcatgtgagatgggtctcctgaatatagcacaccaataggtcttgactctttatccagtttgccagtctgtgtcttttaattggggcacttagcccatttacatttatggttaatattgttatgtgtggatttgatcctgtcatcatgatggtagttgattattttgcacattagttgatacagttttttcatagtgtcattggtctttttggtatgcttttgcagtggctggtaccggtttttcctttccatatttagcacttccatcaggagctcttgtaaggcaggcctggtggtaacaaaatagctcagcatttgcttgtctgtaaagaattttatttcttcttcacttatgaaggtttgtttgtctggatatgaaattctggtgcctcccaaatcatcattttttctcatatcatccccagatatatgatatgggaaaatcaacatttggaaactcatctgtgtccttctgggttgactaggaaggtgtgacatgatttcacagtaatttccctaacccttgagtcactaaagtcctaaagccctgtgtgatgcacaagttaccccatgagcttgcagcgacatcagggcatagccttgaagttcaggcaggagtctattcaacacttgattctttctaagagatacttattagtttctatctgggtttgtagctaaacccaaaccccactgtcataggaaccccaacaaacacgagcaacagagcttggtttgcaccaaaagctgacatctgctttcactgcttgctttcactgctgctgccccaaatcctactattctcatttctattaggcaaaaagttgccttatattatcttatatttttcaaaattctattgaatatggcatacaaatgtatactttctaaatgcttccagacttgtttcttcatttttaaaactcagattgagaattcagaaatctctccttttacttcatcttgctgtgtctgactgatcagacatttcacacaggacttttgtttttaagtagatttaacaacatctatttagtagctgaaagctgagaatgtcaacatttttacctggctactctctgcaacagtggtataaaaaggggtcattccaccccctttcctggagagagacaggtgcaaagaaaaagtggaagtgtgaagctgggaaaagaaagagaaacagtctttatacacctaaactaacccaggtacatgtacaccaggaactatttaatcaaaataaaatccagaaaaggtgttagttttggtttggcatgaaccagtcttaaatataaagttgttatactgaataggttcaattgaccaaaaaatgtagggaaggcaggaaggattaggatgtgctttcactcagctttatctgctgtcacgtctggttactcaggggggcacttggatcccctccattgtcctgctggttctgccaggccaaggctgttaaatctggtggagtctcatgtgtggacttttgggtatatacagggagaacatcagagaaaggcctaccagactttactggatattgttaatctgacatgggcttttggagaaaaaaaggctttagatgaaaagtgttggacaaagtcacgcatggcttatctaaaaaacaaaaaatcaaatacaacttgaaaactcttgctagagaaaatagatgactttagaaaaaggtgaagtgacatttcagtttcccaaatcactcttcttcatacatgttcacttagctttttttcaccttctatctctgaggttttagaagggcctgagctaaaaggaatttgtttccataggaatccagcaagtaaaacataaacaacatcaaataatctacatcattatcatagaagcatgtcaaagaaactaagattaggttgtgagttatggcacaagtattagagaaatagagaaaagatttaaaagatagaataagacttacacaagaaagcaggacagccttatgacaattgaacatatcataggataataggttgtgataatggatggtgagaagaaatggattggacagataggcatgggcgtgattgaagatctgagcaatttagcatagatcaagacagaatccttgggatttaaagtgttgtcaattggatagtggaaaaatctggggatgtaatgaacttggatttaacactatttccaataagtttctgctaagttaggccagttatgataatgatgactattacagtgctaagtattatagcaataagtatactgaaattaatagcagcatatattatctgttggataatattctaaatgttttacattgtttaaatagtaaacagacctgtgaggtagaacctactattgtcacagcaacgcaggtatagaaactgaggtaaagggaggttaagtcactttactaatgtcacacagtctgtaagcagtaagctctgtccccacccccaagggtttgacttcagggcctgccaagacaacgtctggactgttgcatggatcttgcctggctgtacatgaagctctaattccagaatggatgaagatgccggtagaacttggtgtagcattaataaaattgtttccttcagaccaagagaaatgtccagagggcaaaagagtttaactgcttaaaggaaagaagcagatttataggaaatgaagttctggagtgtgaacagagtttttcacaaccattaaggagaagagaaattgagtctagtttgatagatgtgctgtgtagaatgagtggtgtggagattagagaatcagccaaggaattgtcccctgccttcctggatcgcatcatcatctgtcttcaaggcaattgtatcggtaccctgagggtcagagcctgggtcctgcttatccatgcagctgtggtcacctttgcacctgcagtgctggagttaattgagtgttactttttgaggcagcttcaggacccttggtaaaaatcactaagcatcaagcaaaaggcatttttggaagaaaattctaatcagctcttcattcccacctgatgcaatttttgctgctgctgggaccccaagttcttgatcccaattttgttttttcttttatttatttatttatttatttatttatttatttatttatttatttatttattttgagatagagttttgctcctgttgcccaggctggagtgcagtggtgaggtctcagctcactgcaaccttcacttcctgggttcaagtgattctgctacctcagcctcctgagtagctgggattgcaggtgctcaccaccacgtccagctaattttgcatatttagtagagacaggctttcaccatgttcgtcaggctgatttcgaactcctgacatcaggtgacccaccgcctcagtctcccaaagtgcagggactacaggagtgagccattgcacctggccccttgccccttttgtaaatagaaattaacaccagaccacaacagaaattttctcaggcaaggtttaataggtttgtggcatgagcaaagcaagggagcagcctatgggtaagagatcccagtggcaatgccctgaagtgcccagctcttaccattttaaggaagctgagggggaaaaggaatgacatacaagcatgtttaggcaaagttttctttgcatttgtgcagtggagcgtcatgctctaacatatataacatgatcaggaaatggagaataagctctgcctttggtggatattttagtattacaatgagattataatgaggaaaaatcagtgaaaggtcagtgctggagaccatctcgtcttcagccagctagatctcatttggttctttggagcaatgccagatcttgcagcaatcttgcaagatgaccaggttcttatcaggaacgttagagttccactttagaaaccttgagaggccaggggcagtagctcacacctgtaatcccagcaatttgggaggccaaggaggatggattgcttgaggttaggagtttgagaccagcctggccaacatggtgatacaccatctttactaaatatacaaaaaatagccaggcatggtggtgtgtgcctgaagtcctagctactcaggaggttgaggtaggagaatcacttgaacctgggaggcagaggctgcagtgagcggacattgtgccattgcatcccatcgtgggtgacagagtgagactctgtctcaagaaaaaaataaaataaaaccttgagagacatcaccaaaggagataaatggttgagctcttctttttatggataggattttggcctagtccactaagttgggagaggacagctttttggtatggaactggaatcagctatgttaagggaggcaagaaggttggagtggaaacattcctggacatgtgaggcccattgggatcctgagaacaatgtctttttcctgccacaactgtatctcttccttatactctcacaatcatgcaccaagagagacaactaggcacattttgggtagaaagagagagatggggccacagttttctattttgttcctaacagtccttttccaaacaccatctcagtgactccagatgactggcgagacaggagaacacaggcattaaattctgtgaccaaggacagaaattctaaactcaggctgagctaacagccttttctgacctgatcacctgggcaaaacctgaccaatataatatttacatttctaaccatacagatagattcattttataaaaattgatggtatagatatgaatagttggtaatccatttagaaaaatattaagaagaaactgaaactaaataatatttgtgtataatgatggtaatttgtgtcattaaaaaaatgtacatatggtatataaccactcaaaactcggtggctaataacactaagcatttattttcctgttcatgataacaatcatctggttgatcaaggaagggcttagaagggtggttctgctgcaaggcactgagattatcaccagcacttgaatagggtttgatctgggacccaggcagggtctaaccaaggtacaacatgcctgtggcaagcagcaggagtgaatacaatccccaaaccaaactgaataggaaaataatttaaatccaattattggacttacattatttgccttttcagcttaagtctaataattattataaggacaataatctctaacccaggtacacacagttttaattttgttctttccctttggtaaatactaaagtttctaaaaacatttactgcatttaattatcaaggtatttgatctattgataaaaaataattttttttaacttttacaatcttaaaaatgcctttgaaagaaattttgcactaattagaattaaagctgagtgtgcctttaacatgtggttttaatataaatggcctctgtaaaaaatatacattttgagctgaggtaaaatcctctagaacatagctcctgaaaatttcagtagattacccctacacttgttaaaatgcagattgtaacacaataggtacaagatgcatttgttagtttgcattcataacatgctcattgtgatgctgaggaggcagttgagttggcagctggacaaattttgattagcaaagtgttttcacattaaggaaaaaatatactttgtgaacaattaggtgtcttggttgttttatcaagaaagtgtttcatttttttgtcaaagaattgctaggtattctaaacaattttctcctttttctgtttactttatgacacaggaagttttcttgcaataatcccaaacttgctaataagacgtggaagcacatgcaaggatattcttgggtcatcccaaatctggaaaattctgagatttggggaaatattgaccttaattggttgtcagctctccattcctcattatcaccatcatttctggaaacacatttcacaaaaacccttttcccactatggtttcttgtagagttgctcaataatgggccctcatgtcatacgtaagagtcagaggaggatgattcaatattcattgacacctgcaggtagacacatggactgaggtgaggactggagaatcaccgagtgacgtgctacaggcagctaagagaatcagcaccctaacatctctacttcctagacagggcagaggaccacatgtttaagcagcccatacattcagggtcagatgcgttcaggcttctggtggaccaccagagagtcccgtatttctagtatcagcttctctgtttaccacacccccaggtatggatgtttgactctaattccctgttttaaaacaattccttcttgaaatctgtagagtggtttctattttgatgtatgaaccctgactgatgcaacaacacagattcctcaggtatcataattgctatcattactaaatcagggagacgttgtcatgtctgtgctcctgggactgaggatgaagaaagagagttagaaaacaggggagactccctgatcccttgtgccaaaagcttaaaaacttgtatacatctgagaaatgctttcagcagatggaggcaccaggcggagcctctgtgcaacccaacttcatacatttgtttcactaaggggcttatgttcaggcttgtaaccctgtgggagggtaactgaagtcctgtttacagtaataagctgcaaaatcttcaggcttcaggctgatgatggtgagagtgaaatccgtcccagatcccctgccactgaacctcgatgagaccccagggtgcaaatcttttgcatcatagaggaagagcttaggggatttccctggtttctgcagataccaggctaaattactgctaatgccctcacttgcccagcaaatgatactgactctgtctcctacagatgcagacaggaaagatggagactggatcatctggatgtcaaatctgacacctgagattggaaacataaaaacaaatatccacaccatgaatcatggtataagagaacttcccagaagtgccagagcacagtgggctaagaaaattcctagtgttctccttccttacctgggagccagagcagcaggagccccaggagctgagcggggaccctcatgtccatgctgtgtcctgactgggactgactcctgcacaggtgtgaccagcctattaagaagtctttagggcagggggtggtgctctgggaacaagcaaaacggcagggggtggggcaggctggatacagctgcgtggctggctcatctcagtaactcagcacaggggcagtgtccccagtgtcccaggtcagaccagggcacctagatttgcctgcagagaatgtttcttcctaaaggatattttgttaccaagtacatttttgagcatttattggcaaaactcgaagtggttgtgagaactagatggaataatatatttcaatgctgtattgggaataagtaggagaatatccttgtttgtagagagtgcttaataaagtcttagagagtggggctatcaggtcttcaacacactgtgaaattgttccagttgggagcgatactttgtgacatacatactacatttttgtaagcatgaaattgatctttttttaagtaaaaaagaacacttagtcatgagcaagtaaaatgttctcaaaagcattttgtaatggccctaaaccaatgttattaccagtctaagctgaagaggtttactgcagattgacaaagaggatgattttgtgattccttaaagcatatgacatccacagttcctgcattgtccagagctataagtctctttaatgcttgagttttaatgggattcattttattctctgtttggggacccccatattctacccccttttctgtcattgtgaattatttcccacggtccatcagcataaaagtctgactagcaatgctaaatctgattactttaaaacaattttttttcttctactataggagccttgattagcataaacttgaatctttgtgttagtttgcttaggataatggcctccagcaccatccacagtgttgcaaaagacatgatctcatttttcatagctgtatattaagcattccatgttgcatatgtaccacattttctttatccaatctacaactgatgggcatttaggttgcttccatgtctttgctattaggaatagtgcagtgatgaacatacacatgcatgtgtctttatggtaaaatgatttatattccttagagtatatatccaataaagagattgctgggtcaaatgatatttctgttttaagttctttgcaaaattgccaaactgcttcttataatggctgaactgatttatattcccaccagcagtgtataagcattctcttttctccataaactcactagcatctgtcatttttaagtttttaataatggccattttaactggtgtaagatggtatctcactgtggttttgatttgcatttttttaataattagtgattttgagcactttttcatatgctttttggccgtttatatgcttttttgaaaagtgtttggtcatatactttgtccactttttaaaatagtttttttttgcttgttaatttgcttaagttagttggaggttttttaaggaaaaaaccagaataagagaaaaagaggaaaatataataccacagaaaacacagactgtggtaagtattgcctcgtggatatatgtgtgtgtgtgtgtgtgtgtgtgtgtgtgtgtgtgcatatatatatatatatatatatatatatatatatatatatatatatatatttatgatacatgctgtgtttatgtgtataatgatgatccagaaactaaagggtgactggtttaaggactgcctatgttgcactgaggcttccttcttttcaaattatgaactaaagggtacagcagtacttgcatgactctcaaaaatcctagcagcatgagatagaggtagaggagatttactgagatagatgcattggaagctgtagaagctcgtcctgtgctgttgtggatgttgtgattgtagtagttgttgttagtacagtgggagtaaaagcagcttgaagatttacaagctcttctcttcctcatacttacaactccctctagagacgcatcaatgattgtacaggaatctctgacacctctggagaaatcttgttagctcaatccagaatcttacctgagaaatgttttgagcctcaaattatgtgaaactagggtgtagaaaaaggactagagcaagggaaaataatgttcatgcctgcacagtggttgtagacaggtaaatggggggctttataagtgtgatgatgtgccaaacctctgtcaccacggggagagaagcatcaaaccaggatcacttctggaagaatcattaggttattttagatggaaggaactgtgaattccttgccaaatagatttttaaaattcaaagctactcattacgtgttaatattatttaacttctttaaatataccaggtggtagagggcacatccactatttcaattcagggtttgtatgcctatgtgaattataccattaaaaacacagcaaattccatattggttggggaagaatgtttgaacagtaatcaattttgtgaagaagaggtttatgtcacagcactttccacagtattacatacaaaaacagtgagtgatctcatatccacaagagccagcatttctcatgtgccacatatgccctcccagaaagaatcaaagcctggttcaagttgatgaaaagggaagtaaaaagaataaagccccaaaacacagcactataaatggaaaggggaaaatcattgcagagcctatgatgataaaaatacaaaagatggatattctgagtatttttatggcaactagcttgacagaagtaacaataaatttgtattataaattacccagaacgaaatttccaattttatatctgcctgactggtgtcttgataccttatcaaaattacacaaattttcaagagattcaaaaagaataaatactcccaaacttatcatatgagatcaccatatactccagtccaaaaataaacaaggacctaacaaacggagaaattaaatgctggtatctcttgtgagcataaacacaaatattctgaaaaatagggaaagaaggaaaatataatcatttttatatctatacgtttgtgagcacacatggttaagtgtattacagtttttatgctaagaacacttgatatgtaattacaagttctaaaaaactgataagaaacagaagatgtgacagttccattttcctaacttttaaaagaatatttcatcttatttaaatattatttttatttttgtatgactttttgttttgcttagacttttagttgaaatgaataatgaatgtgtattaaaagcctaccattttgatttaatctatgaagggtatttaaattctcattctatagaagaaaaatccaaactccttagaaaagagagatcttgccaagagctacacagttcttgtttcagagctgagattttctctcagatattctggctcatacaattttcagtacactacagatagaagatgcaaagacaacattacccaattggtcttgcacttactttgttccctgttaactaagtttactgaaaaaaaataattacaataaaatacactgtcaatgaactgtcacaaataaatacatctgtagaaccacctccaaaatccagacatagaacatttctataactcccaaaagtttgacccactcttttggaatccacttgctttccaccacacagatcagggaattcttgatctgcttattgtcagtgcagattccaatttctttttaagggtttcatgtaaatgaaatatagcatgtgctcttttgcatctggtgaattttgtgtagcataactgcttctcagattcattgagatgtcatgtgttccagttatgtgctcctttttatttttgagtgttatttaactgtttggtaattttataatggatcctttcacctgttgattgccatgtaagttgtttccactttgggctattacggataaagctgctatgaatgttcttgaacaagactttgtatgaacatatctctttatttcttttgggctaatacctaggtgtgtagttgctgggtcttacagtaagtgtttaatactctgttcaactttttccaaagtggctgaaacattttacatgtccaccaataacttattatagctccacaccctccaactgctgttttgattttttttttaagatttcacctaattgtcactcaacagtaaccagaatagctagtgattattaagctatgtttttctgactattttcttgtcaattttggtggttgatgtgtttcaggatattgagaatagaatcaatgccatccaagctccttttcaaataattttatcaagccataatatttaagatggtaacaggatatatacaaggtgtgttgggagtagtaataagtgttttcaacatttattattatcgtactccataaggcaatatgtcttcaatgaaatagtgtttaactagacttaggatagaaaggttctcatctcaaccctagtattcaatattaggaaaagtttaaggaaaaaaaaaaacatccaggaaaataagtcagagagtgttttgctagtcaagaaaaactgcaacactgatgctcttttaatgccaggccttcacaacaatttccactcagatcatttggtggcctccttgccttgttctccttatgggacttcattctgagggcatgtgacatcacagagggagcagtgcacttgggtacagaaatatggcttaggagattgtctggccttagaggcgcctgcaatggaatatacattttcaaggaagttccctgttaaagctgataaattgttagttaaggcaaggtgcaggggcttatgcccattatcctagatgtttgcgaagtcaaggatggaggacagctgaaagccaggagtccaagaccagcctggaaaacatagggagatccccccgtctgtagaaaaaaaagaatgtttggtaagatgtggtgtgaacaatgacatctataagagattatttattaacatttgctcagaaaactagaaaatagaatgatgtcttataatccatcaatatcataataaaaatgctaagtttttcaactatggtaaatatagagaacataacattgcccatcttagccatttttaagtgtacagggcaatggcattaagtaagtcacattgttgtgctatcatcaataatagcaatctccagaactctttccatcttctaaaactgaaactctatttcaattaaatgataaccctctccccatttcccctgcttccagttcctggcaaccttcattcaagttctgtctctatgacagtgactactctgaagcaggttcactgtgccctggttaccaacttatcagagtccagggagacagaacaatcatacacaacaagttacaagaatctggtgtagtatttataggtggccagcaagggactgcagaagcctaggatgtattgtgggtctgtccccttaggcacaggcatgtgggtctgatggaaccttgaccgtgtgtaccccacttggaccataactcagcaaccccagaaagaagatgctctgggtttttaatcctggtgtcacaggacacatggagctaaagtactggaggactaaagtactggaggacagtactaggagaagctggaacaggggcaggctcttctgaccagtctctccctatttcagaatgttacatttccagcacatcctacagttgttcttgagaagtgtaagaaagagagtggggagaactaactgagtcgagaaccattagaggactgtactggagtcacccccaacccagacacccccattagaaagccattccattttatatgcctactaataaccctgaactggtggcagaggtgtgtcttgtttgactgatgaagccccttgacgaacacaatgtcaaagcaacatcattgagccagagccagaatagatttcactgggccaatgaaaactactaccagaggcaggatgatcaggcccaactgaggcagttatgtagcccaggatcccatgatccacagaagaagttgctaaaggggtgaaagaagaatccttcaggtgggcccattttcttcaattacgagcctgtttccagatctcctctacttgaatttctaggatacttgaggtgtttgtccagatacaacaggaagtgttggaaattgtatacaatcctcccagttgggattttaaaaaagtctagagcaacactgttatctaaaacatccatcccgatggagttaacggatgtctgctgggctaccaaggcagtggctatggaggaggagcaatatctgccatggtcagggacacgtttcttatcatttctcttttttacatgagcactgactcctatacatagtaccaaaaatatcacaaaagacataaaccgataatctgttataccttctggcaggtccctagtaagtctgaggtacagctttgggctgcaggctcaatggttcacctaattccaaggagtaatatccagagacaaccccagcatgcccaacatgcagaatctcaccatcccacagttatccagagatggcatcacacatcctgcattttgttcactcccagaccattcacagagaaatatgtagcccttgggtgcatacagccccttttctcccattttattgtttaatcacccagtcatggttatgcaggtattggtgtgttcattagccaagtctcactgatggcagagttgaaggagcaaagtttttctcagacaatattgttcatagacagagggtagcattagtcctctccttgtttttgtctttgccattgggacatttcttatctatgcaatcaaagaaatatggtgcatcaaaatatcagtccaccaatgttttttttagttgtgatcatgacatttgccacacagtcaatttagttaaacggggggcctccagttttctcccatgtggtaggtgtcacatcctcagttggtaggccagtgctcgggtcctgttgatgtacatcatggtatcaggaatgttggcgccatttaccttcggtagagtgaaaggaaacctctagttagtgacagaatgaggtcaagaatggcagattcagtattttgaaagattacactcggtgacttgcaagaagctaacaaagatgttatgcttctaggcctttgctgactcattcttgccaaaatgcagtgtgacaggttagtgcatcatctctcacccatcccagggtctcaggtgtctcctacccatctacaagggttaggctgtgttggtgtaagaatgcggcctggctgtccttgctctgtgaacaatccatttcctttgtcacttgacccagacatttcagtcctgattgtccactgcaggaagggagattatgccctgtaaaaacttgacatatttcataatatcgccaacactaaaggaaggataagatggccctggcaccagaagagggcccctagctccctgatatttcttagtcttgtcatccatcctgtgggatcttgtagaaaagaggcatttagaggaaacataatccccatattagagttagggggcctgtctggggtaagatgatggcctgaattgaaaatcaccccagggcatgcattctaaaggaaaaaaagaaaaagaatggttaggaacactgaaatagctttcacaggtccagactaataaaggaactgcctggtctaccttcgcttccactcagcattatgttccttaacattcattatttcccttgttctggagtgcgatatttaatgcccatattgctctagtaagatggggtaccaccccattagcagactttctagatgtcctttctagatgttgctgtgtgagtccattgttctagcattcactagattcattggcctgtggatgcagggtgcatggaaagttcatcgtgttccatgagagtgtgcctactgtcatgttgcttgggcagtgaaagatgctccttggtcagtgtgaagtgtcattgggtatccaaaaatataacataagttcctctcaagggtgaccttggtagtcccggcatccaattgagcatcgtatctctttttcctgcaggtggaaagctgtggccatagtcctttcctccacaccagggattctttaaaactccagtctctcagttgccattttcctgaacagatgttgaggctgttggcaatggcccatgatttagtggaaatgtggcatggtacgatgttggaacagcctgcatggccatcaccactgaatgtagtttgacccactgggttgaaatcccatgctaagtttcagttaaaaaagtggccatccattggctgaatggtggccacacctagtggacctgtcagtttgtgttttcctcagccatcagtgactcctgccgtatggaaatctctgaatcttgggctcgacatgggtaaatgaaaatccaaattatcacctacaagtcatttggtcccttcaacaacctctccatttgttcatggagccacagatcctgtggggtcctgactaagcctgatcaagaatgtgccatttccatttgataacatgactctgttgagattgttactgccttgaaagccaggcaggtgcttctcaactctgtgattcttcccaggaaatacgtgagaacttccatctgggttcatatctcaaacacaacccagcagtctctcacttgctgctctctgctcaaagtcttcacattgtaatttttcatggggtaaaaagttagcttatatattatcttgtattcattcaaattctgtttaagtaacatacatatgttcctttattctttcgaactttgtccttatttttgaaacccagctttggagttcagaaagctacttttgtacttcaatatgctgtgagtgagactgtgcaaacactttagcaactaggtctttatttttgcatacatttgccacaacatatctagtaattaaaaaatctagactgtgaagagttttatttgggttctccctgaaaaaagtaggataaaatacagtgcttgctggtgttctggtcaagggtctgccttacaaaaagtagagggggggaggtggaggaggggagggaaactgatttaatatcaccaaatcttatcaatgtacatgtactctggtaactgctaaaccaaatcaaaagaatgtgttagctttgtgttgccagtaatcagtctcaattaggtgcctgttatgcagaatgaatttagttgatgaatgaacgtagggaaggaagagaggattagaatgagctctcattgagccttctcttctcttgtgtctcattgctcagagggcacgtggacctcctccatactgcagactctgtcatgcaaaggctgctgcagctgacgggaccttaaaatgtgatgcctgaggtgtagccgagaaatttatggtcatgagccctcagctgcaccaagccctctgagttctccaacatcttcttctttaggcatctaagagaatccacagtgcctgctctccacagaaacagcacatctgggcagctaggccacagcaagtggggaggtttgtgttcaagactctaccattgtgggaggataatgtgtactttgctggcagcaataaaccccaacatcctcagcatccatcctcctgattttagcatgaaatctgtccccgacccactgccactgaacttgtctgggactccagggtcgtgattggaaactaaatagattgggagccaaggaggctggcctggcttctgtaggtaccaattgaaatagatgtatccattactgtgaagggggctgtgactagacctgcaggagatggaggctggctctccaggggtgatgggcagggagagtggaggttgggtcttcgcagcatctccattggatcatgaaataatgagagagaagtgcaaggttatgtgcaaacattgtgagtcattttaatcattttctgtctgttatttatgttttgctcaattatttttgtgtgtgtgattttgattaatcctcccaaaacatacaggtttaaaaagaaccaatatttgcaaggcaaagccggcctctagaagtcacctatcccatccccctctttctgtgtcacagctttcactaaagtacatgtccttgctccttctggaatcttcctcactctcacagatctagacatcatatgccccatcctggaggacaagacacatctaacacgaggacaggacacacatgggaggtggcgggatccacagagttcaccctcccaccccatcatcctccctcatttcccttctgcccttaccagggacccagagcattagcagccccaggagctgagcagggagcctcactgtgagaaggtgaactgaggagtcctgatcagtcaaggcaagggtagagctgagcttttatctcagactcacaaggaaagtcctccctaggggacagtatgcaaatcccctggtgggtgcagtggggtggaaagagccaaggagaaggtgggggcgtctcttgtgagcaaaacgacataaatatattttatgtttttaaggaaatcaatagaggtaaaatctgtgttgcctgagtggcagaagggacgtatttagattttcctgctgtttcctctactagacttctagttctttaggactttctcgggcatgttttatgtttctttttaataagcttgatctttcataaatatttgatgattcttatttctttgtttaggtttatttaaaagagtctaggtttgtttattttattttattttattttattttatctaaggtaaaacacacagtgcaaagggtgcaactcttaagggtgcaaatgaatgtcaagatccagatcatttcatgtcatgatccacatcaaaatacagaaggtttccaattctctcgctgctttcattatgcaccttcccagtcaaaaactgctgctcaaaacacaatcaatgtaaatgatattctgacatatattataattgttttattcatggacttaaactttatatcaggtaaagtaaacattttttgtagcttctttccaatttttttcattttttgaggccttgattccttcttgtcaatttgagttgctgtctgctgtcattttctgttattctgaagaattttctcttgaatctcttacaaggcatatatgctattaatgaattaatctttgtgtatgaaggaatatttctaccttgcttttatatttaaatgattgtttttctggatatagaatttgtggctgacttttctccctcagtatttaaaaatatcattccactgtcttctcacctccatttgtaatgatgaaaatttagccaatgattttaatattgcttcttagtataaagtaagtcggtattttagtgatgcatttcaaattctctgggtctttgtctttcaacactggtactataatgtgtatagttatgaattgtactgtgcttatcctaaaagggtttcactgagtttctttcatgtatagattaaggtgtttcatcactgtgaaaaatgtttttcattatttctccatttttttctttttcaatttttattttaaaatcagagcatacatgtacagatatgttacaaagttattttgcatgatgctgggatttggggtatgactgaacttattaaacaggtagtgagcactgtaccccataggtattttttcagcctctgcccttcctccctttgtctcccctctagtagttcccagtgtctattgtgcccatcaaccgtggattggataaaaaaaaaaactgtgtatagatacaccatggaatcctatgcagccataaataagaagaaaatcatggtcctgcagaaacttggatgcagctggaagtcattttcctaagtgaactaatgcagaaacaaaaaaacaaataccacatgttctcacttataagcgggagctaaacatggggtacacatgggcgtaaagatgagaacacagtttttagcctcttcctgtcttctcctttgtgattcctaatacaaatttgttggtattgttcacagggacctataatgtctgaggttttattcattcttctttataatttttcccttctttatatgaggtcatttctattgacttctttttcagatcactgactctcgtgtcatgttaaattgctgttgagtctatctaatacatttttcaattgagttgttgtacctttcatttttcggattcccagtaggtctgttttcatagttttgtctctttttgagagcctctatttgttgaatcattgtctttacaaattcctttttaagtcttttattataggttaaaataattatttgaacatatatttgataagggtggagcacacagacaccatggagatggaccataaggcagggagctcagaattggattagttgaatttggagtctctgactagatggtgctcttgtgagatttaattattttccatgtttcatgtttctcacaatacaaatagcttttattttttaagatggtaactatgtacagaaattcagcttataaattcctgggaattcctaataggaaaattgatgaaaaaatggtttctcttaggcccccatacctgcctctgcctgggacctgactttgtctctgagccggtggaatctatgatgaggttttgagttgggcagtgaaatcatggcagggcaggctgtgctctgggtgctgtggaggacagggggacactccttcagggtcagtgatgctgggagttcaaggggagactcagcatggagctgcctgttgagtcgccccagcaatcctgtctggacagtgatcatctcacaagtgtactcagatgccagtggatggcccaaatgtgggttcacgttggacaaggacaaagctttagggatgaacatatggggctcatttgatagtctgaagtttcagcacaagcgtaatgaatcatatgggaaaagaaaggagtcacaaggttgtgacttttcatttggtattaaaatatattccctctgctcatttttccctccagaatgtaactactgatacatatttaaccaaagtcattgtttttaattttcattttagtaactgacagcctgtgtgcagagttcctaaataactggaaagccaggccgtcattcctatggctgaagccaggaagtgactgtggatatgaagaaatgtgagtttcatgtacatgtctctaaagccatgggccattgatctggtgggaacctgcagtcatttcactttctcatacccagatgagaggacaccttgatctgtgttcatctgatgatctgatgaactctaaaaactggaccatattctgaaggtctagctcacacttcttttctgtgctagagggactctactcacatgtattgtacactctgcataggacagtctgtgatacatacaagtttttttctgctaaacactcatcaatcttgtcatttatgcgtcttctatacttgttacctgacctatggctatggggtcttccaaaagaataggccagaggtggagctgtgaaactgtagctgaataagaagtgtaagtgtcaagatagggtaaaaaagtgttgataataataataatatttcaaattagtctgggctcttggctgtgattactggtaagtgggaaagagtctaggtttgttttttttaagttttatttcaattgataaagtagccagggtaaagtgcacaaatcttgaatgtgcaactgaataaagtttatgtgtaattcattgtccaggtggaatgatagaatatttcacatactcttgtgcttccctcatggacaatctttgtcagttttcgcccctcccacccagccatagtaactgttattctgacatctaacacaatcacttaggttttcttgtcttgaacttcacataaatagcattaagtgtatttttctctttttagccttggtattgctccttacaatgtttgaggccttcatttcttccagtggactcaaggtcctgtctgatgtcatttcctgggattctgaaggattttctctcaaatatcttataagacatagctgttatgaatgaatgtacttttttatcaaagaaattttgtttttgctttttctttagatgtgaaggtattttcactggatgtagaattcctagtagacttttttctcctttcagcatctaaatatgtcatttcactgcttctaatctctattggtcctaatgaaaacttagccaatagcaatatgttgtttctgtgtattggttgggagatgatgtttgacagtgatcagtttgtgaagcagaggcttatgtcacaatactttccacagtactacatttaaaaatggcgaatggcctttcattcttgatgcagtgaagattttctgtctttcaacatcttaatataatgtgttcagttattaatttctattatctaaaagggttttattgaattttttcatctaagaatattttttattacttttgaaaagtttttgtcattatttctccaaggatttttttttcagccactttctctgtctctcctcctttgtgactctcattatacttttgttggtatccttcactctgagctataaatctctgacgtcttcctcctttttttaaacattttatttagactcaataagttctattcctttattttcaagttaactgattattctgccatctcaaattgttattatacctagctaatacgtatttaaattggattattttacttttcatttctagagttccaatttggtcattttttatattttccatgtcttttcttgaggccctacttgccgaatcttcttaatattttcttttttatgtcaatgatcatagttttaaaaataattatttgaaaatctttgtagtctttactaaatccgataattacggcaagttagaatcagctttcgttgactattttctgttgtcattattgtagttgctttatttttgttcctttaatattggtcattcttctcatttttttcccaggagctgttaaactgacaattttacatttttgataatacagtacctctctttagattatgggttttttaattttaatttatttttttagaaatagggtcttactctttcacccaggctggagtatggtggtgtgatcatagcttgctgcagcctcaacctcttggggtccagtggttctccagcttcatcctcctgggtagctgggactataggtgcatgccattactctctgctattttttttttttaaattgtaagatattttgcccacccagcctggtctcgaactcctggcatccagtgatccttctgcatcagcctccaaagtactgggattacaggcttgagccaccatgtcaggcctggaatttgttttgtttttctgatcattttttaattttcttcttagttacttgggtgaacttactgatagtacctgacttatgatgcttggagttataactttttgactttcagatggtatgaaggtgatatgcattcaagtagaaatagaaattctagtatttatacaactattctattttctctttcaatatagtattcaataaatgacatgaggtattcaacactttattggaagataagctttgtgtaagataatgttgcccaagtgtaagctaatgtaagtgttttcagcacatttaggataggataggctgagctataatgttaagtggattagatgtattaaatgcatgttcattgcatgagattgaaaaatctatctcacgtggtgtttgaccactgatatctctgcttccttttattcttaatattaatatttagtttgaatttataggaactgcacatgtatctgcatagtgatgtggtcaccaatgatttgagacgttttgctcaaatatctggaggttataaatctatcttctgtcaacccatctgtgtgtagtttaaaaagcaaactgcatacaaaatgcagctagttcttacctccttctggttttactttgcaccggagactccttgttctcatcactcatatctatatcttctaggtcactaggaatgtgtgcagagattatttcagcaatatgggcctatcttatccaggaatctgctatttactatcagcagatgtactacttgcctcaaacaggtcattgtcttggacttgtaaagctgtgagatttttctgttcatttcctatggagttctgcatgtttagctggaaacactgaagaatttttttccactccttggctttactcaagtccaccccctttggcagcaagctgctagttttatttgctacgctcatattggtaaaactccagttctgtaattcatgctgattgagctgggggtagaaggctgctgtcacaggcaaaaggctacagacattttctgtccttactcaaagcactggtactttttttttctacaaagaatatgcatccttaattattttatacttcaccaattttcagagtgctgaaatagttttgatacttcagctttatatttaaatgtgtgtttgttgtttatttttgcacagaagatttattgaactctttgtgatgccataaacagagatgccttctaaaatgcatttagttgaacataatagccacactgaaatggtatgatgcaatggactaacataagtaattttggacttgacaacttgaactccaaaatggccaaatagagctgagatgctaacactgagtggccaccccactagctgtctgtaaaggaagcagctggtataataatctagtaaacactgatggtcttgttggggtttttgtttcatgtggaatcactgtgggatgccagttgctacgctgctgacagtaataaactgcaaaatcttcaggctctaggctgctgatggtgagagtgaagtctgtcccaggcccactgccactgaacctggctgggatgccagtggccctgttggatgcatcatagatgaggagcctgggagcctggccaggtttctgctggtaccaggctaagtagctgctaacaccctgactggccctgcaggagagggtggctctttcccctggagacaaagacagggtggctggagactgtgtcaacacaatttctccggtggtatctgaaattggaaataaaacagaaatgcactcatgtaatcaaaatcaaacccactgtctttgagtagagccaaaattgttgatctattttgaattttaattatatttcttgctgagcagaggtggcaggagttttcactgatgtgcaaagacacctcatattcccctcacctgggagccagagtagcaggaggaagagaagctgcgctggggcttccatggttccgtctgggtcctaactgagcagttcctccccagagctctgacccaggcattgatatgggctctggaaggtagggcagctgggagggacatgcaaagcagctggggtgggagctgagcttccagctgcagagaccacctgtttcttcctctctgcactgagcatcctgcgccgccctggttgtcaggccagaaaagtctgttggctcagtctgagtgtagaactcctcccttgtgctcagagaatttcattcctatgtctttcttctcctcaatcacctaaattcacccagatgatgtttggcacaagcctgttaagaacaatataaaaggctgtgttttcatttctgtcttcctatcctcaatatgcccagtcatctccctaagtgcattattggatcgatggaaatgaagagtctgttagaacttaatcttccagatacacctttcatttgcttgttagtaatgttttctgagggtcctgaagctttccattaacccagacacataccctctttgagttaaaaagtgaaaaacttctgtttacagtcacatgtcctggcagccctgacatagatgctccatggcttgccgattgcttgcaattgatgaagtaacttaacttccctatgtctcagtttccatatctgtgtaactgtgacaatactggtgcctaccttacagtgctgtagacagtttaaagaaaataagataaaacatttacaatagtattcaggacattatgtatgcggcagttaattttgtttttattgattaaatatttagcactacagtcatcatcattatcataaatatacttacttagcacagaaaagagtcttcagtctaatccaagaatgttttatcaacagtcaaattaaattctagggctttttcttcaccaactgtacacaactcttaaaatcctaatgatttggtcttaatctgtactaaaatgctcagaccttcaatcattcccgcccatctctgtctaacgcattaattctcatcatccattatcaaaatgttaccctatggaagtttcccatgtcctgctgctgtccttctttcttacataatctttattctaccttgttatcttttgtcttacttttgccccaggactgacaataaggaaaagctaccatcattacttgtggacttgctccagtataattttgtcaggcttgttatcttggaagtgaggactatgtcttgcaaagaaacatattcattgggtcaatgtgttatgaaataaaagattttatctacttgtcatccaataattaatttagactgacttgaacagattttttttaaggacgaaaaggagaagatgatataagaggaaaatacaatacagtatcaaatgctagctattatgactcttgcttcatggatttttacatatatattaggcacatggtgtgtatatgtgtgcaatgatgatccaaaaactgaatgctgactggcataaggaatgcctgcattacactgagtcttgtctacttttccaattatgaacagaaagctgcagtagtatttgtatgagtatcaaaacttctagctgcctgagatagaggtagagcagatttactgaaataaaagccttggaagtagtagaggtttgtcctgtgatgttatggctgttgctgtggttgctgttgttaggaaatacagtgggagtgaaagcaagtagaagattgacaagctctgctcttcctcatacttacaaccccctctagagatggacagatgctggtacaggaatctctgacacctctaaggaagtctctttgctttttccagaatctttcctgacaagtattgtatgagtcacagatgaggtggaagtgggtgtagaagaaaggactagagcgagagaagaagttttcagtcccaggtagttgttgttgccacggggaaactgaatttttcaaagatttgtgccacacttctatcgtgttggggagagaggcatcaaaccaggctcactcctgagagaatcattacattattttagagagaaggaactgtaaatttcttgtcaaatagatgtttaaaattcaaagctatcaagaccatcctggctaacacggtgaaaccccgtctctactgaaaatacaaaaaattagctgggcgtgctggcgggcacctgtagccccagctacttgggaggctgaggcaggagaatggcatgaacccgggaggcagagcttgcaatgagcgagatcgcgccactgcactccagcctgggtgacagagcgagactctgtctcaaaaataaataaataaataaataaataaatataaaaaaaattcaaagctactgatttttttgttgttgttgttgagatggagtcttgctctgtcacccaggctggagtgcagttgcatgatcttggctcactccgtttcccaggttcaagcgattctcctccctcagcctcccaagcagctgggattacaggcgtgtgccatcacacccagctaaattttgtgtttttagtagagacggagttttgccatgttggtcaggctggtctcgaactcctgacctctggtgatctgcccgcctcggtctcccaaagttctgggattacaaacatgagccactgtgcctggccctactgatgtattactattattcatcttcttgaatacagcaagtggtaaggtgcaaatccacaatttaaacttgagatttctactcctatgtgaattataccagtgaggaacagaaaaattctgtattgcttgggagatgatgtttgacagtgatcagtttgtgaagcagaggattatgtcacaatacattccacagtattacatataaaaatggcgaatggccttaaacccagaagagtctgcatttctcatgagccatactacccccaagaaagaattgaattgaaacttgtgtctacttgatgaagggtgtataggaagagggaaagaaaaaaggacacaaaacataatattggaaatggaaaggagaaagtcattacacagcctattagagtaaaaaactaaagagaggctaaatgagtaactttttggctactaacttgacaaaagtggtgcaatcttcacctcctgggttcaagcaattcttgtgactcagcctcccaagtagctgggattagaggcgtgtaccaccacttatggcccccttttttttttttttgcatttttagtagagacatggtttcaccatgttggtcaggctggtcttgaactcctgacctcaaacaatctgcccacctcagcctccgaaagtgctgggattacaggtgtgagccactgtgcccggccttaaagcagtattttcatttagtaaagtgtagaagaaaaaacataaataaagtgacaacaagaaaacaaaatgccattatgaaaaatggtaactttagggcagaaaacaagaaaaggcaaaccaagattctcataaggtaagcctccaatccacaatcctaggaggaatgtcaatgctgaaaaccctggagcatccagggagtggccaaaaatactaaatgctgaaaacccagagtacccgagtatcagcctatgagtgtccccacaccaaatgccaggaaaccctggaatatccaggggctgaccagtgcagaaaatcctggagcctcagtggggtggccaacagtgagccccaaaggcctgattgggaccacagaacaatgtgactctggcttcttatggccaacagaacaggagaattcttacatccaagtgtcctgccttaaacaattgcacaaacacaattagcagggagccaaagccaaaactgcaaagcaaacacatatatcagggcagaaaataaaataaaatggctgatggataaataaaatggcattagaggagaaatgactaagagaaggagcaaggaggatgtagtcaggtgtgctatggaggacttcaaatggactatggagtcaaaggccttattccctggatcttccaatatagggcaggtgggcagaggggacacttacaggtgtgcaggagcccaaatggtgccaagcagtctctaacgtggggcctgcgtgaagatctctccaggctccccagcttgggtgggttgggctcctacggaggaactggagcacggagcggctggcctgcatgaagcagtggctctgtgaccacttgcccatccccagggctccaccgcctgtcaggaaagatgatggctcttaaaacagcctttggctagtgttaacagctctgcaatgttagcaactctgtagctttgatcgctgtagcactgatcaccgtctcaccctctttcactgatctctgtcttcccaattctccaatagctgtcctgctcattgctgaccgctatgtccatcttctcacaaaatcccatctcttgctgtctcttgttgtcttgctttctctgctgtttctgctgtctcactgccacatcaaacgctgcctctcaccatctctagagttgagtggctggcttaatcctgatgcaaggcaagttcttggctttgctcaggaaagaacgttagagtaagccggtgattgaataaaacagctttattgatggggcagcagtgttacagctctgtgactaagcctgtggagcaggcataattcataggcagagggccaagagtagcagccaggtgcagttttacagtcacatttatacccacttttaatcatgtgataattaaggggtgggttatcgagaaatagctcgaaaatgggtcgtgttgccccaacttctgggtgttgccatggcagggcagcaatttccaggtgttgccatggcaaggcgctgcgacttctggatgttgctatggcaatggtaaactgtcatggtactggtgggtatgtcttacggagaggtgttttcagaatcctattcctgttttggccagcctcacatctggtccagagtgaagtgctgcctacctcttacctcaaaagtaacaagaaatctgtaataacaagttacccagaaaaaactccaaattttatttggtggttagtgacatggtacttatcaaaattacacaaactttcaagggaataaaaaaaatactcagaattattataggaggtcataatgtcctccagtccaaaaattaatgaggacataacaaaaaaaggatattaaaggctggtatctcttatgaacatagacacaaaaatcataagaaaaaataaaaatggaatccatctgtgtatctacacatttagtgaacacacgttgtaaaaagtgttacagtttttacgataagaactcttgataggtaattttaatttctgaaaaatttatatgaactataaggtatgttggatctctttccctaacttaaaaaatatttcctcgcatttaaatattttccaatttttaataactttttattacttagacttttagttgatataaataagaaatgtgtattaaaagcctaccattttgatttaacctatgaaacacatttaaattcttggaaaaatccaaaaatacctagaaaagtgagctcttgctagaagatacacagttctttagtgtcaggctgagattatctaccagaaataacttttggctcatgtagctttcagtacactgtaagaataaaagatgtgaagacaacattacttaattggatttgcaattactcactattcactattaaccaattttattgaaaaaaaatgattccaatcaaatactctgattttaaatgtactgttgaacaagtacactcgtgtaaatgcctccaaaatcaatacacacaacatttctataactccaaaaagttttgtcctgctcttcaggaatcaacttgctttccacctcacagaacagaccatccttggtcagcttattgttagtatagatttcactttctttttaagaattttacataaatggaatatagcacgtgttcttttgtggctggtgactttcatgcagcataattgtttcctaggctcattcatgtcgccctgtgtcctcatgatgtgttactcttcacttttgggtactatttaactgtgtagtaatttcacaatgtatcccaccacctgctgatagatatgtgggttgtttccactttgggctattatggataaagctaccaagaatggtattatacatggctttgcatgaatatttctttatttcttttaggcaaatacccaggagtgcagttactgggtcttacagcaagtgtttaatactccaccaaactgttttccaaagtagttgtaccattttacatctcagccctgaattgatgagtgttctcaatgtttcagctacttgtttttaagaatttttcttaatcttcactcaacagtgaccagaatggctaatcatcattaagtcatgttttccttacaattctcttgacttttatgggtgcttgacttgtattaggatattgaaaacaggatcaatattgtctaaaccccctttcaaacacttttcctaagtcatgatatttaggatgataagaggagatctaaagggactgctggtagtagtaacaggcattattcaatatttattatcatactccataaggcaatacattttgagtgaaatagcattcaattagactcaggataaaaagcttctaatctcagctttagcattaaatattaggaaacctttgagaaaacaatccaggaagacaaatcagagtgttttgctagtggagaagtgctgcaacacctaaaccctattaatgccagatctttgcagtgatttccactcataaagttgggttgactccttgccttgttctcctatgtgtctgtgtgacttcatgctgaggggatgtgacatcacagagggagaagtgcacttgtgtacagaaacatggcttaggagattggctttggaggtggctgcaatgaaatatacgttttgaagaagttccctatgaaatgtcttataaactgtttcttctggccaggtgctcgggctcacacctgtaatctcagcactttcagtgaccaaggagaaaggatcaggatcatgtaaggccaagaatttgatgcaagcctgggcaacatagggagaccccatgtctacaacacacacacacacacacacacacacacacacacaatttgtgaacaatgtcatcacaaagtgattatttatgaacatttgctcagaaaagtagaaaataaaacaatttcttctgagctaacaatactataataaagacgttagttatttaactatagtaaatacagagaatataagattgtctatcttaaccatacttgagagtgcagagaagtggcattaagtatattcacatgttctgccattattactgacacaatcagtaaaaatcttttcatcttataaaaattaatatgtataccccttaaacaatactccacccattttctctatccctacctccagcaacctccattgcagttctgtctttatgtcaatgacatgtttgaagcaacttcgctgtgcactggttaccaacgtacttgagcgtgggggaagagaacaccccccacagcaagttacatgaagtgggtttattattacagataagcagcaagggaacacaaaattcttggactcattatgggtcagtcccccaaggcacaggaaagctatgtggagctgatggagttgactatgtgtaccccacatacaccacagtgcaggaacccaggaaagcagccactctgggttttgtatcctggggtaaaaagacacacagggctgaagtgctaatggacattctattctatgggaaactggtatagaggacaggtaggttgttctgctcagttcctgtctatctcaggatgttacaattccagcacgttctgcaattgtacttgagaactcttaaaataagcaagaaagtggagagaactaagtcagtccagggtcattgcagaacggtcttgcagttatctcatcccccttagcaaagctagcatacttcatatgcccaccaacttcccctgaactggaggcagaggtttatcttttcagattgatgaagcaccttgacttacacaatctcaatgcagattatgaagccatagtgagagtacatttcactgggccatgaaaagctagtaccactggtaggaggataaaactccccaagcagtgactaagatgttaagaggtgaaagggggatcttttgatgtcctattgtctgcagccagtgagcctgctttatgatcacccctacttgtatttctaggatatctgaggtgtttatccaggtacagcagccagtgttgggtgttggtaattgcatggaaagtccatttgtttccatgagagtgtgcccattgttatgttgattgggcagtgaggctgtttcttggtcagagtgaagtctcatggaatatccaaaaacatgacataaattcctctcaagggtggccatggtagccccagcatctaatagagtgacatatatttagctgtccaggaagcaagctattgccatagtccttttctccactcatgagatcctttaatagttcagtcactcagttgctattttcctgaccagacagctgggctgttggcaatggcccatgatttagtggaaatggagcaaaatatagtgttgggggcagcctgcatggctactatcatttcatgtagtttgtcccattgggcagaatgaccatgttcagtgtcagtcaaaagatgccatcccctggctggatggtggctgcacccagtggatccactggcatgtgttttgtacaatcatcagggccccatgccatactgacacaggcatgtctctgaatctttggctctatgtggccaaaggagaagctaaattgtcccctatgggccatttgttcccttctagcaagcttgccatttactcatggggcacatgggtcctgtgggatcctggttagggctgattctgactgtatcatttccacttaatgatttggatctgttgggcctgtccagttttattgattgtgtttgtaggtaccaaagtgagaatggttagttaaggtcgcagcgtcctgcctggtgctctagctctgagatactcagcccctatcagtttcctacagcaagcaaggagctgccattcaaaagaggcacaactgttggctgcttcaggaaattttgtgtccaaaatctgagtctggtgcacccagtgacactagaatcacctgacatcagatgttagtctgagccctgatgtgtgatacaatgtgaagggttcaggaggggtcattcttcttggcaaattaggtgttcagaagagccagtagcactctaaatctcggttgggggaaactcaaattattgagtccccacagagacctccataacattggttcatgagactcccagggaaagctgggaaagatgactgactgaagtccatgtgttgaatcattctcattattaaaagcccctgctcattaatggcatttcgattagcatccacttggaaagcattttttttttttggattatggctcattttaaaaacatctagtcatagctcttccacaatgactttgtctgtaatcatcctgttgcatttcttttaaggcctgatgatctgtcaaaaccaacagccaatattattaaaatgttattctctttgcaatgtgatcatcagacataggccttgcagtttacccactgttttgatttttacatttccagggcttccttgacaatggcactgatgtgactccatccagcatccattgttgtgagaactctatttggcatatcatcattgtgggcatgaacataatggagactttcataggatgcaatgattaatattcaacattagtcaaaatttcttctagtcctacccttggagctctactgggttggaaaatattttcggacaaggacaatcatttggtagagttttaaaaataaaggctacaaataaattttccatagcaagagtatgaactatgtgtggtccagaatacaattttttatggaatgtaacaaaaattatttaaatgtattcaatttagataataattttacaaataggcatatattgcatatataatagaattaacacacttaagtatgagtactatatatatagccaacattttatcaaataatatattgacttgtatgtatcttacatacatgtatgcacattttcccataaatatggtaaattttaattttttattgaaatattagttttaattttgtcattaattttctaagtttataatttgattactaaatatttacatttatgccactaatttaagaaaaaatacatgtgtgtatatataggtagaggtgtaaatactgtatcaggaagcttttatgcattaatgattggtaactggctaaatacacaactcagtgacagaaaatagtaaacatttgttttcatgttcatagatgctcacgttcacagtaatctggctgatcaaggaagggttcaggtgagtggtttctctgcatggcactgagctcgtcttcagcctacacatatcaactgtctgaggacaaggctgaacagcaatgactacccatgactcaagattcttctggcaggtcacaagagtgaacagcatcccaaaccaaactgcacagttgagtttaagtccaataatttctaacatagcttcacacatttcaaatatattgctttatttcagtgagtacaaatttttaagaaaatgtttactccatttaattatagaggtgtttgatcattccatggacaaataattatgttttcaacctttacaatattgaaaatatttgcaaatgtaaatttgcattaataagaaaataaagctggatgtgttttcaacatgtggctttaaatataatttatttaaatggcctcatgggggaaaatcattttaacttacataaattctcattttgtctctcttgtttcttatagagttgcccaataagaagtcctcccatgagatttggaagtccgaaaaggatgactcaatattctccattggtacctaagacagacacagggacagacatgaggactagagaaacacctgaaaagatgctgtaggaagctgagagcatcaacacccccacccctaagcttccagacaggactgaggaccatatggttagaaagcccatacttcagaggaagatgcattctgttgcctgagggaggatcagagattcctgcttctaatatcagctttcatgactactatatccttggctttgaaaggttgtagtgggaaacttaatcttaggaatttggtcattcttgtcatacccaacagagcaaagaaaccagtggggaaaggcactcagggtgcaaaatattgtttctagaatgcaattgaaataggccctattatcccatggaactaatgtttatgtttttttgtataaacatagaaattgactcccccagtcttaaaactcaagatagttacatctgtcttatctgagtttttttttgtttgtttgttttttcagtaaaccaatgaacaggcctcccagatactatcaaggagctgaaacttacatatcactgaatcgggacagtgagacatcagaaccttcacccattatgattgcctcactgacctcctgcttcctgttgaccaaattatcttccttacccctccctaattcctgttttcccacatttcttccctgctatataaactcctaatttcagttggtcagggagatacatttgagaatggtatcacatctcctaggctgcagcacctgattaaagcctgttccttggcaatgcttgttgtcttagtgattggctttctgtggggtaagctgcagggtcttcactgaatccctgacatttcagtaacaaaattctctgcaaccttcactgctttggcttattgtaacctgaaatcaaatttgtccacaacttctgagataacttgatataattctaggattcattttgtccaccactgcttaccagtctgagcttgccagctcccaacccttcctagtgccaatgaactttctcaaagagccacaggtaacattttccctttttcataaaatgctaattttctcttcgttcttccaatatcttgaagaccactgagttttcctgtatgccccacctggcaaatatttctttgcaaataaaacttaaatttagagattcatctctacattttattttgactttagtagtttactttaattctctgtattaagacaattcctgcttagaatatctatagtggcttcttctgtgttatatgaattcaagctgaagccataaactagactcctcaagtgtcatgatctctgtatttatcaaatcaggagatgcattgctatgtctgtgcagttggggctgagaaagagaaaagaattagggtgcagaggcgatttcacgtacccctctaccaacaccatcagagtgtggctgcatctgagcaacactctcagccaatggaggcatcaggaggagcagctggggcagcccagcttcacacatctgcttccctgggggtttatgttcgggttggtaacactgtgggagggaaactgttagcctgttgacaatagtaagttgcaaaatcttcaggctgcaggctgctgatagtgagagtgaaatctgtcccagatccactgccgctgaaccttgatgggaccccactttgcaaactggatgcagcatagatcaggagcttaggggctttccctggtttctgctgataccaggctaaccagctgctaataccctgactcgcccgacaagtgatggtgactctgtctcctacagatgcagacacagaagatggagactgggtcatctggatgtcgcatctggaacctgagattggaaacataaaaacaaatgtccacacaattaatcatgctgtaagagaagttccctgaatagtaaagcagtactcagcacactgaccgagtataatcctagtgttctcctttcttacctgggaaccagagcagcaggagccccaggagctgagcggggaccctcatgtccatgctgtgtcctgactgggtctgactcctgcacagggtgtgatcagcctgttaataagtcttcaggtcaggagactgtgctctgggaacatgcaaatgagcaggggatggggcaggctgggcgcagctgcagggctggctcatctcagtaactcagcaccagctcagtgtccccaggtgtcccaggtaagaccagggtagcacaaatttgtctgcagagaatgtgtttctactgggaactattttgttgtgagtaacattttttggtttctttttgacgatttgaaatattcctcaggagttgatggactaatgtatttcattggtgtatggggattatttaggagaatattgttgtttgtaggaaacacatagtaaaatgttagacggtacaattctcaagtcttcaaaagactcttatatgattccggctagggaagggggtatttgtcgtatacatgcaacatttctgtgagtttaacattgttcctatgtaaaaaaattaaaaataaaatttattgacatgatggtacatacatttttaagtatcaggtaatggtgttatgccattgttcttaccagtatgcgatcaaactatgtactatagatacacaaagatgataccgtgttttctcgatgcatgcaacagtcacagatccacaattatcaagagcgacaggtctctatagtactcagacactaaatgggctgcaccttattcttgttttgggcaccttcatagtctaccttcttttctgccattcagtattatttcccaaagttcatctctcttactgagggtgaccactgcatggagcatgtccctgccatgcaccatcaatgacactttcctcttttactttttatcagtgattggggaaatcattctgacccagacaacagcctccctgttaactgctttaggaaagagacactgaatctcttatcaagcagttgcctatgtacatggagaaatcacttggatccagatgaaactggacagggatttgcactcgttatatctcatatctctaatgtgcccaaaaatgtcccagcctgactcagtagcagggaaagtggatccaactacatcagcatcagtgggctgccacctaggactccacaaaattttactgatgcctgactaggggagccaaatcacagtgctgcaggctgtgcacaaaccttcctgctgttttttaagctgcctgaattttaagggaacttgcttatattgggagaaaggaagaaagctccatttgtcctctaaatatttgctgaaaatgaatggacaaaagaaagattaataagagaaaagacaaacaaaattcatttgaagtgcagcagaatatcatagcagggtgattacccagataactcaatgggatacagttgtttatatttcttttctaaggaagagggaattgagaagcgtaggcaacctggaaagaatagatgagaacagaagtgcatcctcaaaagaacaggtcatagcctgtctggataaagcatcaacttcagtctcttgtattttagattcctcttttgtgttaatattccctgatgtaaaaattctcaggaagaatttttttgacaattggtttccttctggagaatctgctattatgcagataagggacatttaggaaaagtctttttgtgcatttggtgctttctaaatgtctttggttttacataatcatcataccagtgcagcatagtttgagatgttattttctggattcctttacttgcaacccacctgccaagatcctgttccagagagatgcagctacagattgaatgagcagttgacccttgaacaacatggaggtttgggcactgaccatgggtgcagatgaaaacctgtgtaaaacttttgcatttctaactccaggcatcatcttgaaagtggagaaagcagaccttaacctgcccatgtcttgatctttaatttcccattctccagaactgtaagaaaataaatttctgttccttatgaattacatagtgacaattaatctgttatagcagcttgaaatagaacaagagagacagcgcacaatcagtgaggacacgatgaggtgtatacataccccagcttcctcatctctcaggtggaatagcccagaggaacttagtccatgtttcctcatgtggttgatctttggttatcctgagtcaggtaggttgttgatgtgtctttttccattcatcttctgttctcttcctcactttcctcctttcctcccagtgtaaatttgctgcctaaacagggatcctcattgagggtggacccaaactaagatagttaaaaaaaaaattgttaatcttttgtaagaggggtatttctcatctgaattctgataatttctttttctttgacatgtaggaatattcaggaggcacttaattttttttttttttttttaccaatctgttttacattcaatttttgaactgattttgtttttctgtgtgttaaaaccaaaaattaagttgtaagccaccaacctgctgaatggactcctcttttgtaaagagcacttcaaagaaatttgaaaaactaggttaggccatgactggcaggtgggtttagatgtgcctcattatactttggagttcagacacaactgaccaacattgtcattacaacagagatctttgggctgacaaaacagacgctttgtagcattaagataccatattccaacatgacagataataggccctgaagaaaatctaaatattttaccttaaaaatatttcttcatcatattctgaagtggttctgcaaagctgccagttgtgggggaaatttgcattctatagagaatctcctccccttactaagtcttttttaaagtctgacattttttaaagctctgataagcaacattcaccttgtactttatctgctactgataggattcatctacatgacaagaaccttggcttccacatccccttgtctacactcaagcatttctttatgatgaattcaactctttagacagaccttaactctttcaaccagtagccagtaaggaaagctttgaattcacctatgacctggaagcccctgcttcaagctatcccacctttccaggacaaactaatgtatatcttatatgtattgatttatgtctttccctgtatttctgtgtttccctaaagtgcttaaaaccaatgtgtaatccaaccgccttgggcacatgtttacaggaccttctaaggctgtgtcacaggccataagccttatctttggcagaataaccctgtaaattgattgagacctgtctcagatactgttttgtttatactgggtcacaaaatttaaaaatcctctaaaactatctacacatcaataaatctacattagagacagtggagtgagcataccccaacagataaaactcacaagttagaggaacctgagtctaagattttgtccacctcccttgattcataaaaatacttcgtgattttttaaattttactttagagaaggacaattttggggaatatgtttatggtcggtggaatgaataatatcccaccccaaaggatgtccatgtcctcatctctggaacccaagtgttataggagtttttaagaaattattttaggcagataggaaaaggggtccttgggaaggttttgtttcctttaaagcagctctagaaacacttcttgtctagccagaaagccctggctcttagagccaggctgggaagctttcctatgcaaatcatagccattagaaactggattcacccaaacatggtgattcccaccattttcttccttgtcaacacatgtgcctgggaaaaacctgaaagatgctataggaagctgagagcagctgcaaccccacccttaagctttcagacaggactgaggaccacatggttagatagcccatacttcagtggcagatgcattctattttctgagggagtaccagagaatcctgcttctactgtcaacctgcctgactactatatccttggctttgaaaggttgtagtgtaaaagttaatcataggaattcggtcattcttgacatacccaacagagccaagaaaccaggagggaaaaccactcagggtgcaaaatattgtctgaagaaagcaattgaaataggccctattatcctatggaactaatgtttatgattttttgaataaacatagaaactgactcccccagtcttaaaactcaaggtagttacatttgttaatctgagttcttttttcaggaaaccaaccatcaggcctctagatactatcaaggagctgaaagttatatatcactgaatggggacagtgagacatcagacccttcacccattatgattgcctaactgacctctagcttcctgttgactaaattatcttccttacccctctctaattcctgttttccacatttcttccctgctatataaacccctaatttattttgtcagggagatacatttgagaatggtgtcccgtctcctcggctgcagcacctgattaaagcctgttctttgacaacacttgttgtcttagtgattggctttctgtgtggtgagccgcaggatctatactgaatccctggcatttcagtaacaaaattctctgcaagcttcactgctttggcttattgtaacctgaaagcaaatttacccacaacttctgagataacttaatataattctaggattcagtttgaccaccactgcttaccagtctgagcttgccagctcccaacccttactacagccaacaaaatttctcaaagaacaataggtaataatttccctttttataaaactctttgctcttccaacatattgaagaccattgagttttcctgtatgccccatttggcaaaaatttcttagcaaataaaacattaaatttatctgtacattttatttagacttcaatactttagactctaattctatctattaagactattcctgcttagaatatctataatggcttcttctctgttatatgaattctaaccaaagccataaactagactcttcaggtgtcatgatctctatctttattaaatcagcagaggcattgttatgtctgtgcagctggggctgagaaaagaaaaagaaattgggatgcagaggtgatctcatatcctcctctaccaacaccatcagagtgtggctgcatctgaggaacactctcagccaatggaggcatcaggagaagcagctggggcagcccagtctcacacatctgcttccctgggggtttatgttcgggtttgtaacactatgtgagggtaattattaaactgttgacagtaataagttgcaaaatcttcaggctgcaggctgctgatggtgagagtgaaatctgtcccagatccactgccgctgaaccttgatgggaccccactttccaaactggaggcatcatagatcaggagcttaggagctttccctggtttctgctgataccaggctaaagcactgctaatgccctgacttgcccggcaagtgatggtgactctgtctcctacagatgcagacagggaggatggagactgggtcaactggatggcacatctggcacctgagattggaagcataaacacaaatggtccacacaattaatcatgtagtaagagaatttccctgaatagccaggctgtactgagccccctgggctgagtaaactgttagtgttctccttccttacctgggagccagagcagcagaagccccaggagctgagcggggaccctcatgtccatgctgtgtcctgagtgggtctgactcctgcaagaagtgtgaccagcctattaagaagtcttcagggcaggaggttgtgttctgggaatatgcaaatgagcagaggatgggcaggctggacacagctgcagggctggctcatctcagtaactcagcaccagttcagtgtccccaggtgtcccaggtaagaccagggtagcacaaatttgtctccagagaatgtgtttctactgggaactattttattatgagagacattttttaggttttttttgacaatttgaaatattcctcaggagttgatggagtaatgtatttcattggtgtatggggattatttaggagaatattcttgtttgtaggaaatatataataaaatgttagacggtatgattatcaggtctccaaaagactctcatatgatcccggttagggaaggggttactttgtcctatacttggaacatttctgtgattttaacattgttcctttctaaaaaaatcaaaaataaaatttattgacatgatgctatatatacctgtcagtattcggtaatggtgttatgccattgttcttaccactataagatcaagcaatttactacagatccacagagatgatgcctatgtacatggagaaagcagtttgatccagacaaaactggaaatgatttgcaatcattatatcgcacatatctaatgtgcccaaaactgtcccagcctagctcagtagcaggggaagtggatccaactatattagcatcagtgggctgcagcctagggctccacaaaattttactgatgcctgagtaggggagccaaatcacagtgccatagcccgtgcacaaaccttcttgctgctttgtaagccgcctgaattttaagggaacttgcttatattgggagaaaggaagaaaactccatttgtcctctaaatgtttgctgaaaataaactgacaaaaggaagattaataagagaaaaggcaaacaaaattcatttaaagtgcagcaggatatcatagcagggtgattacccaaataactcaataagatccagtagttcatatttcctttccagcgaagacggaattcggaagtgtaggcaatctggagagaatagatgagaacagaagtgcatcttcaaaagaacaggtaatagcctgtctggataaagcatcagttcccagtctcttctatttttgattcctgttttgtgttaatcttccctgatataaaaattctcaggaagaagttttttgacaattggtttccttctggagaatctgctttttggcagataagcgatgtttaggagaaggctttttgtgcatttgctgctttctaaatgcctttggttttatgtaatcctcatacgaatgcagcatagtttgagatgttattttctggattcctttacttacaactcacctaccaagatcctgttccagagagatgcagctacagactgaaagagcagttgacccctgaacaatgtggaggttggggcactgaccacaggtgcagatgaaaacctgtgtagaacttttgcatttctaacttaagtactaatagcttacttttgactgctagccttaatgataaaataaatagttgattaacacttttttaagttatttatatcatatactctattattccaataaactatgctaaagaaaaaaatgtaattaagtaaattataaaaatgagaaaatatatttactacttattaagtacttgcttacaggtgacacacacagaagaaaatacaagtggatctgcaaatttcaaacccaatttattcaagggttaactgtaccaggatgaatataggagtctctatctgtattctagggctttctctttgctgtacctctgctcacttccaatggcaatatacatgtcttatgttctttacagtcttgggcagagaactctgcctgcatgcattgctgaccaaatgacctggaaagtgtatctcttaggaaagtgctatggtttcactgtgtcctccagaatccatctgttgtaaagttaattctcagtgtaatggtattgccaattggggcctattgggatgtgtttagatcatgagtgtggtgccctctagtggaatacattaatgccagtataaacagcaattgtggggctgggatctctctctcttctgcttgtctgtcatgttaagacatggccttccttcctttgaaggaccccaaactccaggcatcatcttgaaagcaaagaaagcagaccttaacctgcccatgccttgaacttaaatttcccattctccagaagtgtaagaaaataaatttgtgttctttatgaattactcagtgaaaaggaatctgttacagcagcttgaaatagaacaagagagacagctcacaatcagtgaggacaggatgaggtgtatacatacttcagcttcctcatctctcaggtggaacagcccggaggaatttagtccatgtttccacaggtggttgatcttcagttctcctgagtcaggtgggttgttgatgcgtcttttacaattcatcttctgttcccttcctcactttcctccttttctcccagcgtaaatttgctgcctaaacaggaatccttattgcaggtggacccaaactaagacagtaaaaaaaaaaaaaaaatcgttaatcttttgtatgaggggtatttctcatctgaattctaataatttctttttctttgacatgtaggaatattcaggaagcacttaatttttctttaccaatctatttcagattgaatttgtgcagtgattttgtttttctgtgtgttaaaaccaaaaattaagttgtaggtcaccaacctgctgaatggactcctcttttgacagaaagcacttcaaagaaatttggaaaactagattaggccatgactggcaggtgggtttagatgtgcctcattatactctcctccctttggagttcagacacaactgaccagcattatcattacaacagagatctctggactgatgaaacagatactttttagcaataagataccatactccaatgtgacagataataggccctggagaaaatcaaaatattttatcctaaaaatatttctttgacatattctgaagtggccctgcaaagctacctgttgtgggggaaatttgcattctatagagaatcttctccccttactaagtcttttccaaagagtctgacatttttttctaaggtctgataatcaacattcaccatctactttatttactacccataggattcatctacatgacaagaaccccccattttctagactcaagcatttctttatgatgaattcaactctttaggcagagcttaactctttcaaccagttgccagtcaggaaagctttgaatccacctatgacctggaaacccctgcttcaagctatcccacctttccaggacaaacttatgtgtatcttatatgtactgatttatgtctttgcctgtaatttctgtgtctcctaaagtgtataaaaccaacgtaaaatccaaccaccttaggcatatgtttgcaggacctcctaaggctgtgtcacaggccataagccatatatttggcaaaataaacctgtaaattgattgagacctgcctcagatagtgttttgcttacactaggtcacaaaatttaaaaatgcctaaaccgcagcagcccggcattcctccaggacctcctcccctgggatcttgcttcaagtgctggaaatctggccactggaccgaggaatgcccacagcctgggattcctcctaagccgtgtcccatctgtgcgggaccccactggaaattggactgtccaactctcctggcagcgactcccagagccactggaactctggcccaaggatctctgactgactccttcccagatcttctcagcttagctgctgaagactgatgctgcccaatcgccttggaagcctcctggaccatcacagacactttgggtaactcttacagtggagagtaagtccatccccttcttaatcaatgtggagtctacccactccacattaccttcttttcaacgacctgtttcccttgccaccataactgttgtgggtattgatggccaggcttctaaatctcttaaaactccccaactctgatgcgaacttggacaacattcttttatgcactcctttttagttatccttacctgcccagtttccttattaggtcgagacgttttaacaaaactatccacttccctgactattcctgggctacagccacacctcattgccacccttttcctcacttcaaagcctcctttgcatcctcccctgtgtctccctgccttaatccacaagtatgggatacctctactccttccttggcaactgatcatgcaccccttaccatcccgttaaaacctaatcactgttaccactagagcgtgttatcacccacctgttacaacatggcctcttaaagcctacaaattctccttactgagggaagagagagaccctctcatattgttttatattgttttatactcagtacctgttttaagagtaaaaatcaaggaagtgaaatcagagacaggcagcccggcgccaggcctgggcctgcctggcctaaacctagtagttaaaaatcaactcatgacttagcaaccaatgttatccatagattccaagcattgtatggaagaacattgtgaaactccctgttctgttctgtttgactctgactaccagtgcatgaagaccctgttacataacccctagattgctcaatcaatcacgaccctttcatgtaaaatctttagtgttgtgagcccttaaaatggacagaaattgtgcactcaaggagctccgattttaagacagtagcttgccgatgctcccagctgaataaagcccttccttctacaactcggtgtctgagaggttttgtccatggctcatcctgctacattacagctcccctatcctacccatccaggaaccagacaaatcttacaggttggttcaggatctttgccttattaatcaaatcgtctttcccatccaccttatagtgccaaacctctacaccctcctatcttcaatacccccttccacaactcactattttgttattgacctcaaagacaccttctttactatccccttgtatccctcctctcagcctctttttgcctttacttggactgaccgtgacacccaccaatcccaacaactcacctggactgttctgccccaaggcttcaggaacagcccacactacttcggccaggccctttctcatgatctgctttcttttcacctgtctgcctcccatcttattcaatattttgatgatcttctttgcagtccctcttaccaatcttcccagcaggacactaccctgcttcttcaacatctctatttaaaggggtaccgagtatccccctccaagacacaaatttcttcccctagtgttacctatctcggtataatcctccatcagcatacacatgcccttcctgcagactgtgctcagttaatctcccagacccgaatccccaccacaaaacaacaactcctttccttcttaggcattgttggatatttccgactctggataccaggctttgctatcctaacaaaaccactttacaagctcacaagaggtaacttaactgatcccatagaccctaagttttttgcccattgttctttttgctctctcaaaaaggccctggagacagctcccacactagcactccccaactcgtcccatgctttttccttacacacagctgaaatacaaggctgcgctgctggagtcctcacacaggagccaggcccacgacctgttgcctttctatcaaaacaacttgacctcacaattctggtgcagccctcatatttgcgtgcagcagcagctgctgctgtaatacttctggaagccctcaaaatcacaagctatgctccacttaccctctacagttctcacaaccttcaagcattaatatcctcctcacacctttcacacttactgtctgcccctcgactcctccagctctattcttttattgaaaccccaacagtaactattggccatgggcacgatttcaacccagcttctcagttagtaaccaacacaagtcctgaaccacgtgactgtatttccctaatacacatagcatcttcctcctttccttgtatttctattcttcgaattcaaaatccagaccacccaatcaattttcaccaggtaagctggatatgctgtcatgtcccacatctctattattgaaactgctgctcttcctccctccaccacttcccaacaagccaaactgattgctttaactcatgtgctctctctcgctaagggaatgcacattaacatttatactgactccaaatatgctttccacatcttccataaccatgctgccatctgggctaaaagaggcttccttaccacacaaacctcttccattatctatgcctccctaataaaggccctccttaaggctgctctcctgctggccaagcctggagtcattcattgtaaaggacaccagaaacctactcatcttattgcaaaaggaaatgcctatgccgacaggacagcaaaagaaataaccaatgcctccacacccgctaatattccagctcccactccagaggaccagtatttttcttccttatctatcactaccacctactcttttgaaagcctgctctactagtcttttccaactcagggaaagtgcttcttaaatcatggaaaattcattcttcctgcctcacaagctcagtccatgctttctttccttcatgaccacttccatgtgggatacaagcctctggctcgcctcctgcagcccctcatctccttctcttcatggaaatccatccttaagacagtcacctctcaatgctcgtctaccatgccaccagcccccaaggctttctcagccctcctccttttcctacgcatcaggctcgtggatttactccaacacaagattggcagattgacttcactcatatgccccatatctgtaaatttaaatatctcctggtttggattgacaccttcactgggtgggttgaggcatttcccactatctctgaaaaggctactgcagtcatttcttcccttctaacagatataattccctgatttggcctccctacttctattcaatctgacaatggtttggcttttattagtcaaatcctccaagctgtctctcaagctcttgatattcagtggaaacttcataccccctaccatcctcagtcttcaggaaaggtagaaaggagtaatggtcttttaaaaacacacctcaccaagctcagcttccaacttaaaagggactggacagtatttctaccacttgcccttctcagaagtagagcctgccttcaagatgctacagggtacagtccatttaaacttttatatggacttactttcttgcttggccccaaccttgttccagacaccagccctctggacaactatcttccagtcctccagcaggctagacaggaaattcgcccgactgctaatcttctctttcctactccagattcccagccatatgaagacaccctagctgaacgatcagttcttgttaagggtctgagccctcaaactctacagcctcgatggactggaccctatctagtcatctatagcaccccaactgctgtccatctgcaggaccctccccattgggttcaccattccggaataaagctgtgtccatcggacagcaagcctgatctctcctcttcctcctggaagttgcaagtactctccactacttcccttaaactcactcacatttctgaaaacagtaataacccttatgaacctaatatgttccttcattctattaggtctattcatccttactctactttttgcaacagggctttacacagtcacccccactacttggactgtgccccaaaacttgtcatccctactatcttctgtctagtcatactcctattcaccattctcaactactcataaatgccctgctcttgtttatactgccggtttacactgtttctccaaaccatcacagctgatatctcctggccctattgccaaaccaccactcttgactccctcttggagtggatagatgatctttgctggcagggcacactccaatattttcaccatgatgaagtcctattctttttttttatactcactcttattctcattcccattcttatgccaccctctccctctccccaactatctccactacactatcagtctcactcactctctcccagccatttctaatccctccttagtgaacaattgctggctttgcatttccctttcttcctgcgcttacaaagctgtccctgccttacatacctactgggcaacatctcctgtctccgtacatctccgaacttcctttaacagccctcacctttaccctcctgaagaacttctttactttctagacaggtccaggaagacctccccagacatttcacatcagcaagctgctgcccttcttcgcacttacttaaaaaacctttctccttatatcaactctactccccccatatttagacccctcacaacacaagctgctattcttgtggctgctcctttatgtatctcttggcaaatacccactggaattcccctgggtaaccttgcatcttctcgatgttccttcactcttgatctccaaagcccagctacacataccactgaaacaattgtggctttccagctccatattacagataagccctctatcagtactgacaaacttaaaaacattagcagttattattgcttaggaagacattaccctgtatttcactccatcctttgctgccttccccttgctcttcagactctcctcccaggccctcttcttgtttgcttatacccagccccgtaaataacagtgaaaggttgctcatagacactcgacactttctcttacaccatgaaaatcgaaccttcccctctatgcggttaccccatcagtccccattacaacctctgacggctgccgcgctagctggatccctaggagtctgggtacaatacacctcttttagtactccttctcatcttttcactttgcagctctggtattgccttgcacaaggtctcttcttcctctgtggattctctacctacatgtgtctatctgctaattggacaggcacatgcacactacttttcctaagtccctagattcaatttgcaaatgggaccaaacagcttcctgttcccctcatgaaaccgacacgataaaaaagtgttattccactaattcccttacttgtcagtttaggactttctgcctccactattgctctcagaactggaatagcaggcatttcaacctctgtcacaaccttccgtagcctttctaatgacttctctgctagcatcgcagacatatcacaaactttatcagtcgttcaggcccaggttgaatctttagctgtggttgtcctccaaaactgccaaggccttgacttgccgctgaaaaaggaggactctgtgtatttttaaatgaagagtattgtttttacctaaatcaatctggcctggtatatgacaacataaaaaaactcaaggatagagcccaaaaactcaccaaccaagcaaataattatgctgaacctccttgggcactctctaattggatgtcctgggtcctcccaattcttagtcctttaatacctgtttttctccttctcttattcagaccttgtgtcttccgtttagtttctcaattcatacaaaaccgcatccaggccatcaccaatcattctatatggcaaatgctccttataacaaccccacaataccaccctttacccgaaaatctttcttcagtttaatatcttctacactatgttcccatgccacccctaatcccactcgaagcagccctaagaaacaatgcccattctctctacataccaccaccaaaaatttttgccaccccaacacttcaccactattttgttttttcttattaatataagaagataggaatgtcaggtctctgagcccaagttaagccatcatatcccctgtgacctgcatgtatgcatccagatgacctgaagcaactgaagaacaacaaaagaagtgaaaatagccagttcctgccttaaccgatgatattccaccattgtgatttgttcctgccccactctaactgatcaattaaccttgtgacattgcttctcctggaaaatgaatctcaggagctcccccacaaagcaccttgtgacccctgaccctgcccacaagagaacaaccccctttaactgtaattttccactaccctgcccaaatcctataaaactgccccacccctatctccctttgctgactccttattcggactcagtcagcctgcacacaggtgattaaaaagctttattgttcacacaaagcctgcttggttgtctcttcacacacacatgtgtgacagattacagccctactgacaccttaacattagctcagtgagacttctgacacggggtactatattttatttgtgtgaagccaataagactgtggtgatttaaacagcagcattggaaactaatgcaaggggaagagatgtctttcacctcactgagagcatggttgtcctctgttcttggaaatatttccaccttgttatctggtgtcaattatgacatattttctagtatttaaagaaaagatctgctgccctaaaatcctatgtccagtaaaattattatttagaaatgaaggacaaattgagaagtcctcagttgtagaaaaactaagagtatttgctgccaacagatccactttaaacataggcaaaatgagccctaggaagataaaactaaagataaagagaggatattaaataatgttagggacaaaaggctacaaaaatgagaagatagatggatataatgcattgctaaatcatgtgtgatagttgtatcaaagttgtaatactgtttttttcctaatatatgcagataaattacttttaaaaaacaatctatttacaatgggggaggaaacatgacataaaaaaggtaaaattctatatttattttaaatggtaatatattgatgccaacatactgtgagaagctatgcatataaaggaaataccatgacaaccaatttgaaaatcattataaaaagagataccccaaaattaggcaaaattaaaatgaaattgtaaagatgttcaagtaacccaaaagaaggcagcaaaaagaaaacagagaagcaaaaaaagatacagcaaaaaagtagagtgcagacttaaattttaatatatcaatatcaatatattaaatatgcaaattatgaaactttgaaaaagacaacaattgatgaataaaaagaaatgtcccaactgtatgttatctacaagacactcacatcaaatataacagtataagtagattgaatataaaaggaaggaaaatggtatactatgcaaacattaataaaaagaatcagtagcaaatactaatatcagataaagtagactacagagccaaagaatgttaccagggacagaaaggtacattacataatgaagaaagtcattttggaaagaagacagagcagttctaagtgcgtagacaccaagcaaaagagcgatatagtgcatgtggcagaaactaacaaaacaattgcacacggagacttcaaaaccccttgttaatcttcgataggacaactggacagaaaatcagcaaggatttaggactcaacaatatcatcaacccacgagatctaactgacatttatagaacactccaacccataacaatagaagttcacatttttttcttccaagtgcccacaacatataccaagataggacatatcctgcccacataacctctcaacatatttgcaataattaaaatcacagtgaatgtgttctctgaccatggagggatcaaactagaaatcaatattgaaaatgtaacctccaaattttcaaatatatgggaactatacaatattgttctttccaaagaaccagcctttggtttgcctggtgttcagtgtcactttttctgtttgcagttttattgatttctgccctaatatttattatttattttgctcatgttctacttcagatataaattgctcctctttatgtagtttcataaggtggaagtggagattattggttttatcccttttattttctgaaaaatactcatatgcatatgtttatctacatgcatacacaggcataaatatgtgcagatgcatattcatacacgtggttttaataccataaattaccctgtaagcgctgctgaatacctatgcatattttcttttctctgagctcaaactccactcacttgcaaacctgcccacttaatctgcatgttcattggtgtctcaatctagaattgagcaaaaataacaaactcctttcattttatctcaactttcttggccgctaatacatttaacatcagtaagtcagaatctatctaatagattaaggccaaagctgccaggtcactcctaatctgactcttctcacaccaaggagtgtaaatgacattgatttaaaaatatggtatcatctgcctatgtctccaacaatcttcactgccccaaaactagttaatgccaggatccactttgcccagataagcatctcttctgcttctcacagcccaattcgagtcattactttgctaaaaaataaatatgaccatgggggtactttggttaaaaaaattcccagaatgtcctgctgtacctacaaaacatttgctccccaaacagaaaatgaaggccttattaatttcacatcagtcacatgtggtgatctttaagacactgagagaaaatgtctctgacctgccccctcacaaactttctcttttttacctcagttaagtcactctcctcatagtgcctttctctgtccttcacacgttcatactgtattccttctaagcgccttgattgtcatgaacctcagtgcccttcagaaacttctcttcaggtcagttgttctcctcatccaggtcagtcacctcctcagaaaaagtagcctctacctccctaactaactgactccttttcctcattaaccacttcctcttcccttgccatttttttcctttatgacccttaactttttctagaatctttttgttgatttatgtttaattagacatggcctttttttcaccagaaaagatataggtaaatgagagtcagacactgactttctcaggggtgcagcctagatacgttcctggaccagcatagttgctcaattaacactttattgaatgaatgaataatgaaaagttaataagaaactctccaagacataatcaacactcttaacctatacacattgaaaacaacccactgaatgtaaaacatggattattctgagtaatgagaagtttgaatagcagtgtgctgctcttcatagtcagctcttcatagtcagtgtgctgctcttcatagtttgtattttgctggggagataaggaagacatccaaagtccatgataatcaggtaagagtattcttatcttttttaaaaaacaagcaaatagactttgcagtcacaaaaaaattgcaataaatgggactacactatcacttaactctattggctcctgttcacaaaaacaggttgtattattaactcttctttgaaaacaaaccagctccaaacaaaatgccataaaatgagtatgtacagtcctccctcagtatccatgggaaatagtttccagggcaccctgcagatattccaatttttggagactcaaaacctttatgtaaaatgcacaatatttgcatataacctacacatatcctcccgtacatttcacaccatctctagcctccttatagtacctagtacgatgtctacacatgacttaacttgtgtagattcatccaagtgttactcagcacatggcaaagtcaagctttgctttttggaattttgtggatttttttttcaaaatatttttgatccaggattagttgaatccatggatgcagatcccatggatagagagctgactgtacagctccttataattctgagggtcagctctgtggttcttccattctgggctggctggactgatctctgctgagtccgctcttgtgtctgcagttaccctgtggttcatttgtgactggatggtctgatgtgacttctttaacctatctggaagctggtttgatgtgcaggttggacaacttttggtatcggtttacatgggtcaggaagatgggtcctattccccaatctgtattaggtttgttcccagatcaactctggggttcaagtctattcattgtgggttgtttgggagaaattctacatgaacaaagctgaactgctgtcatttattgctgttagcagttattgttatcctctgaaatgcatcttatataaccaagatctccccagggtggcccaacagtacagctcagctcagcccatcctgtcacttcgctggatgactgcaggtatgagaaaggcaatatgctcagtcacaggaaaggcaggggcccaccctggggctgaaacctgcagacacagcgttcacacagcttctttgcaaaatacgaagacttcattttctttatacttaagatagttatacatttttttctataatgtccctatgctatttaactaattttaattttcagaactggttgtatttattatttctgtgttaggtgctcttagtcacttatggcaagagtgagttaatagagacaacatacagattagccatggaacaatagagaagtgtgtgtattcagacaggataaagatcaaaggggtgacaaatacattcttttgagaagcagattctcatagatcaccacaagtcaaggtccacattcaaggtgcagtggcgtgtcagtcacattgtgcaaatggtcagctctgcacattaaacttggctagcacattgcaggaccaaaattacctataaaggtatggggaaaataaaccatcatggaaataacaatttgaaggagttctcaattatttatacttggatataaagcagaacgctacaatgaatgaacctacaacctaaaacctttaagccttttaaagaggtttctttttgtcagggtatttctcagcaaataatgataaaaaatttatggataaactacttgcacaattagccacaataaatcccttccctgtactcatcctttggttggcctcattctaaatggatgcaggtgttgcccatgtgtcttgctcaggccaataggataatagcagatgtgacacaagtggagtcttggaaagggcttgcacatcgaagctttcctctctctcacagtgcttggaaaccctaaggtcacaatgagaataagactgtgcccatctacagtcaatgtcagtggcatggctgctcttcggtctactatttgttcttaaaatgtgtgctaagtttgttatggccatgtaacaaattaccacaaatttatcagcttaagactacacccatttatcatctctcaatttctgagtcagcagtcggcacatggctttgtcgggtcctggccattggatttcacaagaatgtgccacagtgtagattgggcttcattctcacctgtgagtcccctgagaacatagatactttagagctctttcaggtagttgcagagctcattccttagcatttctatgactcagagcttcaatttctaactggctcttggctcaaggttgctcttagttccaagaggctgtggacaattccctgccatgtgatgctcacacaggcaatgcccacatggctggttgcttgttcatggtcagcagaaggtttcagagagtgtctctttccagtctgctatgacagaggcttatcgaatacaatcattggaaagacatctcataacctatgacatatcatatggattagaagcaagtctaggttccgcttgttctctgtggaggtagattatacaattgtgtgattcactggggagagggttctgctagggtgttctggcatctttagtttcctcaaatatcaggtacttgtactgagtgtgaaatctgtcctgtacttactggcattgactagtcctgtgacccctgggaacatcttgggaagcatactttgtaagagaggttttagggtaacctagctattggaagcataacatttgcaaaatatcctaatctttgtgatttctaacatgtcctcaaggttccttaattgcaattatcataagccaattatctctaaatatctgcaaaatttatatttaatagtaggaaaatgatttattaaggagtctattaaacaagactcagggaaatgatgtcaacacctaattgctgctgcccactgctagactatgtgagacaattttcatgaacaatagaacagatactgcatgctagacactgctgtgagcaccactggcctgctacctctagaaatgtttgcagaacgagggcaattgctatgagtctcaaaatataattttttttattatactttaagttctagggtacaagtgcacaacgtgcaggcttgatacatagggatatatgtgccatattggtttgctgcacccatcaactcatcatttacattaggtatttctcctaatgctatccctcccactgcccccgaccccatgacaggccccagtgtgtgatgttcctcaccctgtgtccaagtgttctcattgttcaattcccacctatgagtgagaacatgaggtgtttggtttcttttccttgtgataggttactgagaatgatggtttccagctttatccatgtccctgcaaaggacatgaaatcatcctttttatggctgcatagtattccttggtgtatatgtgccacatattcttaatccattatatcattgatggacatttgggttggttccaagtcttgctattgtgaatagtggcatgataaacatacgtgtgcatagtaccatgatttataattctttgggtaggtacccagtaatgggattgctgggtcaagtggtatttccagttcttgatccttaaggaattgccacactgtcttccacaatggttgaactaatttacactcccaccaccagtgtaaaagctttcctatttttccacatcctcgccagcgtctattgtttcctgacttcttaatgattgctattctaactgacgtgagatgatatctcactgtgattttgatttgcatttctcttatgaccagtgatgatgagcatttttcatgtgtctgttggctgcataaatgtcttcttttgagatgtgtctgtttatatcctttgcccaatttttgagggggttgtttggtttttttcttgtaaatttgtttgagttctttgtagattctggatattagccctttgtcagataggtagattgcaaaaattttctcctattctgtagattacctgttcactctgatggtagtttcttttgtcatgcagaagctctttagtttaattagatcccatttgtctatgttggcttttgttgccattgctttggtgttttagtcatgaagtccttgcccatgcctacgtcctgaatggtattgtctaggtgttcttctagggtttttatggttttaggtctaacatttaagtctttaatccattttgaattaaattttgtataaggtgtaagtaagggatccagtttcagctttctacatatggctagccagtttttccagcacgatttattaaatagggaatacttccccatttcttgtttttgtcaggtttgtcaaagatcagatggctgtagatgtgtggtgttaattctgaggcctctgttctgttccactggtttgaatctctgttttggtaccagtaccatgctgttttggttactgtagccttgtagtatagtttgaagtcaggtagtgttatacctccagctttgttttttttttttttttgcttaggattgtcttggcaatgcgggctcttttttgattccatatgaactttaaagtagttttttccaattctgtgaagaaagttattggtagcttgatggggatggcattgaatctataaattaccttgggcagtatggccattttcactatattgattcttcctatccatgagcacggaatgttcttctatgtgttttgtgtcctcttttatttcgttgagcagtggcttgtagttctccttgaagaggtcattcacatcccttttaagttggattcctaggtattttattcactttgactttatctgtgaagtgtatttaaattctcattctatagaagaaaaatccaaagtacttggaaaagagaaatcttgccatgagatacacagttcttcagtttcaaagcagagattatctctcagatattctggctcatacaattttcagtacactgcaagacagaagatgtgaagacaacactacccaattggccttacacttgctttgctcgctgttaactaagttcactgtaaaaaaaaaatgattacaataaaacacattgtcaatgaactgtcacaaataaatacatctttagaaccacatccaaaatccagacatagaacatttctatagctccaaaacattttgacccactcttttggaatcaacttgctttctgcctcacagatcagggaattttgatctgcttcttgtcagtacagatttcattttccttgtaagagtttcacataaatgaaacataggatgcgctcttttgtgtctggtgacttttgtgcagcatgactctttctcagattcattcagatgtcctgtgttctaattatgtgctcctctttatttttgagtattatttaactgttcagtaattttatgatggatcccttcatctattgattgccgtgtgggttgtttccattttgggctattatggataaagttgctgtgaatgttcttgaacaagactttgcatgaacatatgtcttcatttcttttgggctaatacctaggcgtgtagttgctgtgtttatcagtaagtgtttaatactctgtccgactttacccaaagtggctataatattttacatgtccaccaataacttattatagctccacaccctccaaaatatttcaattttttttaagatttcacctaattgttactcaacagtaaccagaatagctagtgattattaagctatgtttttcttcccattttcttgtcaatttggggaattgatgtgttacaggacattgagaacagaatcaatactgtcctagttccctatcaaacacttttatcaagccataatgtttaggatggtaacatgatatataaagggagtgttggagtagtaataagtattttcaatacttattatattccataaagcaatatatcttcaatgaaatggcatttaactagacttagcatagtaaggttctcatatcaaccctagtattcagtattagcaaaagtttgaggaaaaaaatatccagcaacataagccagagagtgttttgctagtcaagtagcactgcaatactgatgctcttctaatgccagcccttcacaataatttccactcagaacatttggttgcctccttgccttgttctccttatgggacttcatgctgagggcatgtggcatcacagagggagcagtgcacttgggtgcagaaatatagcttagtagattgtctggccttagaggtggctgcaatggaatacacattttcaaggaaattccctgttaaacctcctggtaaactgatagttaagaccaggtgcggggacttatccccgttatcctagatgtttgcaagatcaagtagggagggtagcagaaatctaggagttcaagaccagcttggaaaacatagggagaccccctcatctctagaaaaaaaacactgtttgttaagatgtggtgtgaacaatggcatctctaagtgattatttattaacatttgctgagaaaattagaaaatagaacgatgccttctgatccaataatatcataataaagatgtgaagtttttaaactatggtaagtatagagaacataaaattgcccatcttagccattttcaagtgtacaggacaatggcattaagtatagtcacattgttgggctagcatcagtaatatccatctccagaactctttccatcttccagaactgaaactccatagccattaaatgacaaccccctccccgtttcccctgctcccagtccctggcaacctgtaatcaagttctgtctctatgacagtgactgctgtgaagcaggtttgctgtgccctggttaccaacctgtcagagtccagggagacagaacaatcatacacaacaagttacaagaatctagtttagtatttacaggtggccagcaaggcacggcagaagctgaggatttattgtgggtctttaccctgaggcacaggtaagtggggctgatggaatcttgactgtgtgtacccctcttggaccagagctaaggaaccccagaaagaagatgctctgggttttaaaccctggtgtcacaggacacatggagctaaagtactggaggacttaagtacaggaggacagtactagagggagctggatcagaagccagtctgttctgacctgtccctcgctatttcagaatgttacatttccagcacattctacaattattcttgagaagtgtaagaaagagagtggggaaaatcaagtgagtccaggaccatcggaggactggagtgaagtcgtcccccaacacagacatcccccgtagaaagctattccattttatatgcctaccaaccaccgtgaactggaggcagaggtgtgtcttgtcagagggatgaagcaccttgactgacacaatctcaaagcaacatcattgagacagagccagaaaagatttcactgggccaatgaaaactactaccagaggcagaatgatcaggcccacctgaagcagttatgtagcccaggatcccatgatccacagaagaagttgctaaaggggtgaaagaagaatccttcaggtgggattttctgaatctgcagaatccattttctgcaattatgagcttgtttccagatctcctctacttgaatttctaggatacctgaggtgtttatccaggtatagcagggggtattggaaattgtatacattcctcccagttgggattttttaaaggtctagagcaacactgttatcttaaacatccatcccaatggagttaagggatgtctgctgggttaccaaggcagtggctatggaggaggagcaatatctgccatggtcagggacaagttccttatcatttcactttttttcatgagcactgactcctatacgtagtaccaaaaatatcataaaagacataaacctatcatctgttgtaccttctggtaggtccctagtaagtctgaggtacagctttgggcttcaggctctatgatttacctaattccaaggaacaatatccagagacaaccccagcatgcccaacatgcaggatctcactattccacagatatccagagatggcatcacatatcctgcattttggtcactcccaaaccgcttacagagaaagatgtagcccttgggtgcatacagccccccttttcccatttttcttcaatcactcagtcatggttatgctggtattggtgcgttcattagccaagtctcactgatagtagagttgtgtgagcaaagttttgctcatacaatattgtctgtagacagagggctagcattagtccagtccttgtttttatcattgccattgggatgtttctcatctatgcaatcaaaaaagtatggtgcatcaaaatattagtccaccaatgttttttttagttgtggtcatgacattcgccagaggcaattaagttaaacaggggtcctccagtttcctcccatgtggcaggtgtcagattctcacttcgtgggccagtgcttgggtccttttgatgtacaccttagtattaggaatgttggtgtaatttacccttggtggaatgaaagggaacctctagttaatgacagaatgaggtcaagaatgggagattcactattttgaaagatcaccctggtgacctaaaagaagctaacaaagacattgtgcttctaggcctttgctgcctcattcttgtcaaaatgcagcctcacaggttaatgcatcatctctcacccatcccagggtctcaggtgtcccctacccatctacaagggttgggccgtgttggtgtaggaatgcggtctggctgtccttgctctgtgaacaatccattgcctttgtcacttgatccagatatttcagtcctgattgtccactccaggaagggagattctgccctataaaaactggtcatatttcataatatcaccaacactaaagggaggataagatgtccctggcaccagaagagggcccctagctccatgatatttcttagtcttgttatccatcactgtgggatcttgtagaaaggaagcacccagaggaaacataatcctcctattagagttagggggcctgtctggggcattgtaatggcctagattgcaaaccaccccagagcatatattctaaaggaaaaaaagaaaaggaatggttaggaacactgaaatagctttcacaggtccagactaatataagtgtctgcctggcctacctttacttccacccagctctgtgtttctcaacatgcactatttccctttttgtggcccaggatccttaatgtacatatttctctagtcagatgggataccaccccattaacagactttgtagatgtcctttctgcatattgctgtgtgattccactgatctagcattcactaggatcattggcctgtggatgcagggtgcatggaaagttcatcgtgttccatgagagtgtgcctattgtcatgttgcttgggcagtgaaagatgctcctttgtgagtgagaagtctcatggagtatccaaaaatatgacataaattgcactcaagggttacctaggtagtcccagcatcaaattgagcatcatatttctttttcctgcaggtggaaagctgtggccatagtcctttccttcacactggggattctttaatagtccagtctctcagttgccattttcctgaacagatggcaaggctgttggcaatggccgaggatttagtggatatgtggcatggtgcgttgttgggacagcctgcatggccattaccactgaatgtagttttgcccactgggtagaaagcccatgttaagtttcagttaaaaaagtggccatccactggctgaatggtggccacacctagtggacctgtcagttagcgttttgctcagccttcagtgactcctgccatatggaaatctctgaatcttgggctccacatgggcaaataaagagccaaattatcacctacaagttatttggtcccttctagcaagctccccatttgttcatggagccacagatcctgtggggtcctgactaaacctgatcaagaatgtgccatttccatttgataacatggctctgttcagattgttcagttttactaatggtgtttgtaagtatccaagtgggaatggacagctaagggaccagtgtcacagtcacacatggtgctgaagccttaacatgttcagtctccatcagtgcctaatagcaagcaaggagttgccattcaatataaacacattcagtggctgattcaggcaacttatgtgtcctaagattgagaggctggtgcactcattgatagttttctgttgctatacgctccactgagtatgcatagaggttgtggatacctggacttccatctggttagcaggctgtaaaaatcttagagaagtgactgggccaggccttgttgaacagattccaaggcaactgttgcaaaacgcctttttcaaagttggcaactttgttcatgattttgactaagggaaccaaaagaacacccaggtgaggtttatgccgtctcccattcgcaaaggggcctacctgccactgagtctccttttattcagtgggtgccacagcgaccaatgtttccagctgttcagttggcataataattaactatgagtacacagctcactttcactatacatatattccttgatggaagttacagcatcatacatgattagcgtgtcagaaccttcaccacatctgacagggtatcaattcaattacctagggtttgtgtgtcagttttgcttgactaacaatacgttttctcctttctatagagacggctgcacctgtgcaggtgataagatcatgaactgcaccctttgccttacttttttgttgtaaataatttgcctgattcaatgccatattatggaagaatttcttaactgtgatgaaagcacttggaaaatcctcaaataatatttcatgcagacatataactgaaagaaagacaaatgcatatacaggaaaacaactgctgctcttctcatgttggatgaggcctgctaaaaacacctgacaccagctgttagtctgatccttgatgtctggtacaatcttgggttattctccttggaaaagtggatgctcagaagtgccagtatccccgtgagtcccagttaactgaaattcatattgttaagcccatgcatggatagtcatgacatcagttcatgagattccctgggaaagctgggaaaggtaactgatgaagtccatgttttgaattattttaattattttgagctcctgcttctaatggcctttagataaatattcacttggaaaggatttattttttctactggtccttttttggaaggtccagtcatatctcctccagagtgactttgtgtccaatccttcagatgtgtttcttctaaggcctgatgatctgtcaaaaccactagtcaagattgtgatattgttggtaatatccagagcggggagaggacaatagtactcccaatattgcgggaggtgtacacccctctttgtgttattgttcttaatatccagggggaaaacaggatgacattactaccaatatcgtggggggtttacacccccccttgtgagattcttcataatatccggcaggggggtggataggactatattattcccaatatcgtggggggtgtacacccctcttgtgatattattcataatatcctggggggagacgacaatattactcccaatatcgtggggggtgtacaccccttattttgatattgttcgtaatatccagggttggagaggacgccattacccccagtattgcggggagtgtacaacccccttgtgatattgttcgtaatatccagggagagaggaagatattactcccaatatcgtggggagtgtacacccccaacttgtgatattgttcataatatccaggaggggagaggacgatattactcccaatatcgcccgggctgtacacgcccccttgtgatattgttcgtaatatccgtgggggaagggaagatgatattacttccaaaatcgtaaacactttgtgtgtacacccccctgtgatattgttcgtaatattcggggtgggggggagaggatgacgttactttaaatatcgtaaacacgttgtgtgtacacccccccaccccacgatattgttcataatatccagggagagagaggagatattactttcgatatcgtaaacacgttgtgtgtacacccccctgtgatattgttcgtaatatccgggagaggagagtatgatattactcccagtatcacggagggtgtacaccccccgtgatattgttcataatgtccagtgggggagaggagatgtattactttcaatatcgtaagtaacttgtgtgtacaccctcctttggtattgtccataatatccagggtgggagaggatgatattactggcaatatctcggtggctttacacacccctgtaatattgttcgttaaggagttaagaggatgatattactcccagtatcgcgggggcgtgcacgcctctgtgatattgttcataacatcttgggagagacaggaggaaattactctgaacatcgcggggcatgcacagccccctgtgatactgttcgcaatatccagcggggaataggatgacattactcccaatatcgctggggatgttcaccccactgtaatatttttcttaatattcgggggggaaggatgatattaatcataacactgcggggggtgtacacccttctgtgatattgttcattgtatccagggatggttggagatgatattactttcaatatcgtaaacaccttgtgtgtacacccccctgtgatattgttcgtaatatccagtgggggaaaggataatattactcccaacatctcgggaagtgtacacgtccctgtgatatttttcttaatatccaggggggcagaggatgatattactcccaattttgcggggggtgtacaacccactgtgatattgtcgtaatatgaagtgggagagaggatgatgttactcccaatatcgccgggagtgtacacccccctgtgatattgtttgtaatatccagggggggattggagatgatgttagtttcaatatcgttgacaccttgtgtgtacacccgcctgtgatattgttcgtaatattcagagggggagaggatgataatactcccaatattgtggggggtgtacaccaccatgtgatattgttcataatatccagagaggggagaggatgatattatgcccaatatcgtggggggtgtgccccccctgtgatattcttggtaataatcggggggagatgacattatttccaatattgtggggaatgtacacccccttttgatattgtttgtaacatttggaggggagaggatgacattactcccaatatagtggggggtgtaaaatccccctgtgatattgtttttaatatccggggggatttgagatgatattactttaaacatcgtaaacaccttttgtgtacacccccctgtaatatcgttcataatatccaggtggggagaggatgatattacgcccaataccacggggttgtacatacccctgtgacattgttcctaatatccaggggaggaggggatgatattattcccaatatctcagggagtgtacacctccctgtgatattgttcataatatccaggggtgattggagatgatattactttcaatatcataaactttttgtgtatacacgcccctgtcctattgtttgtaatatccaggaggggagagtatgatattactcccaatattgtggggggtgtacaccctcttgtgacattttttgtaatatctgggagggagaggattatcttactcctagtatcgcaggtggcgtactccccgccatgagattgtttgtaatacacagggctgtcaggatgatattactcccaatatctcggcattgtaccctgccccagcatgatgttgttgttcgtaatacccaggcagggagaggatgatataactcctaatatcacatgcagtgtaccccctctgtaatattgtttgtaataccctgtggtggagaagataatattattctccatatcacgggtgatttactcctcttttgtgatattgttcatagtaccctgtggtggagaggatgaaattgctcccaatatcaccaccgatgtgacattgttcataatactcagggcaagtctttcctgtgtttgtcccatgatagggaataagtctcttgagatctgatggttttatgaagaggagttctgcacaagctgtctctctttgccttttgccatccacgtaagttgtgtcttgctactttttgccttctgccatgaccgtgaggcctccccagccatatggaagtgtaacttaattaaacctctttttttttttttggtaaattgcccagtcttggatatgtctttattagaagcatgaaaatgggcaaatacagtcaattggcaccaggagagtgggccgctattgaaaagatacccaaaaatgtggaaatgactttggagctgggtaacaggcagaggttggaacagtttggagggctcagaagaagacaggaaaatgtgggaaagtttgaaactccctaaagagttgttaaatggctttgaccaaaatgctgataatgatatggacaatgaaatccaggctgaggtgttctcagatgaagatgaggaacttgttgggagctggagtaaaggttattcttgttatgttttagcaaagagattggtggcattttgctcctgccctacagattggtggaactttgaatttgagagagatgatttagggtatctggtgggagaaagttctaagcagcaaagcattcaagaaatgactcaggtgcttttaaaggcattcagttacataagataagcagagcataaatgtccagacaatttgcagcctgccaatgtgatagaaaaggaaatcccatttctgaggagaaattcaggccagcagcagaaatttaaaaaagtaatgaggagcccagtgttgttaatcctcaagacaatggggaaaatgtctccagggcatgtcagaggtcttcatggctgcccctcccatcacaggcccagaggcctgggaggaaaaagtggttttgtgatccaggcccagggccttcatgctgtgtgcagactaaggacttgttggcctgtgtcccagctcttccagccatggccaaaaggggccaatgtagagctcaggctgtggcttcagaggacccaagccttggcagcttccacgtggtattgagcctgcaagtgcacagaagtcaagaattggggttgggaaaccttcgcctagatttcagaggatgtatggaaacacctggatgcccaggcaagaagtttgctgcaggggtggggtgcccatggagagcctctgctagggcagtgctgaagggaaatgtggggttggagcccccacactgagcccctactggggcactgcttagtggagctgtgagaagaggggcactgtcctccagatcccagaatggtagatccactgacagcttacaccgttcacctggaaaagccacagatgctcaacgccagcccttgcaagcagccaggagggaggctgtactctgcaaacctacagggacagagttagtcaagtccacggaaactcacttcttgaatcagcgcgacctggatatgagacatggagtcaaaggagaccattttggaactttaggtttaactgccctcctggatttcagacttgtctggggtctgtagtccctttgttttggccaatttctcccatttggaacagctgtattaacccaatgcctgtacccacaattgggcctaggaagtaactatcattcttttggtcttacaggctcataggttgaagggtcttaccttgtctcagataagactttggactgtgaacttttgagttaatgttgagatgagttgagactatgggggactgctggaaaggcatgattggttttgaaatgtgaggacatgatatttgtgaggggccaggggcagagtgatatggtttggctgtgtccccaaccaaatcccatcttgaattctcacaggttgtgggaggtacccggtggttggtaattgaatcatgagagcaggtcttctctatgctgttctcatgatagtgagtaagtctcatgagatctgatggttttataaagaggagttcccctgcacaagctctctctctttgcctgccaccatccacgttaagatgtgacttgctcctccttctgccatggttgagaggcacccccagcttatggaatcgtaagtccattaaacctctttttttgtaaatttcccagtctcaggtatgtctgtttcagcagggtgaaaacagactaatacaggattcagacagatttagaattttaatggcttcttgatggatttaccaatttataattataaaatgtccattttatctcttgcattaaagtcatgacctagtttcttttgctcagttttacatgatatgtacttttcatcctttcattttcaaagccattctatattcttactatagtgtgtatttaatgattaacatacatctttgattttaatcctgtctgataattttatgatttacttggaaaaatttgtttatttacgatgcaattattgtaaagttagggttaaacctaccgtcatgtttcctctgattttcttgattcatgctttcatttgaattagtttaattatagattttttcttatattaacttgctaaatatgcaagattattatacagaagatatcctcaacttattaatgcctaatacacatatagtgtattaaaatttctctctcaaattatttctaggtaagtgacacaagcagaatcaacctttggaagatcatctatttcctgctgggttgactggaatgtgtgatacgacctaaggtaacctttgagtcaccacacagacctagagctctgtgtgatgcagcacttcctcaggagcttgcagtggcgtcagggcccagccttgaatgccaggcaggggtctctcaactctgtgattcttcccaggaaatacataagaacttgcatctgggttcatatctcaaacgcaacccaccagtctctcacgtactgacctctgctctaagtcttcagatggttatttttcatgcggtaaaaatatggcttacatattatcttgtaattctgtttaagatggcatacttatgttcctttattctttcaaacttggtccttattgttgaaacccagctttggagttcagaaaactactttttacttcaacatgctgtggttgagactgtggaaagacttttggcactaggtctttagttttgcatacatttgcagcaacatatctagtaacttaaaaatctagaccgtgaagagttatattttggtactccctgaaaaaagtaggaaaaaatacagtgcctgctggtgtcctggtcaggggtctgccttcggaaaagtggtggggggaggtggaggaggggagggaaactgttttaatattaccaaaccttatcaacatacatatactctagtaactgctaaaccaaatcaaaagaatgtattagttttgcgttgccagtagtcagtctcaattaggtgcctgttacgcagaacgaatttacttgatgaatgaatgtagggaaggaagagaggcttagaatgagctttcattgagctttctcttctcttgtgtctcattgctcaaaggggaggtgttcctcctcctttttgcagactctgtcatgcaaaggctgctgcagctgatgggaacttaaaatgtggtgcctgaggtgtagctgagaaatttatggtcatgagccctcagctgtaccaagtcctctgagttctccaacatcttggtctttaggcatctaagagaatccacagtgcctgctctccacagaaacaacacatctgggcagctaggccacagcaagcagggaggtttgtgttcaggactgtaccattgtgggagaataatgtgtactttgctggcagcaataaaccccaacatcctcagcatccatcctccttattttaaacatgaaatctgtccccgacccactgccactgaacctgtctgggactccagggtccctgttggaaaccaaatcaatcaggagccgtggaggctggcctggcttctgtaggtcccaattcaaataggtgtatccattactgtgaaaggggctatgactggatctacaggagatagaggctggctttccaggggtgatgggcagggagagtggaggctggttcacacagcatctccattggatcctgaaataataagagagaagtgcaaggttatgtacaaacattgtgagccattttaataattttctgtctgttatttatgttttgctcaattattttttgtgtatgattttggttaatactcccaaaacatacaggtttaaaaagaaccaagatttgcaaagcacaaataagcctctagaaatcacctatcccatccccctctttctgtgtcacagctttcactaaagtacatgtccttgctccttctggaatcttcctcactctcacagatctagacatcacatgccccatcctggaggacaagacacatctaacacgaggacagaacacacatgggaggtggcagggcccacagagttcaccctcccaccccatcatcctccctcatttcccttctgctctcagcagggacccagtgcattagcagcccagggagctgagcagggagcctcactgtgggaaggtgaactgaggagtcctgatcagtcaaggcaaggttagagctgagcttttatctcagactcacaagggaaggtcttccctaggggacagcatgcaaatcccctggtgggtgcagtggggtggaaagagccaaggagaaggtggggacctctcttgtgagcaaaatgacataaatatattttatgtttttaaggatatcaagagaggtaaaatctgtttcctgagtggcagaagggacatatttagatgtttcctgctatttcctctacccaatttctagttcgttaggactttctcaggcatgttttacacttctctttaataaggttgagctttcataaatatttggtgattcttatttcttggttcaggcttatttaaaagagcctaggtttgttttattttattttatttaaggaaaaacacacagtgcaaaaggttcaaatcttaagggtgcaaatgaatgtcgaaatccagatcatttcatgtcatgatccacatcaaaatatggaaggtttccaattctcttgctgctttcattatgcaccttcccagtcagcaactgctgctcaaaacacaatcaatgtaactgatactgtgacatctattataattgttttttttcctgtacttaatcttcatatcaggtaaacattttttgtagcttctttcttatttctttcattttttgagggcttgattccttcttatcaatttgaattgctgtctgctctcattccctgttattctgaaggattttctcttgaattttccacaaggcacatatgctataatgaattagtctttgtgtatgaaggaacatttctaccttgcttttacgtttaaatgattgttttgctggatatagcatttgtggctgacttttctccccagcatttaaatatatcattccactctcatcccacctctattagtaatgatgaaaatttagccaatacctttattattgcttcctagtatagagtaagtcagtattttagtgatgccttccaaattctctgtgtctttgtctttcaacattggtatgtgtattgttatgaattgtattgtgcttatcctagaagggtttcactgagttactttcatgtacagactaatgtgtttcatcattgtgaaaaatgtttttcattatttctccatttttttctttttcagtttttattttagaatcaaaccatacatgtacagatatgttacaaagttattttgcatgatgctgaggtttggggtatgacagaaattattaaccagttagtgaacattgtacccataggtagtttttcagcccctgccctttctccctttgtgttccttctagcacaatgtctattgtgcccatcaaccagggattcaataaagaaactgtggtatatatgcaccatggaatactatgcagccataaataagaacaaaatcttgcccttgcagaaacttggatgcagctggaggccattttcctaagtgaacagatgcagaaacaaaaaaccaaaaaccacatgttctcacttataagtgggagctaaacatggggtattcatgggcataaagatgggaacacatttttagcctctttctgtcttctcctttgtgattcctaatacaaatttgttggtattatacacatggacctatgatgtctgaggttttattcattcttctttataattttttccttctttatatgagatcatttctattgacttgtttttcagttcactgattcttgtgtcatcttaaattgctattgagtctatctaatacatttttcaattgagttgttgtacttttcatttctagatttcccagtatgcttgttttcatagttttgtctctgtttgagagcctctattggttgaatcattgtctttacaaattcctttttcagtcttttattataggttaaaataattctttgaacatatatttgataagggtggagcacatagacaccatggagatggaccataaggcagggagctccgaattagattaggtgaattttgagtctctgactatatgatgctcttgtgggttttaattatttcccatgttttatgtttctcatattacaaatagcttttatttttaagatagtaactattatagaaattcagcttataaattcctggaaatttctaacagaaagattgatgaaaagatggtttttttaggcccccacaccagcctctgcctgggacctgactttgtctctgagccagtggaatctgtgatgaggttttgagttgggcagtgaaatcaccacagggaaggctgtgctctgggtgctttggatgacaggaggacactccttcagggtcagtgatgctgggagttcaaagggagactcagcatggagctgcctgtgagttatcccagcaatcctgtttggacagtgatcatctcacaagtgtgctcggaagccactggatggccaaaatgtgggctcaggttggagaaggacaaagctatagggatgaaaatataagactcatttgatactctgaaatatcagtacaaccatcatgaattatatgggaagagaaaggagtcacaagattgtgattttttatttgatattaaaatatgtcacctctgctcatttttccctcaatgatgtacctactgatatacatttaaccaaagtcactgtttttaattttcattttagtaactgatagcctgtgtgcagagttcctaaataacgaagccagaccatcattgctatgggtgaagccaggaagtgactgtggatgtgaacaaatgtgagattcatgtacacgtctccaaagacagaggccactgatctggggagaacctgcagtcatttcactttcccatacccagatgagaggacaccttgatctgtgttcatctgatgaactctaaaatctggaccatattctgaaggtgtagttcacacttcttttctgtgctagtgggactctctcactgacgtgtattgtaccctctgcataggacagtctgtgatacatactacttgttttctgctaaacacccatcaatcatgtcatttatgagtcttccataggtgttacctaacctatggctatggggtcttccaaaagaatgggccagaggtggagctgtgaaactgtagctggataaaaagtgtaaatgtcaagaaagggtattgaagtggtgataataataataataatccaaattagtctgggctcttggctgtgattactggtaaatgtgaaagagtctaggtttggtttttattagttttatttcaactgataaagtagccagagtaaagtgcataaatcttgaatgttcaactgaatacagtttttgtgtaattcattgtccgaatggaatgatagaatatttcacattcccttgtgcttccctcatggacaatctttgtcagttatcacccctctcacccagcaaaattaatgtctttctgacatctatacaatcatttaggttttcctgtcttaaactttatataaatagcattaagtgtatttttatctttttagacttggtattgctccttacaacttttgaggccttcatttctttcagaggattcaaggtcctgtctcatgtcatttcctgtgattctgaaggattttctctcaaatgtcttgtaagagacatagctgctatgaatgaatgtattttgtttatcaaagaatttttttgctttttctttagatttgaagggtattttcgatggatatagatttcctggttgcctttttttttcctttcagcatttaaatatgacatttcactccttctagcctctattggtcctgatgaaaactcggccaatggctatgttgttgtttttctgtatatagtgtctgctttcattcttgatgcaatgaagattttctctttgtctttcaatattttaatataatgtgttcagttattaattcctattgattatctaaaagatttttattgaattttttcatctaagaattttttattacttttgaaaagtttttgtcattatttctccaaagatttcttcagccactttctctttctctcctcctttgtgactcttattatacatttgttggtattcttcactctgagctataaatctctgaagtcttcttttttttctaaactttttctttagactcaataatttctatacctctattttcaagttaactgattgttctgccatctcaatttgctattagacctagctaacaaatatttaaattggtttattgcacttttcatttctagagttccaatttggtcatttttttatattttccatgtcttttcttgaggccctacttgccgaatcttctttttttttaatattttcttttttatgtcaatgatcatagatttaaacataattatttgaacatctgcatattaactgctttgtagtctttgctaaatccaataattggggcaagttagaattagctttcattgactattttctgttgttattattgtagctgctttatttttattcctttaatattgttcatacttctctgcttttttccagaagttgttaaactaaaaattgtacatttttgatagcatattatagtagctgtctttagattttgggcttttttattttaattttaacttttttagaaatagggtcttactttttcacccaggctggagtgtggtgctgtgaccatagcttgctgcagcctcaacctctgggggtccaggggttctgcagcttcatcctcctgagtagctgggactataggggcatgccaccactctctgttattttttttttaattgtaagataagagtgtcactattttgcccacccagcctggtctcgaactcctggcatcaagtaatccttctgcatcagcctcccaaagtactgggattacaagcttgagccaccatgtcaggcctggaatttgttttgtttttctgatcattttttaattttcttcttagtttcttgtctgaacttactgatagtacctgacttatgacagttggagttataatgttttgactttcagatggtgtgaatgtgatatgcattcaagtagaaatagaaattctagtatttacacaactattctattttctctttcaatatagtattcaataaattacatgaggtattcaacactttattgtaagataagctttgtgtaagataatgttgaccaacagtaagctaatgtaagtgttctgagcatatttaggataggataggctgaggcataatgttaagtggattagatgtattaaatatattttcaatgcaagatatagaaaagtctgtatctcatgtggcgtttgaccacagatatctctgcttctttctgttcttaatattaatatttagtttgattttataggaactacacatgtatctgcatagcgaagtggtcaccaatgatctgagacattttgctcaaatatctggaggttataaatctatcttctgtcaacccatctgtgtgtagtttaaaaagcaaactgcatgcaaaatgcagctagttcttacctccctctggttttactttgcaccggaaactcctagttctcatcactcatatctataacttctaggtcactaggaatatgtgcagagattatttcagcaatgtgggtctatcttatccaggaatctgctatttactatcagcagatgtactacttgcctcaaacaaggcatcatcttggactagcaaggctgtgggctttttctgttcatttcctatggtgttctccctgtttagctggaaacactgaagaattatttcccactccttggctttactcaagtccacccactttggcagcaagctgccagttttatttgctatccttacatgggtaaaactccagttctgcaattcatattgactgagctgggaatagaagggtgctgtcacaggcaaaaggctacagacattttctgtccttactcaaagcactagtactttttttttctataaaaaatatgcatccttaattattttatgctttgccaattttcagagtgctgaaatagttttgatatttcagctttatatttataggtgtgtttgttgtttattcttgcacagatttattaaactctttgtgatgccataaacagagatgccttctgaaatgcgtttaaatgaatgtaatagccacactgaaatggtatgatgtaatggaataacataagtaattttggacttgagaacttgagctccaaaatggccaaatagagcagagatgctaaaactgagtggccaccacactagctgtctgtaaaggaagcagctggtataatctagtaaacactgatggtcttcttgaggtttttgtttcatgttgaatcactgtgggaggccagttattatactgctgacagtaataaactgcaaaatcttcagactgcaggctgctgatggtgagagtgaactctgtcccagacccactgccactgaacctggctgggatgccagtggccctggtggatgcaccatagatgaggagcctgggagcctggccaggtttctgctggtaccaggctaagttgctgctaacactctgactggccctgcaggagagggtggctctttcccctggagacacagacagggtggctggagactgcgtcatcactatttctccagtggtatctgaaattggaaataaaacagaaatgcactcatgtaatcaaaatcaaacccactgtctttaagtagagccaaaattgttgatctacattgaattttaattatatttcttgctgagcagaggtggcaggagttttcactgatgtgcaaaaccacctcatattcccctcacctgggagccagagtagcaggaggaagagaagctgcgctggggcttccatggttccgtctgggtcctaactgagcagttcctccccagagctctgacccaggcattgatatgggccctggaaggtagggcagctgggagggacatgcaaagcagctggggtgggagctgagcttccagatgcaaagaccacctgcttcttcctctctgcactgagcatcctgcgccgccctggttgtcaggtcagaaaagtctgttggctcagtctgagtgtagaactcctcccttgtgctcagagaatttcgctcctgtgtctttcttctcctcaatcacctaaatccacccagaagatgtttggcacaagcctgttaagaacaatataaaaagctgtgttttcacttctctcttcctatcctcaatatgcccagtcatctccctaagtgcattattggatcgatggaaatgaagagtctgttagaacttaatcttccagatacacctttcatttgcttgttagtaatgttttctgagggtcctgaagctttccattaacccagccacataccctctttgagttaaaaagtgaaaaacttctgtttacagtcacatgtcctggcagccctgacatagatgctccatggcttgccgattgcttgaaattgatcaagtaacttaacttccctgtgtctcggtttccatatctgtgtaactgtgacaatactggtacctaccttatagtgctgtagacagtttaaagaaaataagataaaacatttacaatagtattcaggacattatgtatgtggcaattaattttgtttttatttattaaatatttagcactacagtcatcatcattatcataaatatacttacttagcacagaaaagagtcttcagtctaatccaagaatgttttatccacagccaaatttaattctaaggcttttccttcactaactctacacaactctttaaatcctaatgatttggtcttaatctgtgctaaagtactcacaccttcaatcattcccacccatccctgtctaacgcattaattctcatcatccattatcaaaatgttactctataaaaggttcccatgtcctgttgctgtccttctttcttacacaatctttattctaccctgttatcttttgtcttattgttgccccaggacaataaggaaaagctaccatcattacctgttgacttgctccagtataattttttcaggcttgttaccttggaaatgaggactatgtctggcaaagaaacatattcatctggtcaatgtgttatgaaataaaagattttatctacttatggtccaataagtaatttagacctacttgaacagtttttttttaatgaacgaagaagaagatgatataagaggaaaatacaatacaatagaaaacacaagctattataactcttgcttcacggatttctacatatatattagacatatgctgggtatatgtgtgcaatggtgatccaaaaactgaacgctaactggctgaaggaaagcctgtattacattgggtcttgtctatttttccaattatgaacagaaagctacagtactatttgtatgagtatcaaaccttctagctgctgtgatggaggtagagaagatttactgagactaaagccttggaagtactagaggtttgtcctgtgatgttatgggtgttgctgtggttgttgttgttaggaaatacagtggaagtgaaagcaagtagaaaatttacaagctctgctcttcctcatactcacaaccccttctagagatgacagatagtggcacaggaatctctgacacctctaaggaagtcttttttgctctttccaggatctttcctgacaagtattgttttgagtcacagatgatgtggaagtaggtgtagaagaaaggactagagcaagggaagaagctttcaatcccaggtagtggttgtaggcacagtgaaatggaatttttcatagatttatgctacacttctatcatgttggggagagaggcatcaaaccaagcttattcttgaaagaaacattacattattttaaagagaaggaactatgcatttcttgtcaaatagatgtttaaaattcaaagctacaattttttttttttttttgacagtatcttgctctgtcgcccaggctgtagtgcagtggtgcgatcttggctcactgtaacctccatctccgtggttcaagtggttctcctgccttagcctcccaagtagatgggattacaggcatgtgccaccacacccggctaataacaggagggagtaaagggccacacaagcatgtacacaagagacaacttttcttcttttttacagaataagtctaaatgtaaaatagcgttataatgtatggactcatgtttaagacaagtctcttggttttctaatttgtgttgaacccaagcagtgttgtgatagaaaatgagtttctttttctttaagctgaatttgaatttgctccaatagcctaatagacaccctagtggcaagtcctctgtgatgctcgccattgtccccatgtctaacaaggatttctactggacacagaagtttttctaagtccaacaagagggaaagagactgggccatcattgttctcatctcagatttccacttcctgcatagaaggtatacatataggtagccagacgttatgaaaatggattgtaagcatttgttagtgaacaaaatatgactcaaacagtatttttattttttatttttaaatttctattgcttattatttgagacagactgtcactctgtcacccaggcaggagtgcagtgggtgcaatcttggctcactgcaacattcgcctcctgggttccagtgattctcaggcctcagccacccaagtagctgggattacaggtgtgtgtcactacgtccagctcattttttttttttttttgtatttttagtagagacagggttgcactgtgttggtcaggctggtcttcctgacgtgaaatgatccatccatcttgacctccaaaagtgctgggattacaggcgtgagccaccgcactgggatttaagcaatatttttattaagtaaagtgtagaagaaaaagtgtaagtaaggtgacaataagaaaacaaaatgccgtaatggaaaacgataactttagggcagaaaacaagaaaaggcaaaccaagattcctgtagggcaagcctccaatgcacaatccaaggaggaatgtcaagggtgaaaactctggagcatccagatagtggcccaaaataccaaatgctgaaaacccagaatacccaagtaacagcctatgagtgtccccacaccaaatgccaggaaaccctggagtatccaggggctgaccagtgcagaaaatcctggagcctcagtggggtggccaacaatgagccccaaaggcctggttggggccatagaacaatgtgactctggcttcttagagtcaacagaacaggagaattcttacatccaagtgtcctgccttaaacaattgcacaaacataattagcatggacccaaagaaaaaactgcaaagcaaacacatatatcggggcagaaaataaaataaaatggctgatggataaataaaatggcattagaggagaaatgactaagagaaagaacaatgaggatgtagtcaggtgtgctatgggggacttcaaatggactatctagccaaaggccttatttcctggatcatctgatataggcaggtgggtagatgggacacttacaggtgtgcaggaaccaaaatggggccaagcagtgtctgacatggggcctgcatgaagatctctccaggcttcccagctcgggtgggttgggctcctatgggggaactggagcacggagcggctggcctgcatgaagcagtggctctgtggcctcttgcccatccccagggctccaccacctgtcaggaaagatgatggttcttaaaacagtctttggctagtgttaatagctctgcaatgttagcaactctgtagctttgatcgctgtagcgcatatcagcgtctcatcctctctcactgatcgctgtcttgccacttctccaatagctgtcttgcccattgctgatcactgtgtccatcttctcataaagtgccatctcttgctgtctcttgctgtcttgcttctccgctgtttccactgtcttactgccacatcaaatgctgcttctcaccatctctagtggtgagtggctggctcaatactgatgcaaggcaagtcctcagctttgctcaggaaggaatgttaagagtaagccagtaatagaagaaaacagctttattgatggggcagcagtgttacagctctgtgactactcctgcggagcaggggtaattcataggcagagggccgagagtagcagccaggggcatttttacagtcacatttatacccacttttaatcatgtgataattaaggggtaggttgttcagaaatagctagaaaatgggtggtgttgccccaacttccaggtgttgctatggcaggggcaggaatttccaggtgttgccatggcaaggcgctgtgacttctggatgtttctatggcaatggtaaactctcatggcactggtgggtatgtcttatggagaggtcctttcagaaccctgttcctgttttggccagcctcacatctggtccagagcggagtcctgcctacctcttgcctcaaaagtaacaagaaatctgtaatgaaaatttacccagacagaaaactccaattttatatttggtagttagtgacatggtacttatcaaagttacacaaagattcaagtgaataaaaaatactctcagaattattataggaggtcataatgtcctgtagtccaaaaattaatatgcacataacaaaacaaagaaattaaaggctgatatccattgtgaatataaaaataaatatcttaagaataaaagaaaaatgcaatcccactgtatatctgcacatttagtgaacacacattgtaaaaagtgttacagtttttataaaaactcttgataggtaattttaatttctgaaaaatgtatatgaactataaggtatgttggatctcttcccctaacttaaaaaatatttcttcacatttaaattctttaccaatttttaatgactttttattgcttagaattttagttgatataaataaaaaatgtgtattaaaagcctaccattttgatttaacctatgaaatatatttaaattcttggaaaaatccaaaaatacctagaaaagtgagctcttgccagaagatacacagttctttagtgtcaggctgagattatctcccagaaataacttttggctcatatagcttccaggacactgcaagaataaaagatgtgaagacaatgttacttaattggatttgcaattattcactattcactgttaaccaattttattgaaaaaaaagattccaatcaaatacactgattttaagtgtactgttgggtttaataaataaatacattcttggaagcaaaatcaatacacacaacatttctgtacctccaaaaagttttgtcctgctcttcagcaatcaacttgcttccacctcacagaacagaccatccttattcagcttattgttagtatagattccactatctttttaagaatttcacataaaggaatatagcacatattcttttgtggctggtgactttcgtgcagcataattgtttcctaggctcattcatgtcgccttgtgtcctcgtgatgtgttactctttacttttgagtactatttaaatatgtagtaatttcacaatgtatcccatcacctgctgatgaccatgtgggttgtttccactttgggctattatggataaagctaccacgaatggcattatacaaggctttgcatgaatatttctttatttcttttaggcaaatacctaggagtgcagttactgggtcttacagtaagtgtttaatactctgtcatactgttttccaaagtggttataccattttacatctcagcccagaattgatgagaattctcaatgtttcagctacttgtttttaagactttttcttaatcatcactcaacagtgaccagaatggctaatgatcattaagtcatgttttccttacaatttccttgacttttgtgggtgcttgacttgtatcagaatattgaaaacaggatcaatattgtcttaacccccttttaaacactttttctaagtaatgatatttaggatgataacaggagatctaaagggaatattggtagtagtaacaggcattattcaatatttattatcatactccttaagacaatacattttgagtgaaatagcattcagctagactcgggataaaaaggttctaatctcagctttagcattaaatattaggaaacctttgagaaaacaatccaggaagacaaatcagagtgttttgctagtggagaagtgctgcaacacctaaaccctattaatgccagatctttgcagtgatttctactcataaagttgggttgactccttgccttgttctcctatgtgtctgtgtgactttatgctgaggggatgtgacatcacagagggagaagtgcacttgtgtacagaaacatggcttaggagattggctttggatgtggctgcaatgaaatatatattttgaagaagtcccctatgaaatgtcttatacattttttcttatggcagggtgctcgggctcacacctgtaatctcagcactttgagagaccaaggaggaaggatcacgtaaggccaagaacttgataccagcctgggcaacatagggagaccacatgtgtacacacacacacacacacacacacacacacacacacaatttgtgaacagtggcatcaagaagtgattatttatgaacattggctaagaaaattacaaaataaagcaatgtcttctgagctaacaatactataataaagatgtcaattatttaactgtagaaaatacagagaacatgaaattgtctatcttaaccatatttaaaagtgcagtgcagtggcattaagcatattcacatgttctgctattattaccgatactgtctccagaattcttttcgtcttataaaaactaatatctataccccttaaacaatactccccccatttcctgtatccttatccctagcaacctccattccagttctgcctctatgtcagtgacatctttgaagcaggttcactgtacactggttaccaacgtacctgagcgcgaggaacacaacacccccacacagcaagttacatgaagggggtttattattacagataagcagcaagggatcacaaaactcttggactcattatggatcagtcccccaaggcatgcgaaagttatgtggagctgatagagtcgactgtgtgtaccccgcttgcatcacagctcaggaacccggaaaagcagacactctgggttttatatcctggggtaatgagacgcacagggctaacgtgcttaagaacattccattctatgagaaactggaatacagcacaggtaggctgttctggccagttcctctctatctcaggatgttacaattccagcacattctacaattattcttgagaactcttaaaataatcaagaaagtggagagaactaagtcagcccagggtcattggagaactgtcttgcagttaccccaccacctagacatcccccttagtaaagctagcatatttcctatgcccaccaatttcccccaaactgaaggcagaggtttatctcttcagattgacgaagcaccttgatttacacaacctcagtgcagattattaagccatagtgagagtacatttcgctggtctaaggaagggtactaccactggcaggaggataagacccccgaaagcagtgacctagtctaggatcccatgatcaagaaattaagatgccaaagaggtgaaagggggatctttcagatgccccattgtctgcagccattgagcctgcatcaggatcacctctacttatatttctaggatacctgaggtgtttatccaggtacagaaggcagtgttgggtgttggtaattacatggaacatccgttatgttccacgagaatgtgcccattgtcacgctgattgggcagtgaggttgtttcttggtcagagtgaagtctcatggagtatccaaaatatgacataaattcctctcaagggtggccattgtagccccagcatctaatagagtgacatatatttagcagtccaggaagcaagctattgccatagtccttttctccacacaggggatcctttaatagttcagtcgctcagttgctgttttcctgaccagatgaatgggttgttgaaagtggcccatgatttaatggaaatggagcaaaatatagtgttaggggcagcctgcatggctgctatcattgcatgcagtttggcccattgggcagaatggccatgtttagtgtcaatcaaaagatgccatcccctggctggatggtggccacacccagtggacccactggcatgtgttttgtacaatcatcagggccccatgccatactgacataggcatgtctttgaatctttgactctatgtggccaaaggagaagctgaattgtcccctgtgggtcatttgttcccttcttgcaagcttgtcatttgtttatggggcacatgggtattgtggcatcctggttagggctgattctgactgtaacatttccatttagtaatttggatctgttgggcctgtccagttttattgattgtgtttgtaggcaccaaagtgagaatctgtagttaagatagcagtgtcactcctggtcctctagctctgagatactcaggccctatcagtttcctacagcaagtaaggagttgccattcaaaagaggcacaaatgatggctgcttcaggaaacatttgtctccaaaatctaagtctggtgcacccagtgacaattttacattgccacagactccagtcagcatgcctagaaatagtggacacctggatttacatagaacaagcaggctctaaaggtcttaaagaaatgccttggacatgtatagttgaatagattccaaggctaccgttgcaaagggctccattcaaagttgtcaaatttgttcatgcttttgactaaggtgaccaaaaaaaaaaaaaaaaaaaaaaaaaaaaaaaagactcagggggacagtgcagctacgtaagaatccagtggctttcccgagcttatttgtcttgcatttttggtgacatggattgttgttcatatcggcttcctctggcaggtccacctggaaagcattatatttagcaagaataaaggaggctgtgaatgatgtcactgcggactgcgtatattccctgttgcaaatgtcaaatccatgaagcaaaaagggatttactagaggttattaaattccttacaaattgttgaaaagccttaaaaaacaggctccagtcaaagcctctagaacaattccaagaatcgtactgctggcacaggtcgggggagctcctcctgctgtctgagactccacattcaagctgtctcttgcagcagaagagagagcggctcttctcactactgcccccagaaggacagcagctctggtatcaactgtcaactgctagaaatctgacccctttctctgactgcccatcagatgtgttactacagagtcgttttggattgagatgaaggaggggaaatgcctgatctcactcaaatgtgctcattttcctggtctgagtcacagccaggcagcacagtcctgtgggcacaatatcttcacttgccaggttcctataaaatgggagtatctttcttgactgtggaaaatatggagacgaggaaggtcaagcaatagcaaaaggagtacttggagttgcctgagcttccactctggtttccccaaatgttttcaatccatttaattcatgataataaacacctttctgcctaaccagccataatcgcttttcttagatccagatgattcagtgataaaactaaagagaaaaaataaatacacttttcaacgttgaagctgaccaggtgtctgtctctggtgtttacccctccacatcccactatgcatttcatcttccctttgcctcactggagatccaagtgcaagtaatgcttcacatgactgtgatccctagaacttcatcctaatgactgttgacatcttctctgagttttaccagtggaaatggcaataaatagaaagattccagaaggtcccctagggtccatattttctgtacttcctctctaaaatatgtaaagtcaattatgtttgctcttgctttatacgggctagatctatggccccagcacacatctgaacgccctgtgttgacaacttatccagtattgtattgagtctgaatggtcacatgcttatcatatcatttcttccaatttcatgcagtaattgtcatgtcaactgtttggattaagaaccatcagccagaaaaccacagccctgataaaatagaaatagagtatttcaagctgttcagtgggcatagcaatgatgagtctacagctcattttcaatatataaatattctgttcatgagagtaacagtgtttcagagcctccaccacatctgacagcataacaatgcaatagcacaagagtttgtgtgccagcgttgcttgactaataatgggtttttctttgtctatagggtaagctgcacctgtgcacatgacaagatcatgagctacactttgcttcactttttttgaggtcaataaactgcttgatccaaagccatattatggaagaaattcctgactctgatgaaaacacttggaaaatcctcaaataatattttatgcagaaacataaccgaaaaagaaggcaaattcatatattgcaaataaccagtgccttcctcatgttgcatgaggtccactagaatcacctgacaccagctgttagtctgagccctgatgtgtggtacaatgttaagggttcaagaggcatcagttttcttggcaaattaggtgttcagaagagccaatagccctgtacatctcagttagttgaaactcacattactgagtccccacagggaccttattaacattggttcatgaggctacctggggaagctgggaaaggtgattgactgaagtccatgtgttgaatcatcctgattattaaaagcccctgcttgttaatggcatttcacttaatattcacttggaaagcatttttttttattatggctcatttttgaaatgtctggtcatagcttttgcagaatgactttgtctgaaatcagcctgttgcatttattttaagacttgatgatctgtcaaaaccaacagccaatatttattaaactgctgttatcttgcaatgggatcatcagatgtaaccattgcagtttacccacggttaggatttttacatttccagtgcttctttgacaatgacactaatgtgactccatccagcatgcattgttgtgagaactctatttggcctatcatcattgtgggcatgaacataatggagactttcataggatgcaatggttaatattcaacattagtcaaaatttgctctagtcctacccttggagctctactgggttggaaaaatattttaggtaaggtcaaccatttggtaaagttttaaaaataaaggctacaaagaaattttctgtagcaagagtattgcatacataatagaataaatgtgcttaaatatgaatactatatatatttgtagccaacattttatcaaacaaatatatattcacttctatgtatcttatatatatgcacatttttccataaataaggtaaattttaattttttattgaaatactagttttaattctgttcttaattttctcttaataacttcataaattgatcactaaatattcacatttataccaccaatttaagaaaaaaatacatatgtttatatacacgtagaggtgtaaataccgtatcaggaagcctttatgcataatgattggttactggttaaatacacaactcagtgacagaaaacagtaaacatttgttttcgtgttcgtggatgctcacgttcacaatcctctggctgaccaaggaagggctctgatgagtcgttcctctgcagggcactgagctcaccttcagactacagatatgaattgtctgaggacaaggctgaacagcagtgactacacatgacagaagattcttgtggcaggtcacaggagtgaacaacatcccaaatcaaactgcacagttgaatttaagtccaataatttctaacatagcttcacacattttaaatatattcctttatttcagtgagtacacattttcaagaaaatgtttactccatttaattatagaagggtttgatcattccatgaacaaataattatgttttcaaactttacaatcctgaaaatatttgcaaatgtaaatttgcattaataagaaaataaagctggatgtgttttcaacatgtggcttcaaatataatttatttaaatggactcattggggtaaaaatcattttaacttatgtaaatatccctttttgctgtgcttgtgtcctatagagttgcccaataagagttcctcccatgagatttggaaatcagaaaaggaagactcaatattatccattggtaactaagacaggtacaaggacagaggtgaggactagagaaacacctggaaggatgctgcaggaagctaagagcatcagcacgcctacccctaagcttccagacaggactgaggaccacatggttagaaagcccttactttaggggcggatgcattctgttttctgagggagaaccagagaatcctgcctctaatatcaactttcctgactactgtatccttgtctttgaaaggctgtagtctgaacgttaatcataggcattggttcattcttgttatacccaacagagccaagaaacctagtggggaaaggcactcagggtgcaaaatattgcttctggaatgcaattgaaataggccctgttatcccatggaactaaggtttatggttttttgaataaacttagaaattgtctccccctccctgtcttaaaactcaagatagttacgtctgtcttacctgagtccttttttcagtaaaccaaccatcaggcctcccagatactattaagaagctgaaacttacatatcactgaatcgggacagtgagacaacagaaccttcacccgctgtgattgcataactgacctcctgcttcttcttgaccaaattatcttccttacccctccctaattcctgttttcaacatttcttccctcctatataaacccctaatttattttgtcagagagatacaattgagaatggcgtcccatctcctcggctgcagcacctgattaaagcctgttccttggcaatacttgttgtcttcgagattggctttctgtgtggtgagctgcaggatctacaccaagtccctggtatttcagtaagaaaattctctgcaaccttcagtgctttggcttattgtaacctgaaatcaaatttatccacaatttctgagataacttgatataactctaggattcactttgtccaccactgtttaccagtctgagcttgccagctcccaacccttcctagtgccaatgaactttctcaaagttcaataggtaatatttccctttttcatggaacactgactttttctttgttcttccaacatactgaagaccactgaattttcctgtatgcctcatttggcaaatatttctcttcaaataaaacattaaatttagagattcatctctacattttatttagacttcagtagtttattctaattctctgtattaagactattcctgcttagaatatctatagtggcttcttctgcattatgatttccaactgaagccataaactagactcctcaggtgtcatgatctctgtttttattaaataaggagaagcattgctatgtctgtgaagttggtgctgagaaagagaaaagaattagggtgcagaggtgacttcatgtccccatctaccaacaccatcagagtgtggctgcatctgaggaacactctcagctgatggaggcatcaggagaagcagctggggcagcccagcctcacacatctgcttccctgggggtttatgtttgggtgtgtaacactgtgggagggtaactattatactgttggcagtaataagttgcaaaatcttcaggctgcaggctgctgatggtgagagtgaaatctgtcccagatccactgccgctgaaccttgatgggaccccactttgcaaactggatgcagcatagatcagggacttaggggctttctctggtttctgctgataccaggctaaccagctgctaataccctgactcgcccgacaagtgatggtgactctgtctcctacagatgcagacagtgaggatggagactgggtcatctggatgtcacatctggcacctgagattggaaacataaaaacaaatgtccacacaattaatcatgttgtaagagaatttccctgaatagtaaagcagtactgagcaccctgggctgagtaaactgctagtgttctccatccttacctgggaaacagagcagcaggagccccaggagctgagcgaggaccctcatgtccatgctgtgtcctgactgggtctgattcctgcacaaagtctgaccagcctattaataaggcttcagggcaggaggttgtgctctgggaacatgcaaatgagcaggggatggggcaggctgggcacagctgcagagctggcgcatctgagtaactcagcaccagctcagtgtccccacctgtcccaggtaagatcaaggtagctcaaatttgtctgcagagaatgtgtttctactggggactattttgttatgggaaacattttatggtttctttttgacaatttgaaatattccttgggagtcgatggagcaatgtatttcattggtgtatggggattatttaggagaatattcttttttgtaggaaacacatagtaaaattttagaccctacaattttcaggtcttcaaaagactctcatgtgatttctgttagggaaggtggtacttatcatatacttgcaacatttctgtgagtttaacattgttcctttctaaaaaaaaaattaaaaataaaatttattcacatgatgctacatatatttgtaaatgttaggtaatggtgttatgccattgttcttaccactgtaagatcaagcaatttacttcagatacactaagttgataccgtgtttcctcaatgcatgcagcaattacagatccaccattatcaagagctctaggtctctttaatacccagagactaaatgggctgcaccttattcctgttttgggcaccttcatagtctaccttcttttctgccattaagtattatttcccaacattcatctctcttagtgagggtgatcatcgcatggagcatgtccctgccacgcaccataggtgacactttcttcttttactttttatcagggacatcatcctgacccagacaccaagatccctgttaacatcttttggaaagaggcactcaatcttttatcaagcaactgcccatgtacatggagaaatcagttggttccagatgaaactggacagggatttgcactcgttatatctcatatctctaatgtgcccaaaaatgtcccggcctggttccgtgggaggggaagtggatccaactacatcagcatcagtgggctgcagcctaggactccataaaattttactgatgcctgactaggagagccaaatcacagtgctgtagcctctgcacaaaccttcctgctgctttataagctgcctgaattttaagggaaattgcttatattggaagaaaggaagaaagctccatttgtcctctaaatgtttgctgaaaataaactgacaaaaggaagattaataagagaaaaggcaaacaaaattcacttaaagtgcagcaggatatcatagcaaggtgattacccagataactcaatgggatccaggtgtttatgtttcctttctagggaagaggtaattgggaaatgtaggcaacctggagagaatagatgcgaatagaaatgcatcctcaaaagaacaggtaatcacctccctaggtaaagtatcaactttgagtctcttccatttttgattcctcttttgtgttaatcttccctgacataaaaattctcaggaagagttttcttaaaaattggtttccttctgaagaatttgcttttaggcaggtaggggatgtttaggaaaagccccctgtgcatttcctgctttctaaatgcctttggttttatataatcatcatacaaatgcagcacagtttgagatgttattttctggattcctttacttgcaacccacctgccaagatcctgttccagagagatgtggctacagactgaaagagcagttttcccctcaacaacgtggaggttggggcactgaccactggtgcagatgaaaacctgtgtagaacttttgcatctccaacttatgtagtaatagattacttttgactggaagccttaatgataaaataaatagttgattaacccttttttatgttatacatattatatactctattcttccaataaagtatgctaaagaaaaaatgttattgagaaaaccttaaaaatgagaaaatatatttagtacttattaagcgcttgctcacaggtgacacacagaagaaaatataagtggatctgcaaatttcaaacccaagttattcaagggttaactgtaccatgatgaatgtagcagtccccatctatagtctagggcttttccctttgctgtatctctgctcatttccaatggctatatatatgtcttatgtgcttcatgatcttgggcagagaggtctgcttgcatgccttgctggccagatggcctgcaatgtgtatctcttaggaaagtgctatggtttgactgtgtcctccagaatccatcgttataaagttaaatctcagtgaaatggtattgccaggtggggcctattgagatgtgttagatcatgagggtggagccctctagtggaataccttaatgccactataaacagggtttatggggctggaatctctctgtctcttctgctggtctgtcatgttaagacatggccttcgttcctttgaaggactgaaagctccaggcgtcatcttgaaagcagagaaagaggagcttaacctgcccatgccttgatcttaaatttcccattctccagaaatgtgagaaaataaatttctgttctttatgaattacacagtgtcaaggaacctaacctgttatagcagcttgaaagagaacaagagagacagctcacaatcagtgaggacaggatgaggtgtatacatacctcagcttcctcgtctctcaggtggaatagcccagaggaatttagtccatgtttccacatgtggttgatcttcagttatcctgagtcaggtgggttgttgatgtgtcttttaccattcatcttctgttccctccctcactttcttcctttcctcccagtgtaaatttgctgcctaaacaggaatcctcattgctggtggacccaaactaagatagtaaataaaatcattaatcttttgtatgaggggtatttctcatctgaattcttttatcatttccctttcttcgacatgtaggaatattcaggaaacacacaattttttttaaccaatctattttagattgaatttatgcggtgatttttttttgtgtgtgtgttaaaacaaaaaattacgttgtaagccactaaccagctgaacggactcctcttttggtagagagaacttcaaagaaatctgaaaaactaggttaggccacgactggcaggtgggtttagatgtacctcattatatggtccttcctttggagttcagacacaactgaccagcattatcattacaacagagatctttggattgacaaaacagatgctttgtagcaataagataccatactccaacatgacagataataggccctgaagaaaatcaaaatattttaccctaaaagtatttctttgacatattctgaagtgaccctgcaagctgcctgttgtgggggaaatttgcattctgcagagaatctcctccccttactaagtcttttccaaagagtctgacttttttttaaggtctgataaacaacattagccacctactttgtttgctacccacaggattcatctaggtgacaagaacctttgcttccacaccctcttttctaaactcaagcatttctttatgatgaattcaagtgtttaggcagagcttaactctttcaaccagttggcagtcaggaaatctttgaatccacctatgacctggaagcccctacttcaagctatcctacctttccaggacaaactaatgtaaatcttatatgtattgatttatgtctttccctgtaatttctgtctctccaaagtatttcaatgtgtattcttgtcaccctgggcacatgtttgcaggacatcctaaggctgtgtcacaggccataagctttgggaaaataaacctgtaaattgattgagacccgtctcagatactgttttgtttatactggtcacaaacttaaaaatcctctaaaacaatctacacatcaataaatctacattagagacagtggaatgatcataccttaacagttaaagctcacaatttaaaggaacctgagtctaagattttggccagctctcttgcttcataaaaaatacttcgtgatttttaaaattttactttagagaaaggcaatttgggggaatatatttattgtcaatgggatgaataatgtctctaccctaaaagatgtccatgtcctcatctctggaacccaagtgttacaggagttattaagaaattattttaggcggataggaaaagagtgtccttggtaaggttttctttcatttaaagcagctccagaaacgtttcttgtctagcaggaaagccctggctcttagagccaggctgggaagctttgatttgcaaattctggccattagaaactgagtccagccaaacctgtcaattcccaccatcttcttccttgcccccacatgtgcctgacaacaaggctgcccccacatatccccatgtgtatagaatattttggcgccctgtatttgcatattaaaagtcttgttgggaaggccagttattttgcaggcttcatgaatggcatgcctggtcaaaccagtccctagagccctatataaatcagacaccacctcctccagcctcctcatataagagccacttttctgctgcaatggagttttgtctttgttggaatccctcctccctctgtctctgtgtgggggagctgttttcttcctccgtccttcttgcatattaaacctttctctccctaaaaccactccacgtgtgtctgtgttgttttatccaaagtggtgtgagaccaagaaccctggtgttcctccagtcaacggagccgtatcataaaaattctaccttacatagcaaaaaaagaacttgacagatataagtgaagaataagcgacccagttatctagatgaaaccaatatgatcacaaaggtccttaaaataaaagaggaggcttgcagtcagagaggagctgggacaatggagagggatgtggtttgaagagggaacgggttactctgctacaaaaaaaaaatatgaccacgggggtactttgcttaaaaaatatcccagaatgtcctgctatacttagagagcatttgcttcccaaatagaaaatgaaggcctccttcatttcacaccagtttctgctacatgcactgtattgctctgttgcttggtgtctacgcacttagaactgctctgtcttctttccgaaatgactttcttcattatgtaatgtacatttctgtcactggtaacattcttggctttgtagtctactttatctgatattagtatttgctactgattcattttattaattttgcatactatgccattttcttttcttttatattgagtctacttctagtgtcatatttgatgtgagtgtcttatagacagtatactgttcggacatttctttttgattcatcaattgctgtctgttataatttactaatttgcatatttaatataccgataattattgatatactaagatttaagtcttcgctctacttttttgctgtatctttttttgcttctccgttttctttttgctgccttcctttgggttacttgaacatttttagaatttcattttaattttacctaatttgagggtatctctttttatagtgatttttaaattggttgtcatggtatttcctttatatccatagcttctcacagtatgttggtgtcataatattaccatttaaaataaatataaaattttaccttgttttatgtcatttttcttcccccattagtaatagattgtgcacatatactcatgtacgcttcacaccatctctagcctacttataatacctgacgcaatatgtatacatgacttaacctgtgtggattcaaccaagtggtactaagcacatggtgaagtcaagttttgctttttggaaatttgtggattttttttctatatatttttgatccaggtttagttgaatccatggatgcagatcccatggatagagagatgactatactgctccttataactctgaggatcaactctgtggttcctccattctgggctggctgaactgatctctgctgagcctgctcatgtgtctgcagttaccctgtggttcagttgtgactagatggtctgatatgacttgtttaacctatctggaagctgatttgatgtgcaggttggacaacatttggtttcggtttacataggtcagggagatggggcctgttccccaacctctattcagttcgtttctagatcaactcaggagttcgtctattcattgtaggttgtttgggggaaattccacacaaaacgttggtaatgaagaagctgaactgctgtcatcagttattgttatcatctgaaatgcatcatatattaccaaagtctctccagggtggcccaacagtgcagctcagctcaccccatccagtcacttccctggttgcctgcaggtgtgagaaaggcaatgtgctcagtcacaggaaagacaggggccctccctggtgctgaaacctgcagatagttttcacacagtttcattccaaaatacaaagacttcattttctttgtctttaaaatagttatacattttctttctataatgtccccatgcttttcaactaatttgaattttcagaactggaagtatttattatttctgtgttagatgctcttagtcacttatggcaagagtgagttaatagagacaggatatggattagccatagaacaatacagaagtgtgtggattcagataggataaagatcaaagcggtgacaaatacattcttttgaagcggattctcataggtcaccagtcaatgtccgcattcaaggtgcgatgatgtgtcagctacattgtgcaaatggtcagctctgcagagtaaacttggacagcacactacaggaccaaaattacctgtaaaggtatggggaaaataaaccatcatagaaataatagtgtgaaggagttttcggttatttatacttggatatcaagcagaacactataatcaacgaagctataaccgaaaaactttaagacttttaaagaggtttcccttttctcagggtatttctcaggaaaaaatttataaattatggataaactacttgcacaattagctgcaataaatcccttccctgcactcatcctttggttggcctcattctaaatggactcaggtgttacccatgtgtcttgctcaggccaataggataatagcagatgtgacagaattggaatattggaaagggcttgcacatcgaagctttcctctctttcacagtgcttggaaaccctaaggtcacaatgagaataagcctgtgcccatctccattcaatgtcagtggcatggctgctcttaggtctattatttgttcttaaaatgtgtgttcagtttgttataaacatgtaagaaattacctgcaaatttatcaacttaagactacacccatttataatctctcaatttctgagtcagcagtcagcacatggctttgctggatcctgcccattggatttcacaagactgtgccacagtgtagactgttcttcattctcacctgagactccctgagaagagagatattttagagctctttcaggtagttgcagagcccatgccttagcacctctgtgactcagggcttcagcttcttactggctcttggctcaaggctgctctcaggtcccagaggctgtggacaattccctgccatgtgatgctcacacaggcaatgcccacatggctggttgtttgttcaaggccagcagaaggtttcagagagtgtctctttccagtctgctatgacagaggcttacagaatacaatacaatcattggaaagacatctcataacctctgccataccatatgggttagaagcaagcctaagttctgcctgttctctgtggaggtagatcacacaatgccatgactcactggagagaggtttctgctagggtgttctggcatctttagtttcctcaaatatcagggtactcatactgagtgtgaaatctctcctacatctacttcatcgtgctgtgtctgactgatcagacatttgacacatgacttttttttttttttttgtgacggagtctcactctgtcgccgaggctggagtgcaatggcatcatgtcggcccactgcaacctctgtctcctgggttcaagcaattctcctgcctcagcctcccgagcagctgggattacaggcacccaccaccatgccaggctagtttttatattttcagtagagacggggtttcaccatgttggccaggctggtctcaaactcctgacctcaggtgatccacccatctcggcgccccaagatgggattatagggatgagctaccatgcctagcctactttagtttttaagtagatttaatgaaatctatttagtagccaaaagccaagaatgccaatagttttacctggctactctctgaaacaatggtattaaaaggggtctttccagcccctttccagcagaaagacaggtactaagaaacagtggaagtgtgaaggtgggggaagggagagaaacagtttttatatacctaaactaacccagctgcatgtaaaccagtaactactcatcaaaataaaatacagaaagcatattagttttggtttggtgtgaaccagccttaaatacaaagttgttacactgaatgggtttaattgaccaaaatgcatagggaagacagaaaggattaggatgcccttctactcagctttatctgctgtcgagtctggttcctcaggggacacatggatcccctccattgtcctgcagattctgccaggccaaggctgttaaatctggcggggtctcatgtgtggacttctgggtgtatacagggagaaactagagaaaggccgagcagatttttactgcatgtaggtaatctacgtgggcttttagagaaaaaaggctttagataaaaagtgtttgacaaagtcacacatggtttgtaaaaaaacaaaaaataaaatacaacttgaaaactcttggagaagtgacactttagtttcccaaatcactcttcttcatacacttccacttagctttttttcaccttctagctctgtggtcttagaaggacatgcacttaaaataatttgtttccataggaatccaacaagtaaaagcataaacaacatcaaataaactacatcattaacatagaagcatgtcaaagaaactgagattagattttgagttttggcacaagtattagagaaatagagaaaagatttaaaagatagaataagacttacacaagaaagcaggacagcaatacgacaattgaacctatcatagaataataggttgtgataatggatggtgagaagaaatgcattggacagacatgcatgggcatgattgatttgagcaatttagcatggatcaagacaaaatctttaggatttaaagggctgtgagctgggtagtaaaaacccccattttagcacctcttggggctgtagatggaaagaacttggatttaaaactattttcaataagtgtctgctaagtgctaagtattatagctataaggatacctaaattaatagaagcacatattatctgttggataatattctaaatcttttaccttgtttaaattgtaaaccgacctatgaggtagaacctattattgtcacagcattgcgggtatagaaaaggaggcaaaggggggttaagttactttactaatgtcacacaacatgtaagcggtaaagctccatccccaaccccaagggtttgacttcagggcctgccaagacaacatctggactgttgcatggatcttgcctggctgtacatgaagctctaattccaggatggatgaagattccattagaacttggagtagcattaataaaattgcttccttgagaccaggcgaagtgtccagaaagcaaaggagtttaactgcttaaaggaaaggtgcagatttgtaggaaatgaagctctggactgtgaacagagtttttcaaaacaattaaggagaagagaaattgagtctagtttgatagatgtgttgtgcagagtgagtgtagtggagattagagaatcagccaaggaattatcccctgccttcatggatggcatcaacatctgtcttcatggcaattgtattggcagcctgagtgtcagagcctgggtcctgcccatccatgcagctgtggtcacctttgcacctgcagtgctggagttacttgagtgttactctttgaggtagcttcaggacacttggtaaaaatcactaagtggcaagtgaaagacttggaagaaaagttctaatcagctcttctttcccacctgatgcaatttttgctgctgctgggaccccaagttctttgtctcctccccgctgctttttttttttttttgagacagagttttgcttttgtttcccaggctgaagtacagtggtgtgatctcagctcactgcaacctctgcctcctgggttcaagtgattctcctgcctcagcctcccaagtagctgggattacaagtgtgcgcccccacgcctggctaattttgtatttttagtagagatggggtttcaccatgttggtcaggctggtttcaaactcctgacttccggtgatccacccacctcggcctcccagagtactgagattataggtgtgagccatcgtgcctgaccccttgcctcttttgtaaatagaaatcaacaccaggccaaacagaaattgtctcaggcaaggtttagtaggtttgtggcaagagcaaagcaagggagcagcctatgggtaagagatcctggtggctattccttgaagtgcccagctcttaccattttaaggaagctgaggcggaaaaaggaatgacatacaagcatggttaggcaaagttttctttgcatttgtgcagtggagcgtcatgctctaacatatataacatgatgaggaaatggaagataagccctgccttgggtggatattttagtattacaatgagattataatgaggaaaaatcagtgaaaggtcagttctggggaccatcccactttcagctggctagatctcatttggtgctttggggaaatgccagctctatcagcaaccttggaagatggtcaggttcttatcaggaatgttagagttccactttagaaaccttgggaggctgggcacagtggctcacgcctataatcccagcactttgggaggctgaggagggcagatcactggaggtcagcagtttgagaccagcctggccaacatggtgaaacgctgtctctactaaaagtacaaaacatagccgggcatggtggtgtgcacctgtagtcctagctactctggaggttgaggcaggagaatcgcttgaacctggaaggcataggttgcagtgagtgtagatcgtgccactgcactgcatcctgagtgacagagtgagactatctgaggaaaaaaaaaaatgaaatcttgagatactcaggccctatcattttcctacagcaagtgaggagttgccattcaaaagaggcacaactggtggccacttcaggaaacttttgcatccaaaagctgagtctggtgcacctagtgacattgccacagactccagtcagcatgcatagaaatagtggatacctggatttccatcgagcaagcaggctctaaaggtcttaaataaatgccttggacatgtatagttgaatagattccaaggctaccgttgcaaagggctccattcaaagttggcaactttgttcatgattttgactaaggtgaccaaaaaaaaaaaaaaaaaagactcagggggacagtgcaactaggtgagaacccagtggctttcccgagcttatttgtcttgcatttttggtgacatggattgttgttcacattgtcttcctctggcaggtccacctggaaagcattatatatttagcaagaaaaaaggaggctgtgaatgatgtcactgcggactgcgtatattccctgttgcaaatgtcagatccatgaagcataaagtgattaactagaagatattaaattccttacaaattgttgaaaagccttaaagaacaggctccagtcaaagcctctagaacaattccaagaatcatactgctggcacaggctggggaggagctcctactgtttgagacattcaagctgtcttttgcagcagaaaagagaccagctcttctcactactgcccccaggaggacagcagctctgctatcaactatcaactgctggaaatctgacccctttctctgactgcccatcagatgtgttactacagagtcgttttggattgagatgagggaggggaaatgtctgatctcactcaaatgtgctcattttcctggtctcggtctcagccaggcagcacagtcctgtgggcacaatatcttcacttgccaggttcctataaaatgagagtatctttcttgactgtggaaaatatggagatgaggagggtcaagcaatagcaaaaggagtacttggagttgcctgagcttccactctggtttccccaaatgttttcaatccatttaattcatgataataaacacctttctgcctaaccagccataatcgcttttcttagatccaaatgattcagtgataaaactaaagagaaaaaataaatacacttttcaacgttgaagctgactaggtgtctgtctctggtgtttacccctccacattccactatgcatttcatcttccctttgcctcactggagatccaagtgcaagtaatgcttcacataactgtgatccctagaacttcatcctgatgactgttgacatcttctctgagttttaccagtggaaatggcaataaatagaaagattccagaaggtcccctagggtccatattttctgtacttcctctctaaaatatgtaaagtcaattatgtttgctcttgctttatacgggctagatctatggccccagcacacatctgaacgccctgtgttgacaacttatccagtattgtattgagtctgaatggtcacatgcttatcatatcatttcttccaatttcatgcaataattgtcatgtcaactgtttggattaagaaccatcagccagaaaaccacagccctgagaaaatagaaatagagtatttcaagctgttcagttggcataagaatgatgaatctgcagctcattttcaagatataaatattctgtttatggaagtaacagcaccattcatgattagtgtttcagagcctccaccacttctgacagcatagcaattcaatagcacaaaggtttgtgtgacagctttgcttgactaataatgggtttttccctgtctatagggaaagctgcacctgtgcacatgacaagagcatgagctacattttgcttcactttttttgaggcaaataagttgcttgatccaaagccatattatggaagaacttcctgactctgatgaaaactctttgaaaatccacaaataatattttatgcagaaacataaccgaaaaggaaggcaaatccatatatagtaaaataaccacttccatcctcatgttccatgaggtccactagaatcacctgataccagtaattagtctgagccctgatgtgtggtacaatgttaagggttctggaggggtcagttttcttggcaaattgggtgttcagaagagccagtagccctgtacatctcagttagttgaaagtcatattattgagtctccacagggacctccataacactggttcgtgaggctagctgggaaagctggaagaggtaactgaagtccatatgttgaatcatcctcattattaaaagcccgctgctcgttaatggcatttcaattaatattcacttggaaagcttcttattcttgattatggctcatttttgaaacttctagtcatagctcttacagaatgactttgtctgaaatcatcctgttgcatttcttttaaggcctgatgatctgtcaaaaccaacagccaatattattaaactgctgttctctttgcaacgtgatcatcagatgtaggccttgcagtttacccactgttatgagttttacatttccagagcttccttgacaatggcactgatgtgactccatccagcatccattgttgtgagaactctatttggaatatcatcattgtgggcatgaacataatggagacttttataggatgcaatggttaatattcaacattagtcaaaatttgctctagccttacccttggagctctactggattggaaaaatattttaggtaaggacaaccatttggtaaagttttaaaaataaaggctacaaataaattttctgtagcaagagtatgaattaggtgtcatcacaaataccatttttttgtgtggaatgtaacaattatttaaacgtatataatttagataatattttataaataaaatatgtatatattgcatatataacagaataaatgtacttaaatatgaatactgtacgtagttgtagccaacattttatcaaataaatatatgttcacttctatgtatcttaaatatatatgcacttttttccataaagaaggtaaattttaattttttattgaaatactaattagttttaattttgtgtttttctcttaataacttcataatttgattactaaatattcatatttataccaccaattcaagaaaaaatatgtatgtttatataggtagaggtgtaaatactgtatcaggaagtgtttatgcattaattacggtaactggttaaatgtacaactcagtggctgataacagtaaacatttgttttcacgttcatagatgctcatgttcacaatcatctggctgatcaaggaaggtctctgctgagtggctcctctcagcagagaggagcctgtagattgtattcagcctgtagatatcagttgtttaacgacaaggctgaacagcagtgactacacatgacacaagattcttgtggcaggtcacagtagtgatcaacatcccaaaccaaaccgcacagttgaatttaagtccaataatttctaacatagcttcaaacattttaaatatattcctttatttcaatgagtataagtttttaagaaaatgtttactccacttaattgtagaggtgtttgatcattccatagacaaataatcatgttttcaaccttcacaatcctgaaaatatttgcaaatgtaagtttgcattaataagaaagcaaagctggatgtgttttcaacatgtggcttcaaatataatttttttaaatgacctttttgggggaaaatcattttaacttatggaaatatccctctttacctctcatgtcctatagggttgcccaataagagggtcccccatgagatttggaagtgagaaaaggaagactcagtattatccattggtacctaagaggcagagagacaaaggtgaggactggagaaacacctggaaagatgctctaggaagcgagaacttcagcaattccagacttaagcttccagacaggactgaggaccacatggttagaaaacccttacttcaggggtggatacattctgttttcagtgggagcaccaaagaatgctgcttctaatatcaactttcctgaatactatatccttggttttgaaaggttgtagtgtgaatgttaatcataggaattgggtcattcttgtcataccaaacagagccatgaaaccagaggggaaaggcactcagggtgaaaaatattgtttctagaatgcaattgaaataggccctattatgccatggaactaatgtttatggttttttgaataaacatagaaattgacttccctgatcttaaaactcaagatagttacatctgtcttacctgagttcttttttcagtaaaccaaccatcaggcctcccagatactatcaaggagctgaaacttacatatcactgaatcaggacagtgggacatcagacccttcactcattatgactgcataactgacctcctgcttcttgttgaccaaattatctcccttaaccctccataattcctgttttcccacatttcttccatgctatataaacccctaatttttgttggtcagggatacatttgagaatggtgtcccatctcctcagctacagcacctgattaaagccttttccttggcaatacttgccttagtgattggctttctgagtggtgagctgcaggatctacgctgaatccctggtatttcagtaacaaaacactctgcaaccttcactgctttggcttcttgtaacctgaaatcaaatttgtccacaacttctgagataacttgatataattctaggattcactttgtccaccactgcttcccagtctgagcttgccagctcccaacccttcctagtgccaatgaactttctcaaagagccataggtaatattttccctttttcatgaaacactaactttttctttgttcttgccacatattgaagaccactgagttttcttgtatgccccatttgggaaatatttctgtgtaaataaaacattacatttagagattcatctctacattttatttagacgtcagtagtttactttaattctctgtattaagacaattcctgcctagaatatctatagtggcttcttctctgttatataaagtccaactgaagccataaactagactcctcaggtgtcatgatctctgtctgtattaaattaggagaggcattgctatgtctgtgtagttggggctgagaaagagaaaagaattagggtgcagaggtgacttcatgtccccttctaccaacaccatcagagtgtggctgcatctgaggaacaatctcagccgatggaggcatcaggaggagcagctggggcagcccagcctcacacatcttcttccctgggggtttatgttcgggtgtgtaacactgtgggagggtaactattatgctgtagacagtaataagttgcaaaatcttcaggctgcaggctgctgattgtgagagtgaattctgtcccagatccactgccgctgaaccttgatgggaccccactttgcaaactggatgcagcatagatcaggtgcttagggactttccctggtttctgctgaaaccaggctaaataattgctaatgccctgcctcgcccgacaagtgatggtgactctgtctcctacagatgcagacatggcagatggagactgggtcatctggatgttacatctggcacctgagattggaaacataaaaacaaatgtccacacaattaatcatgttgtaagagaatttccctgaacagtaaagcagtactgagcactctgggctgagtaaactgttagtgttctccatccttacctgggaaccagagcagcaggagccccaggagctgagcggggaccctcatgtccatgctgtgtcctgagtgggactgattcctccatgaagtgtgtccagcctattaataaggcttcagggcaggaggctatgctctgggaacatgcaaatgagcaggggatggggcaggctgggcgcagctgcagggctggctcatctcagtaactcagcagcagctcagtgtccccaggtgtcccaggtaagatcagggtagcacagatttgtctgcagagaatgggtttctactggagactattttgttacgagagacattttttagattttttttgacaatttgaaatattccttaggagtccgtggagtatcatatttcattggcgtatggggagtatataggaggatattctttttttgtaggaaacacatagtaaagttttagacgatagaattctaaggtctttaaaagactattgtataattccggttagggaagggggtatttattgtatacttgcaacttttctgtaagtttatcattgttcctttctaaaaaaaattaaaaataaaatatattgacatgatgatgcatatatttgtaagtatgaggtaatggtgttatactattgttcttaccagtataagttcaagcaatttactacaaatacacaaagatgataccatgtttcctcaatgcatgcagcactcacacattcaccattatcaagagtgacaggtctcttcaatacccagagactaaatgggctgtaccttattcttgttttgggcaacttatagtctaccttcttttctgccattgagtactattttccaaagtttatctctcttagtgagcatggccactgcacggagcatgtctctgccatgcaccatcaatgccactgtccgcttttacattttatcagtgagtggggacatcatcctgacccagacaccagcctccctgttaacatctttaggaaagagacactcaatcttttatcaagcaactgcccatgttcatggacaaatcagttggatccagatgaaattggacatggatttgcactcgttatatctcacatctctaatgtgcccaaaaatgtcccagcctggttcagtagcagggaaagtggatacaaccatatcagcatcagtgggctgcagcctagggctccacaaaattttactgatgcctgactaggggagccaaatcacagtgctgtagcttgtgcacaaatcttcctgctgctttataggctgcctgaattttaagggaacttgcttatattgggagaaaggaagaatgttccatttgccctctaaatgtttgctaaaaataaactgacaaaaggaagattaataagagaaaaggcaaactcaattcacttaaagtgcagcaggatatcatagcagggtgattacccagataagtcagtgaaatccaggtgtttatatttcttgtttagggaagagggaattgggaagtgtaggcaacctggagagaatagatgagaatagaagtgcatcctcaaaagaataggtaatcacctgcctggatgaagtatgaacttccagtcttttctatttttgactcctgttttgtgtcaatcttccctgatataaatattctcaggaagaattttcttaaaaattggtttccttctgaagaatttgcttttaggaagataagggatatttaggaaaagcctttttgtgcatttgtcgctttctaaatgcctttagttttacataatcatcatacaaatgcagcacagtttgagatgttattttctggattcctttacttggaacccacctgccaaaatcctgttccagagagatgcagctacagactgaaagagcagttgacccctgaacaatgtggaggttggggcactgaccactagtgcagttgaaaacctgtgtagaacttttgcatccctaacttaagtactaatagattactttttactagaagccttagtgatcacataaatagttgattaacccttttttatattatacatattatatactctattcttccaataaagtatgctaaagaaaaaaatgtttttaagaaaaccataaaaatgagaaaacatatttactacttacaaagtgcttgctcacaggtgacacacacagaagaaaatataagtggatctgcaaatttcaaacccaagttattcaaggattaactgtaccatgatgaatgtagcagtccccatctgtgatctggggctttcccctttgctgtacctctgctcacttccaatggccatatattgtcttatgttctttatgatcttgggcagagagatctgtctgtatgccttgctggccagatggcctggaatgtgtatctcttaggaaagttttatggtttgactgtgtcctccagaatccatctgttgtaaagttaaatctcagtgtaatggtattgccaggtggggcctattgggatgtgtttaggtcatgaggtgaagccctctagtggaatacattaatgccactataaagaggaattacaggactggaatccttttctctcttccatccgtctgtcatgttaagacaaggcctttcttcctttgaaggagtcaatgctccaggcatcatcttgaaagcagagaaagcagaccttaacctgcccatgccttgatcttaaatttcccattccccagaagtgtgagaaaattaatttctgttctttataaattacacagtgacaaggaacctgttataacagtttgaaatggaacaagagagacagctcacaatcagtgaggacaggatgaggtgtatacataccccagcttcctcatttctcagatggaacagcccagaggaatttagtccatgtttccacatgtggttgatctttagttatcctgagtcaggtgggctgttgatgtgtcttttaccattcattttctgctcccaccctcactttcttcctttcttcgcactgtaaatttgctgcctaaacaggaatcctcattgctggtggacccaaaccaagatagtgaaaaaaattgtttatcttttgtatgaggggtatttcccatgtttattcttgtcacttctctttctttgacatgtaggaatatccaggaagcacttaattttttttaaccaatctattttagattgaatttaggcggtgattttttttgttctgtttgttaaaacaaaaaaataagttgtaagccaccaatcagctgaacggtctcttcttgtggcagagagaacttcaaagaaaacagaaaaactaggttaggccatgactggcaggtgggtttcgatgtgcctcattatactctcctcactttggagttcagacaaaactgaccaacattatcattaccagagacagctttggactgacaaaacagatgctttgtagcgataagataccatactccaacatgacagataataggccctgaagaaaatctaaatattttaccttaaaagtaattcttcatcatattctgaagtggccctgcaaagctgcctgtagtggaggaaatttgcattctgcagagaaactcctccccttactcagtcttttccaaagagtctgacattttttttaaggtctgataggcaacattcaccatctactttgtctgctacccataggactcttctacatgacaagaaccttggcttccacacccccttatctaaactcaagtatttatttatgatgaattcaactctttaggcagagcttaactctttcaaccagtggccagtcaggaaacctttgaatccatgtatgacctggaagcctctgcttcaaaatatcccacctttccaggacaaactaatgtatatcttatatgtattgatttatgtctttcctcataatttctgtctctccaaagtgtttaaaaccaatgtgtaatccaaccaccttgggcacatatttgcaggacatcctaaggctgtgtcacaggccataagccttatctttggcaaaataaacctataacttgattgagacccgtctcagatactgttttgtttacactggatcacaaacttaaaaatcctctaaaacaatctacacagcaataaatctacattagagtcagtggagtgatcataccttaacagttaaagctcacaatttaaaggaacctgagtctaagattttgtccagctctgtttcataaaaatactttgcgatttttaaaattttactttagagaaggacaattttggggaatatgtttattgttggtggaatgaataatgtccccaccccgaaagatgcccatgtcctcatctctggaacccaattgatataggagttattaagaaattattttaggcagatagagaggaaaaggtgtccttgggaaggttttgtttcttttaaagtagctccagaaaagtttcttgcctagcaggaaagccctgattcttagagccaggctggcaagctttgatatgcaaattctggccattagaaactgagtccagccaaacatggcgactcccaccatcttcctcctggctcccacatatgcctggccacatggctgcccccatatatccccatgtgtatagaatattttggcaccctgcatttgtatattaaaaggctatggtgggaaggccagttatattgtaggctacatgaatgacatgcctggtcaaaccaatcctgagagccctatgcaaatcagacaccacttcctccagcctcctcatataggagtctcttttctgctgcacagagagttttctctttgaatcacaccttcccctgtctctgtatgggggaggtgttttcttcttccttccttcttgcatattaaacctttctctccttaaaacactccacatgtgtctgtgtcgttttatccaaactggcgtgagatcaagaactctggtgttcctccagtcactggagccatatcataaaaattctaccttacatagcaaaaagagaacttgacagatgtaagttaaggactttgagaataagaaacctggttatcgaaatgaaaccaatataatcacaaagtccttaaaatagaggaggaggctcacagtcagagaggagctgagacaatagggagggatgtggtttgaggaaggaaggggccatggaaccagaactatgggagcacctggaacgtaaaaagcagagaatccagttctctcctctggatcctccagaaggaatgcagccctactgacaccttagcattagctcagtgagacttctgacctccagaattacagggtaatacatttatgttgtgtgaagccaataagactgtggtgatttaaacagcagcgttggaaactaatgcaaggggaagagatgtctttcagctcactgagtgcatgactgtcctctgttcttggaaatatttccaccttgttttctggtgtcagttttgacaagagacagagaaaatgtttctgagagaagagctaggacaagaattctttttagctagaaaatctcttgggtaaaatcccatgactatctcttatacgatctgggtatcacagagtttagcggtcagatctcacagcacatgataggaggaagagacttctgttagtttgttttcatattaggagggaaaattgattttcagcacacaatctgagaaagacaaactgagtcagagatattgtaagagaaagaggagatgtggaaggattcagggcaatgaaacatgtgtcccagctccaaaatctaaaataaagtcattgattatcaaaggtgaagcaaagctcttcaccttccatcttcttatgaaggatcaaattcttcccagagtccctgcccctccttcactcccctgacattgcattgtggagctaatcacatgtatccttaatccctgctcctgtcccgggctgggagaggctcactgtcctcaccatgtccagcaggatagagctggtgtcctaggcaccaaaggagaagaagatggtttctgtgcaggcaataagagctttgccacacattacatttcgctataactctaagtaaagttgtgtggagagaagagaacatatgggcaactttacctggtgggcttggaagaggccaggctctgagaatgacaatgaattcacatttctacttttccagatggcaaatgccagctttagcaattatggaaatgtggactttgagtttaagaacaagacagactttccagtactacaataaatgaggagacatttggaatagggtccttaacccagggctacagtcaggctggcagtgcctgagagctgcccgatgctgaccctaagctgtggaggaagcagctgctctcctgagccacagagctgaggacctgggaggaaccacaggccctggccacagggctgcctggcaggggcttaagggaaggaaactgctcacaaattcacgagagctgcattaagcatatatcctgcagcctggcaagagtaaaagtctcaagacccagacctcgggactagctctgggttcctgggatgggtgctgtcagctgtgccctccctggtactgaatgactgggaccttgttggagccaaagagggagagtctgcaaatgtactcaaagtctttactcagccagactctgttctgcttggaaataaaaggaacacacgctacaaaaataaatgtaaaattatgtgtatatgtaatatgaatttctaatataaactttacatattgaatacatataatactttagaagtaagttgtatttatatatttgtatatactatgtatctgtttatgaaaaaatatgcgatgcacgtttatatataaagagaactttgattgctagtataaggtatagttttaaactttaataagttgaacatgaacattgaaaatgagcactgggtgtaccaccacatggcccctttctcactacaggacctgagggtcataaagctcaggaccctcttccacgttcccctgggctgagagcagagagctgcccattgctgaggataataagtgacctgaggtgggtgtgcagaatcacagagcagcagatgcccaggagatggatagtggctctgggccctgaatggagggaagttttgtcaccagagctcagcatagacaagtcctcttctggtcatttccatcaaacaaagcagcacatgtggctcagaggctgcatagtcacaggatgaagacccgccatggctcattcccagcttcccctctgactggggtgatgtgggatctcactgcccaggtttcatgactcaccagctgctgggactctgttgacaatggcctatgtctgctccatgcacaagcttctcagtatttgacattttactttctggtctccagtaaccacgacttgccaaccatgacccttccacaaagattcatggagtggggtcagaactatgggttcagcaatgtgctgggccatgtatataagagaaacaaggcgcggccagcccatgtctgaagtgaggatgaatttgcaccatgaattcagagaaggaggtgggagaaaacatcctgacatgctccgtgcagtgatgcccacaagatacactggaggtgaccatagaggaggtgggaagggagtttgagacaaagtgaattcagaggtgtccctcagcctgttgccctgagaagacttcagacccttagcagcccctgggcagagctgttgctagggaagatttgtgcatgataggaaacaggaggagggagcacctacctctgaaggcatcttggttggtgatggccagagtgaaatatgttcaggcccaccgcccctgacccaggcagggatcatgtccagtggggcagcaggatcaagcaggagcaggagctcagagccagatctggtttccgctggtgccagactaggatgtttttcatactccagcaggccctgcaggtgacagtgaccctctcacttgggacacagggagggggctggagatggcatccgcacaacatgctgactattatccaagtgcggaacaaacatgcaaatctcccaatattaatacgaagcaagtagtttgttcaatttgatgcaattctgatcagaaaaaaagtgggctaacaacttcatcatcaaagaaatgttcatgtttgatacaaactatctgaggatgaagcctcagttccccttcctcaccaggcagtcagaacagaaggaggaagagaagaaaagctgggtcccaaagtccacaaggtgcctcctgaggctgattctgctcagagaaggtggggacggtagattgtctgctgggactgccacatcaaaattccctgggctggatggcttaaaggaaagaaatttacttctaacagtttggaaggctggaaagtccaagatcaaggtccagaaaggtctgctttctgctgaggaccctccctctgattttcagatgccaccttctgtccatgtcctcacatggcctttcctcactgcatgcatggagggagggggtggaggagagctcagtggggtctctttttataaagacactagtcttattgaatcagggccccatccttattatctcctttaactctaattaccaccttatatgctttatcttcaaatgtagctatattagaggttagagattcaagagaagagtttctgaagcacaattcagtccatagcagatgggctttggggacacagccaaggcagcagtgaaggcaaggctgggcttctagtctcagagcacagagcacagaggtggttcccacagtgcaggatgctggcagctcctcccaggtactctaggtaccacagagaccacattccagccttaggggctacctgttgataataggacactatcactcttaacctctccaagtatttctctgatcagggttatatcttagggttattatggggtttgtctaccacctagtcttaagattgtagcttagcctcttatataggattgtagatgctgagtcccggtgagtcttgaccgtgagtcttttcacgggtattaatgaaggggatctcaggccagattcatccatcactaggccagattcacaaaacaatttctcttctcaacaaactagctgcatagttgaggccaaaagatagtcagaaaagttatttgtcaaaaaaatattgtgggctagattctgtgacccatgtgagatgccaaagttttggaaaagagatgatgggccacgaggaatcctgcaggacataatggcaggggtggggatgggaagcacagggccctgttctggaactgtcatcccagtctcattcctcccatccaagaaagccttccagagaagctctgaggaccacagcagcagctccagtcaagaaggatccaggccacactgccctctgaatgaaagctgctgaggcctgtgctctaagctgtaacactgagtgaccacatgtcatcattgaggtcagcaccagccaaaacaatttttctaagatgatgaaaatgtctgtatttatgctctgcaagggtagccattaatcatatgtggttactgagcccttgaaatacagcatgtataactaagaatctacatttttaactttaattaagtctgatttacatatttgcagctatgcattgctagtgttaaccacgtgagacagcacagttttagacaataataaccaacaatgtcatcaggacaactaagttgctaattaacaagcgagggtcttttccaggaccattgcaccaagctggggctgtatgttggtcaaagtagaccacgtgggtggatctttggaatcttttctggattctactgcttctaggcaggtggtagaaactcttcctcttggagacactgagggagagactggagactggggtctacagtgttgccactagaatctgaggtggaaacaaaacacaaatcttccccagtattaatgatgtctcactctgtgggcttcccagcagagtcctgctggctgaccaagcagtaggtgaatgcaggaggtgaatgctgggctccctgagcaatggactcaatctcagtcccatgggacatttgagccctgtcacatggagcccccacagctgaggtcagggcaccaggacactaagggccagagtgctatgtccagtgtccagtgctccccctgcctcagatggtcccaccccaaaggcagcgaccaacacaccaataagggcttgagtggcagggaggggctttaggaagcctgcaaactagcaacaaaggagagatctgggcttccagcttctgagcaagagaacattctgtgtcatgggtatgatccaggccaaggtatttggtgaaagatattaggataaattttattcttaagggaataaaatcacagaaggcattggattattataggattgattggctattacaaaggtttaaaaacatacttttttcaatacacagttgtttatctgaaatcccccggtccctgccctcctaatggtgatccgttcaccacggtcacttcattgtcttctcatcactcagatacatcttcagtatgaccctgagaccttccccgatcagcacaaataaatggcctcagactccagataccacatatcattacctgacttttatgtagtttgtcaactactgaaagtattctattcagtttcattatgtggttattgttctgtgcatggctcattcccctactgaatatcagtgcttgggatcaaaatttgtcttaattattcacatgcatcttaccctcaaatgatggcatttacttgttcctgaaaaatatgatattaagtgaaaattcattaaattcaaaaatatgtctgtctttcttattggaaaaatatgtgatacattcccctcaactagagagacttagctacttttacagttggaaaagattgattggacacaaatctataaaaacacatttataggagtaacaagcatcattttgaaaatctgctttgcttgtaaaatgtccagtatgatgaactgtacacaacacagaaggaagaaaggtcctcacggaggatggggcctgatagagagggtgggggagtcagttctttgaagcatggggagggtctaataagtgacctcaggcaggtgtccaataccaggaccagatatttctaattacaactttattttccttaaggtttctgcatatacatagaataagtggaatacaggttgaatgcaacatgcttcagaacacatacaaacagcccacacacataaaaactaaagaatcttacagaatgttgtctcttcctcagcctttcttgaccttggttttaaccaaccacggcacaaaatttaagtttttttccagaggatgttctccaacttggaacatcttgtggagaaagttggtggcagtgtctgaaacacatcatttcttacaatgcattttttcacttctttggaataaaatatctgtgttattaaaaaagtttgatagaaaattgatgtaactttatgtgaccaaatacgacgaaaatctttaacaaaaatgtcactaagtctgaattctcaatgactgcattgtattccaaagttatttttaaataaatgaataaatacacaggaaacaaagtcaaaaaaatgaatttagtttctcttggtattaaaagatgttagcaataagatactggtcttttaatcaagaataatgaaaatttaaaaaatacattttttcaaacacaatttggataatagaggtggaaaaacaggagacagacaatgcttttgatgtgcagaaaagaaaattccaaggatcatgggtgatctccctgtgtttcatatgtcaaacaagatataaaatcaaatgtccattttgtttttacatcttacttgagttcctgaagctactttctctttgtagtttttgctttggtacactcagattttggtgaagcagttcttatggaggaattaagagttgctgatttcaaccttctttggcttgtagccctgtcctgcttctaagactggcaacaaaagacgctgattccttttttattccaggtaaatattgtttctgggatagtccccatttccaaagctatagctagatatttataaccctgttcttgatggaccagtttcatgtttcaaaacccaaatattcagtgaaagtgaaccttaaatgttaatctgatttaacaaatgtcagacttcacagagccgctttggaaataggaacaatgtctcattcctttgaacccacaatgactgaaacctgagtccatggctcttctgtcaaaagagctccaggccatcacctgattgtttcctaatctttaccctttaaagtgattttgtcataaatgaattactgtagccctgaagaataatccacagtttttaccaacttgtaaaggacagtttctgtacacctatggaaagaaacaggagaagtaatcttcaacaactcttctcctagtttgaaagttactgtgggtaaagatgaaagtgtgaggcactgactcttgggtgtcagctctgctgaatgggccatatgtgatggtatttggtaaattatttccccaactgcacctgcaaggatcataaaaacggggtattgttcagtttctctgttccgccaggctgagctaatttttgttttgggttgtagcacagtgtgagggtgcttattgccctgctgacagtaatatgttgcagcatcttcagcttccaggctactgatggtaaaggtgaaatctgtcccagatccactgccactgaacctcgaggggacccctgagatggactgggaagcatacttgatgaggagctttggggcttgatctggtttctgctggtaccagtataagtagttgccaatgccttcactggcctggcaggtgatggtgactttctcccctggagtcacagagaggaaagctggagactgtgtcatcacaacatcacccctggaggctgaaaacatacagcaaacattagcacaatataagcatctgcttaatgaaatcaccactaatctagtagcacaagatgaaagaatacgcattacttaaaaaaaaatcacatttaaaaacaagccaagttccatatggtgccaggttcctaattaagaaaattaatggttcaaagaattagttttagctttttctaaatattctcacctggaacccagaggagcagaagccgcaggaattgcaacggggacaccatctcagtgttttgacttcagttttgctgaagacacatctaggagaaaaagcctcttataagatactgagaggcaggaccacttcagatgtgggaggaaggttacatgcaaattatgggaatgtcctgttgttttaaatacacagacatcactgttgtcaggagagcgccctccccgccccttcggggaatgtgagaggcgccctctgctggcacctgcagatgagcgccgctgaggccccggcagggcttgaccagacccagggcccagcctcagagtgaaggaagagtccatcgcagtctctgggaggctctgcagtcatctggggtgaacagcagctcacatcctcagtctcggcacagggctatcttaactttcctgacaacacattcacaatgaggctgaagaaactttgatcctgtggacgcttcacaaagcatcactccatacaacacgatattgatgtcatcgtggtaactagataggataagcagaaaataataaggactctggattttcagtgaaagcacatgaagaccagagtgtgggattcaaccctacaaaagttaaggacctgtcacattggagaagttatcagggatttagtgaaggaacatgagtagcgttggctcatccccttcaaggtaaggacaaataattgtactttgcagctccaatcactgagaatgcagcacagtgttggcaaggcctgcttagagtattgacataacaaatcccacacttgggtctactccaccaccgcacttataagctaacttggaaggctgctttttggagtgggctcagaaaaagagaagattttgaggaaggttttgggctttgacacaagtagctctgtcacttgagccatgtgatccagaacattgttcggtgctagatgcatctgcattagatgggaatacttcatgaactctcttgcaaactccaataaaactcacggcataaatccctgggattttagagaagaccaagcaatgaccagataacaaataaaaaatttcttgttcaaaatgcagaatatcactacataatggtaggtagtcccatgaggcatttaaaaagtatgtgactgaactgcccctcataagtggaggaggccagtctcaccaatttttagggtcaggtgaggctcagcaccattcaatattaggatgaatattaggtacttttggggtttggttcaagcaggttcagaggctgtgcttcatttacatgaacaggtgttcctgttcctcctaccatttttctctcttactctaacacctttgcatcagctcactccagtgacctcatgagttttctcaatcagctaatagcaaggggggaaacaaaaaatgcaaacaaataaaagaagaaaaccaaaacaacactaagaaaatctaggctttttgaatgggttagcatcatatatttgtgcaagtaaaagtaggctgctcccacattttggccacaatcatgggtggctgtgaggtgttaccttgagttagcagatatttgaggacagcatgtagtgttcaacttagtgtggagagagacatgtactgagtcaagtatatgcatgaattagtgatagctggttggccatagtctttgataaagaaaattggaagatcacagagaagaagctctagaggagaggtatgtggatgcactcatatgaataagaaattacatgtgcaaaattttatttatctctgcaaaaagcagagaatatcttccacagtaagacaccaaacaaccaatcatactggaaggctcatccacttgtaagcagattaacggaactcagtcttttctcttaacttccacaatatttgcataatagagtctgtaatgaagtagccatcatagcctgaacagggctatgaatgagtaaaatgacatgaaccatgcctcacaacaaccatcaccacttgtgttgatcccactgttgccacttctgggtatccaacttctcagcagcagagacaaatatcttcaacaagtgggtggttatttgggatatcagatcactgtcccctggaggtgactgtgatgcatcctaactaggatcctcctgtattctagatgtatgtttacctttcctgcccatagacaattggctatctcagtgctctgagagcattttttgtattaatatgggaatatttcagaaccatgttcctacattgtggggaaagaaacaaaataatagccacgtgattatagcatccattggttctaccaaatatatcacgcaaagaaatccacaagggtataatattctgcagattttagatgctctccctcaaggtgttctgaatctttaaatcaatgaccatagtagaatgaagtaatggttcaggaagccaagggccaggagtacgagcagactctttagtcatcctacacaggaacccagctggcggacatgtgtgtccagtaatgcaattttaggccctgttggccacagacatctactcctggatatccgggagtatgtgcttctacttgggactactgtagataatcctgaagctaaacctcaagctgtggtaaagcagggttcctcatgccagtatacaagaaggcaaccaaacatacctatttcagcaaatagtaaaactatcatgaaaagatcgttttctgctacatttttggttagaggaggaatatatctgggaatatgtctggattgaagaacacacaccataattagatgataattaatcctcaactaatgtaaagtaaattacaaataattaaaataaggtaggaaaaggaaaatatttctaagtggctccattgctccagctctttcaggagaagtgccactatagcaaaaaccttcaaggcttaaaaaatgcatggaaattttttagttttgtgtcttacaatatacttccctcagcaacatgtatcatgtgtgttcattttcaggtgttcattcacacctgaaagctatgaatcacccttttcaaggtaattctagccacatagtagaatcaaatgggaatattttaaaagtattgctgcctgctcttatcctagcctagttggctagaaatacttgactggagttcaggcacccgcatgtttaaaaatcttcccagaatatttatagatgcaagtaggatagaaaaccttttatctaattggctctttgcctctgtagtccagcagccacagcattttcatgaactgggagcttgttagaacattcaaaatatcacgtccgggactataacacaacatcgaaaaggtccatatatcaatcaaattgcagtttttataccaaaaattaagaaaatctctacttgaatgggaaaggaaaactagtagctatttagcccttatatgacagatatgttaaaattatcttaaaaggattttaaagcagccatcataaaaatgcatcaatgaacaattgcaaaaaaagcttgagacaaatgaaataatggcatcaagaatgaaatatgaaattttataaaagaaaaatggaaatttaagaattgaaagatacaatcactgtatgagcagctcagtgtatggcctaatagcagaaaagagtagacacaggaaagtgataatagataatagataataattatctactagtaattgggtaattactattatccaatctaaacaacagtgggaaaataggccaaaaggaaatggatgtagacacaagataaaaagaaatctatggtaaggcatatcctagtcaaacttctaaaaactaaacacaaagaaaatctttaaaggcagaatttttaaaaaactacttgtaaactttaggggaaaaatgatttgaatggcagagaattccttctcagaaactatgaaggttagaaggaaataacaccatttcaagtaatgaaagaaaagacctgccaacatagaattctatttccacgacagctgctccaagatggctgactagtcacagccaggaggaagagcttgcaccaagggactgggacattagaaagactggtgcacttctagcagatcttcagagggaaggcactgagaatagatgaagggaagacgaagatgctgggctgaagggggaggaagctgggaacactgtgtggggctaccatgtaccaggacacattcctggctcccagtgactcctgtgatagggatgagttgaaccaacaaagagcaacttaggtgtctggaatcccttgaacaccaaagacacttgatttgtcagggagagctacttagagaaatgatagggacagaattccagccagcacagagcccagagtgtttggtgcaggagtgtctgtagtggaatatggccagggacactcatccccctaggctcaacttgctcccacaggagactttagtcctaggggaactgtatgacataaactctgcagagtgatcttgtccatgaaacagggccaatatgatctgactgtcccttgggctgctactgtctcccggggccacagccttaccattcctgcttgcattgcagcccctaggtacatcctgggggcccacatcatagctcctgcactggcagattgcatctgacagggaaaatgctccagcagagtggctcccatggacatataccaggcctccagtgttattccaccactgcagcatcccttgtgcacagactcccctgtgccactttgtctgtgctgacactgttagctggcacaaaaaaaggcatagtgaaaagtgaacacacccccaccttgagtggccaccactgcccacgtgaacatgcacagagtctgcatacagtcctgtgcctaccaattccccacccctgtgttaatacaccaccagctcaaacgtgtgtacagtcactggcaggccccactccccctatgagtcatgctgccactgtcactgctgaaaatgcttgcatggaagctggcaccccagcacccactagcaccctgccacagctgatgagtgcacacctgtggctgccattgctgctgacacatacaaacaaggatggatcccactgccaccaccctatgaactgctttggctggcaccacccacagaagtgttgtgaccagcggtccaagagcaccttggcccctccagtgcatcaggttcttaaccttgaggagccagagaacaaaggtgggtaccaatacctgtccccaagggttagagcatgcagtccaagagtcctgagctgtgccttggctccataaaatcttccagaaatgaagccaattgactgaacccagcttataacacaatcaaaccttcaaggttatcaaatagaataaaagaaaaaaaaaacaagaaccaaatcaaaggacagccacttcaaagactgaaagcccacaaagatgagaaggaactagcacaagaactcttaaatctcaaaaagacagagtgccttcttttcttcaagtgccagactagttctccagcaaggggttcttaactgggccaagattgctgaaataaaagaaacagaattaagaatataaataagaacaaagatcattgaaattcaggagattgttgaaacctacctaaggaagctaaaaatcacaataaattgatacaggaactgacagacaaaatagtcagtattttggaaaagaatataacttaccagatagagctaaaaacacaatacaagagtttcataatgaaatcacatgtgttaacagcagaataggccaagctgaggcaaaatctcagagctcgaagactggctttctgcaataagataggcagacaaaaattttaaaaaaagaataaaaaaatgaacaaaaccttcaagaaatatctattactcattggcatttctgaaaaggataggggagaatggaagaaatctggaaaacatatttcaggacatcatccatgagagctttcccaatttagctagagaggccaacattcaaattcaggaaatgcagagaaccataacaaaatacttcacaagatcatccccaagacacataatcttcaattctcaaaggttaaaatgaaagaaaaaaaatgttaaaggcagctagagagaaaaaacagatcacctacaaagggaagccatcagactaacagaagacctctcagcagaagagactgggggcctatatttaacattcttaaagaaaataaattccaactaagaatttcatatttggacaaactaagcttcggaagcaaaggagaaataagatccttttcagacaagcaaatgctcaggaaatttgttaccaccagacctgcctaacacaagcttctggaagaagcactaaatatggaaatgaaacactgttatcagccactataaaaacacactgaagtacacagaccagtgacattataaagcaaccacacaaacaagttggcaaaataacaggctaacagcatgatggtggtatcaaatctaacatatcaatactaaccttgaatgtcaacaggctaaacgccccacttaaaagacacagggtggcaagctggataaagaagcaagaccaaatgttatgctgccttaaggagacccatctcacatgcaatgaagcccatggactcatataaagggatggagaaaaatctaccaagcaaatggaaaacagaaaaaaaacaggattttaattctaatttcagatgaaacagactttaagtcaacaaaaatcaaaaagacaaagaagggcattacataacagtaaagggttcaattcaccaagaagatctagttactctaaatctatatgctgccagctcaagatcacctagattcataaagaaagttcttagacactttcaaggagacttagattcccacacaataatagtgggagatttcaacaccccactgacagtattatacagattataatctgtataattaattttctgaggcagaaaattaacaaagatattcaggacttggactcaaccctggatcaaatggaccttatagaaatctgcagaactcttcaccccaaaacaacagaatatatatattctcatcaccacatggcacatatgctaaaattgaccgcacaatcggacatacatcaatattcagcaagtgcaaaagaaccaaaatcataccaacctctctcttggaccacagaaaaatgaatgtagaattcaagactaagaaaataactcaaaaccatggaaattaaacaacatgctcctgaatgacttgggtaaataatgaagttaaggcagaaatcaaaacgttctttgaaatgaatgagaacaaagatacaatataccagaatctctgggacacaggttaggcagtgttaagagggaaatttatagcactaaatgcccacatcagaaagttatacctcagattaacagcctaacatcacaactaaaagaactacagaagcaagggaaaaccaattccaaatctagcagaaaacaagaaataaccaaaatcagagttgaactgaagtagataagacacacaaaaaaattcaaaagatcaatgaagccagtgcctgtttttattttgaaaaagctaatgagataaatagaccactagctagactaataaagaagaaaagagtgagtatccaaatacataaaattagaagtgacaaaaggacattatcactgaccccacagaaatacaactaaccatcagagactactatgaacacctctatgcacaataactagaaaatctagaagaaatagataaattcctgggtgcatacaccctcccaagactgaaccagaaagaaattgagtccctgaagtgagcaaaaatgagcttgtaattgaatcagtaataaatagcctactaaccaaaaaaatcccaggtccaaatggattcacaactgaattctatcagatgtacaaagaagagctgttaccattcctactaaaggtattccaaaaaagtgaagaggaaaggctgggtttggtcactcatgcctgtaattccagcactttgggagtccgaggtgggtgaatcacctgaggtcaggagttcgagaccagcctggccaacatggtaaaaccccgtctgtactaaaaacagaaaaattaggctggcatggtggcatgtgcctgtaatctcagctacatgggaggctggggctggacaattgcttgaacccgggaggtggggcttgcagtgagccgagatcacatcactgcactccagcctgggcaacagagtaagactctgtctcaaaaaaaaaaaatatgtatatatatatatatatatatatatatatatatatatatatatatatgaggagggactcctccctaactcattctatgaggccagcatcataccaaaacctggcagagatgcaacaacaacttcaagccaatatggttgatgaatatcgatgtaaaaatcctcagcaaaatactagcaaatcaaatccagcaacatatcaaagagctaatctaccatgatcaagagactttatccacaggatataagtttggttcaacatatgcaaataaataaatataattcatcacacaaacagaactaagcacagaaatggcttgatcatctcaatagatgcggaaaagacatttgataaaatttaacatccctttatgttaaaaactctcaacaaactagatattgaaggaacatacctcaaaataataagagacatttagaacgaagccatagccagcatcacactgagtgggcaaaagttagaagctttccccttgaaaactgtaacaagacaatgatgccctctctccactaatcctaacagcatggtgttagaagtactgaccagagcaatcaggcaaaagaaggaaataaaaggcacccaaacaggaagagaggaagtcaaactatccttgctgcatatgacatgatttccttttttttttgagacagaatcttgctctgtcacccaggctggagtgtcgcagtataatctctgctcactgcaacctccacctcatggagtcaaatgatcctccatcctcagcctcctgagtagctgggattacaggtatgcaccaccatgctcagctaacttttgtagttttactagagatggagtttcaccacgttgaccaggctggtctcgaactcctgatctcaagtgatccacccaccttggcctcccaaggtgctgggattacaggcactagccactgcgcctggcctcacatgaatatatctctagagaaccccatagtctcagcccaaaagctacttaagctgacaaacaacttcagccaagttccaggatacaaactcaatgtacaaaaattactaatatttctgtgctccaagaagagccaagctgagagccaaatcagtaatgcaataacattcaaaattgccacaaagagaaagaaaatacctaggaatgcagctagcccaagaggtgaaagatctctataaagaggactataaaacattgctcaaagaaatcagaaatgacacaattaaatggaaaaacattccatgttcatagacaggaagaatgaatttcgttataatgaccatattgccaaaagcaatttatatattcaatgctattatcattaaagtaccattgtgattatctacaaactagaaaaaaactgttttaaaatttatatggaaccaaaaaagagcccaaatagtcaaagcaattgtaaacaaaaagcacaaagctggaggcattacactgcctgacttcagactatactacaaggctacagtaaccaagacagcatggtactggtacaaaaacagatacatagatcaatggaacagaatagagaacctgcaaataagactgcatacctacaactatctgatctttgacaaatttgacaaaagcaagcaatggagaaaggattccctattcaagaaattgtgctgggataactgggtagccatatgcagaagattgaaactggaccccttccttacaccatatacaaaaattaactaacgatggattacagacttaaatgtaaaacccaaaaactctaaaaatcctggaagacaacctaggcaataccattcaggacatagacatgggcaaatatttcattacaaagacaccaaaagctattgcaacagaagcaaagattgacaaatgggatttaattaaactaaagatcttctgcacagccaaagatactatcagcagaataaacagacaacctatagaaagggagaaaatgtttgcaaactctgcatctgacaacagtttaatatccagcatctataaagaacttaaacaaatttacaagaaaaaaatagctccattaaaaagtgggcagaggacatgaacagatacttttcaaaagacttacaagtggccaacacttatatggaaaaaagttcaatatcactgattgttagagaaatgcaaatcaaaaccacaacgagatatcatctcacaccagttagaactggtattaccaaaatgtcaaaaaataaatgctggagaggatgtggagaaaaacgaatgcttatatactcttggtgggagtataaattagttcaaccattgtggaagacagtgtggcaattcctcaaagagctaaagacagaactaccattagacccagcaatctcattaccgtgtatgtacccaaaggaatataaattgttctattatgaagacatatgcacgtgaatgttcatttcagcactattcgcagtagcagacatggagtcaacctaaatgtccatcagtgacagactggataaagtaatgtgattatatacaggtcagttttgcctttaatttgttgctcattattgtgagccttaacatacttctttgtgaacttgccactgtttcaatataatattgtaatctttatttcagagtttattgcaaacatttatggttaagtatttgatatattttatagagtttacttccttgttgcttattgaaatttgattttataattgtattaaaccaatttaaatatatttaaattcaaacatagaaataaaaaattgaagtgttgatatgtctaacaaaaagccaatgcacaaattaccttaaaagattaattaaatgtctgaatcactaatttaataatattttcatgtttaaaatgtgtcaaatatatttttgagtcctagatatgtgaaggttttgtgcaatgtactgtaatatctgctaagacacactattcttttcttatcaggtgaattcatatttgaactgcaagttaatttcttgaactgcaagaaaagaggcacctaggaacatatttgaaaatgcgtaattttaaagcagctaaaattatttattaattaataattattttctgagtttacatattagacaaaaaatgctactgagaagatatcactggtttttgctctgtaacagaattagttatatctcgaatatgttgccactcacctttcctaggcacataggagaaatcaacaaatcattgtctttttttactgaaagaggaggaccaccaaaatctgtcttgaccacagctctagaaggtaccttactaaacactgtatcatccttgccctattaagtaagtgcttgctaaattgcattctttttgtgctttgaattttcaataaatacattctgagaaaataatacaccgattggaatgcttgactattcaaaatttcaggtatatactccattattttattggtctttctcttatgatccaggcagcacaggatcaggtcttctctagaactcactgttgtatttttatgccaagagcttcagtagacaatcagcaaatgggcttgcagttggcaaaaatagttacatagagctgatgatttctcatagagacgagggtgttaataggaaaatatttctttacttattttttcttggtgaatcaataataaacagagaacttattttcggaaataaattcagaaagtcaagtatctaaatctggtagggatgcccatagaatttttataaggaacatatataattttatttctaaaagtcaatttaatgttattagctagtacacgattcaaaggacaatttaaaaatcaggtaactgtagtaaaggcaaatacatacttttgaatgaataaataaatttagaaaagtcaataaatataaaaaccatgtgcaaaaagatcataccagcaacaaacaaattggagatggaattgtgaaatatgtgatctgcccacctgccaaagtgctgggattacagactttagccactgcgcccggcatttttttttttttttttttttttaagacagtctctattgcccaggctggagtgcaatggcacaatctcagctcactgcaacctccgtctctcgggttcaagctcttctcgtgcctcagcctcctgagtagctgggattacaggtgtacaccaccacgactggctaatttttgtatttttagtagaggcaggatttcaccatgttggccaggtgggtcttaaactcctggcctcatgtcattcgcctgcctcatctgcccaaagtatggggattattggtgtgagccactgcggcgggcctaagatgtgaagtcttgatactgtacaaaacattattaaaatgttaaagaagacctctagattgtggttttggtttactatccaaacaattataccatctacaaataataactattcgttttctttatttccagtactcatgtattttatttctttttcttgccctttatactagtaagaggtccagtacagtattatctaggaatgatgatactttacatcttttaaaaatatctaattccaaaatgaagaaaaacaatttttcagcatttaatgtgattgtgtgtgtgtgtgtgtgtgtgtctgtctgtctctctgtctgcctgtgtattctctaagaggtaaggaaggtatttttccatttctaattttctaggacatttttacataaacagggtctaaattttgtccagtgcttctttctataccaattgagacgaccatataccttttttcttctttaactatgtcaaatgtggtaattatattgatcaaatcttttaaatccttattatgttattttctgcttttctatcacctcttgagcataaagtctcccaccataacatggagttgactttttctttatttaatcaattttttatttatatacttttaagttatattttgggtctatatagatttagtattttaatgatttcctaatagattgacccacttatcattatgaaatgtccccttttctccttcgccttaaagtataagtcaggtttcgtcaattcagtttttgcatgatatgtactttccgttttttaattttcaaagtcattttatgatattattgcagtgtgtattttataagcagcataaacctttcattttaatcttgtttaataatttaaaaattttacttagagaaatttgtctgtttatgatgtctaaattattggtagttagagttaaatctaccatcctttttttttcagatttcctgctttcttgctttcctttggattagacattttattatatttttccttgcattaacttgttaaacatacaatcatttattatacagcagctatcctcaacttattacttcctagtaccaaatattaatttaccacttcctaaaatagagttagattttttaattccatttacactactttttcgtgttatttttcatgcaattcagttatatatgcattgcaaaattcacaaaccatgacatctatagttgtgcgcaaatattagtttgtatttattcctatacatatcctttccagtgtccatctcttatgtatctttatgtttctatttagtcttgcattccttctgttgcagaactgtctttagcatttcttttatagagtactactgatatataactgcctaatattttgttgttttacaaacagtatttatttgcacattcattttgcctcatctttttctttccttttcaaaggccccaaagatgttaaattacttactgatatttattttccttggaaggattgagttccttttgagttgtttttcttacatataaatattgccatacaactacatactcagcaaagataatacatagatatattaagtatacttgccattggatatattttcttggaataggcagccatctgccatatagcttatgtccttaatcaaaagcaggatcattttgatttaattcaaaccatctacttctactatagcatgatgaaataatacatatgcccttttatggatcaaaataatattaaagtactattgtaaatgtagtatatttaaagcatatatgtgtgtaatttaggcatatgttactggaatactgaattcagtattccatgtttggtattcagtatcaaatattttaaacactgacatgatcattatcatttctgcagttgtttttctccttcatttccatgtgccatgtgcatttattgatctagatgtgaatgttttgcaatataatattcaaagtgacatccccactttgtaatttaatagaacaatttattttcagtagtgaagtagtgaggaataggccttagaagatggacacaagaattgcaataaatgcaggagagcaaaaatgaacttaaaaaatcatgtttgttataacatcagagagttgtggaacaaataaagaacagatagcctaaaattccacagaggaaagatgcctttgtatattgccttgtgtcctcctgtcactttgtgtcttagtgaaatttgccaaatacgagcgtgattggagattctggtttggtccaggcagaagatctctacaagagtggggaattcatctcacctttggcagaggcatgtacgtgccttacagattatggattatatggcacaagtggagcccttaacaccaggatgaatttttctttgggacatttgctgaggcctgggttgagaatggtagctgggtgggttggctagagagacacaatgaaacctcctgcattctcctgagttctcccctaccatgctgccttgattttcctttatgtgtgtctgaaatatgggctttgggctcccaccactacacctcctactcatcttcccagcccctgcactgctctggtcagcatcatctttattttaactataagctttcttgaatgatcctttctttctcaaatcattcccaggtaaatgatgggggcagaatctacttttccaaggtcttctacatcctgctggattgactaggaatgtgtgatatgacctgaggtacatttggacagggacttctctaaacttggagtcactaaagactgtgtgatgcaatacttccctgggagtttgccattgcatcagagcacagttttgaactccacgcaggattcccacaactccccaagaaatacagcagagctttcacttgggttcatatatcaactccaacacaccaccactaacatagttaacagctgccctcacattctcatttactgccctctgcccaaagtctatagattattatttttcaaggggcaaaacataagcttatatattattttatattaatccagattccattgaatatggcatacatttttgactatggctacatttttagtccttttttcttttgtcttttgaaacttggatatttatttttaaaacacagctttggatttcatagaattttcttttcatttcaacatactgtgaataagattgttcaaagatttttgtcactaggtctttgtttttgcataaacttaccaaaacatatctagcagttacaaagtctagaatgtaaatacacgcaagcactccctgaaaaaaaaataggataaaatgctgtgcttcctgctgtcccagagagagatgtatgttaagaaaagtgtaaagtggaaggtagaagatgggagagaaactgttttagtatcaccaaatcttgtcaaggtacatgtacactagtaactgctaaaccaaatcaaaaccaaaaatatattagttttgtattgccactaatctgtttcatttaggtggctgtcaggctgaatgaatttagttagtgaatgaacttaggcaaggcagagaggattacgatgagctttgattcagctttcccttgcaacatgactggttgttcagaggcacttgacctccctccattctcctgcaagttctgccaggccaagactcttgcaactgatggggactaaattgtggtacctgagatgtaaccgagatattgatggtcaagagccctcagctgtaatgtattctcctgaattctccatcatcttcctctttactctcccaagataatcgacagtgtctgctttccagataaacaacacatttgggcagctgaaccacagcaagaagggaggtttctgttcagggttgtaccactgtgttaggaaactgtgtagcttgcatgcagtaataaaccccaacatcctcagcctccacccagctgattttcagtgtgaaatcactgcctgacccactgccactaaacctgtctgggaccccagaaaaacgactggaaaccctataaatcaggagctgtggagattgccctggcttctgcgggtaccaatgcaaataggtatatccattactatgcaggaggctttgactagacctgcaggagatggaggccggctctccagggttgacgggcagggagggtggagtctgggtcatcacaatatctccactggatcctgaagtagtgagagaagtgcaaggttatgtacaaatattgggaaccattgaaatgatattctttctgttatctactttatgctaagtgatttttttgtgtgactttggttcatacccctaaacatccaggcataaaaagaaccaacattcacaaggcacaaaagagactcaagaagtcacctacactattatcctcttcctgtgtgacactcttcatgagagcacaagtcctttgtccttctaggatatgaagtttagaactataagagtgaggaatcttctctttctgactcttgcagttctaaactttatacaccttttcttgcaggtcaagatgtgcatgtggacaggcagtggggcccccagagctcaccctcacactccattctcctcccttatctcccttctgtccttaccaggaacccaaagcattagcagccccaggagctgagcagggaaccttattgtgagaaggtgagctgaggagttctgatcagtcaaggcaaggttacagctgagcttttatctcagactcacaatggaaggtcctccctaggggacagtatgcaaatcccctggtgggtgcagtggggtggaaagagccaaggagagtatggggacatctagtgtgagcacagtgacataatgtgtcctctgtgtttggagggaacctaataaagtttgtgctgcctgagtggaaaaagggacatatttaatcatgttcttctatttcctctaagagatttctacattgttttcactttcccagacacattttacacttgtctttaataggctgagtttccataaatatttggttattcttatttgtttaattttattatatatatacacacacacatacatatatatacacatatgtatatatgtataaatatatatatatttttgatatatatatctatatataaaaatatatattattttgtgtataaatatatatgtatatattttgagacagagtttcacttactctgtcacccagactggagtacagtgtcaggatctcggctcactgcaacctctgcctcccaggttaaagcgattctcttgcctcagcctcccgagctagctgggattactggcatgcaccaccatacctggttaatttttgtatttttagtagagatggggtttcatatattggccaggccggtctcaaactcttgacttcaagtgatcctcctgcctcgacctcccaaagtgctgggattacaggcatgtgccaccacacctggccagttattcttatttattattttcatatttattttagcatctaggtttttaaattagtttgattttagttgataaaatccccagagtaaagggcacaaatattaagcgtgtaactgaatgaaatttgtgtatattcactgtcaaggtggaactatggaatatagattttttttttttttttgagatggagtcttgctgtgtcgcccaggctggagtacagtggcccgtgatctcggctcactgcaagctccgcctcccgggttcaggccattctcctgcctcagcctcccaagcagctggggaccacaggcgcccgccaccacgcccggttaattttttgcatttttagtagagacagtagagaccaatatcatattccctcagtaatgctctgagctgtactccctactagcatgttcctgtgaactcaggaactgctctcctagaccccggctttctggagagcaggtgagggggaggcaccggggaaaggtcaggtcattgagctgttgggtgtatgttcctgctgtgcaccatcaatgccactttcctcttttacgcttaagcaatgaatggggacatcatcctgacccagattccagcttctctgttgggattggtaggagggagagtcttcatctcctggcaagccactgcttacgtatatggaaaagtattttagattctaatgaaactggacaaagatttgaaatccgattttttacatatctaacttggccctgattgtctcagcctggttcagcaacagaaggagtggaataaattgtatcagcatcagtagactggagcctgaggactccagggaacattcgcacacaagactaggagaggccaaatcacagcagtctagcctgtgcaccgtcctcctgtggcctttcatgagcctgattttttagagaaacttgtttacatccagcttgccaggatcaaattctagagagacgcagatttaaatgtaagttcgcatctttttttttttttttttttttttcctgcatggatgtgctggaatgatggaggaaggagttatggagccaggaatatgagggtatcttgaagattaaaatcaagaaatccgattttctcccctggagcctccggaagaaatacagccctagtgactccttaattttagctcagtaagacttctcaatccagaattgtagataataaatttgataggatttattatagataataaatcatactgaatgcggtataattgtggtaattagttgccctagcaataggaaactgttacaggcataaggcatatcttttatctttctaaaagtgtgattgtccttcttctcctaaacatttccattgtgttatcatttggtgtcaattttgaccagaggcagagaacattttactgcgaggagagctagcaccagaattcttaggtggaaaatctcttgtgagaatccctttattaggtctcatatgatctgcatgtctgagatcctaggggtcagctctcacagcacaatgtgggggagcatgtgtggttatttgtttcttattatattagtaggactcgttagattttcaggacaggatctgagaggaaaggaactaaaaacaaagaccatatgatcatctcaacagatgcagaaaaggctttaaataaaattcatcatcccttgattttaaaagccctgaacaaactagacattgaaggaagatacctcacaattataagacctatatatgacaaacccacagccaacatcatactgaatggtgaaaagctggaagaacttcctctaagaaccagaacaagacaaggatgcttattactctcaccactcctattcaacatagggctagaagtcctagccagaggaggagaggaagtcagtctatctctctttgcatctgatataatttatacctagaaaaccctgtcttcactgcccaaatgttcctggatctaataaaccacttcagcaaagtttcaagatataaaatcaatgtaaaaaatcagtagcatttctatataccaacaatgtctatgctgagagccaaatcaagaacgcaatcccattcacaatagccacagaaaataaagtacttaggaatacagttaaccagggtgctgaaagatatctacaactagaattataataaactgctgaaagaaatcagagatgacaaaaacaaatggaaaaatacttcatgctcatggatggaaagaatcaatattcttaaaatgatcacatagcccaaagcaatttacagattcaatgctatttatatcaaactatcaacaaaatttttcacagaagtagaaaaactattctaaaattcatatggaaccacaaaagagcccaaatagacaaagccgtcctaagcaaaaatgaacaaaaccagaggcattgcactacctgacttcaaactatatactacaaggctacggtaaccaaaattgcatggttctggtacaaaaataggcacataaatcaatgtaacagtttagagaacccagacttaaagctgtacattataaccatctgatcttgacaatgttgacaaaaggtagcaatagagaaaaggctccctatttgataaatggtgctagcataactggccagccatatatagaagattgaaactggaccccttcctttcaccatatacaaaaatctactcaatatggattaaagacttaaatgtaaaacctaaaacttcaaaaacactagaagaaaatctaagaaataccattctagacaaaggccatagtaaaaatttcatgacaaaaactccaaaagcaactgcaacaaaaacaaaaattgataaatgggacctaattaaagtaaagagcttctacacaagttaaagaaactataaacagcgtcaacagacagcctacagaatgagagaaaatatttgtaaactatgcacccgacaaagacccaataaccagaatctgtaatgaacgtaaattaacaagcaacaaacaaaaacaaccccattaaaaagtggccaaatgtcatgaacagactcttcttaaaacaaaacatgcacatagtcaacaagcatatgaaaaatgctcaacaccactaatcattagaaaaacgcaaattaaaaccacaattaggtatcatctcacaccagtcagaatggctattattaaaaagtcaaaaaataacaaatgttgatgaggttgcagagaaaggagaatgcttatacacggctggtgggagtgtaaattagttcagccatggtgcaaagcagtttggagattcctcaaagaattttaaacagaactaccatttgattcagcaatcctattacagagtgtatacccaaaggaatataaattgttctaccataaagacacatgcacacatatgttcactgcagcaaagacatggaattaactaaatgcccatcagtggtagacagaataaagaaaatgtggtacatatacatcacagaataccatccacaactgcaacaaatacaagacaaagttcaggttattggaccgtagttggcctctactatattctcttttatgttctcattcctggagtctgcccacagttttaaaattctcaccctttggtaaagaaaaaaaaacctcacattattctgtgttattctagtggcatataagataaattctataatctgcttgttccagtttaagtttttgtttttaaaatccaacttttggaatttcaaatattatccttttttattagcaagaagtaattgaaatgaatgaaagagttttaacatcaggatcttctgtcttccatgacgtcacaaaagtctatttggaggtgcaaattcaagctttttaatgattgtcctcagccagctctccctgaggacagcttgtgtagaatgctcttttcactatttgttatgtgttgcaatggaaagagaactagtaaaaaggagaagaaggaaattggaaaagttgaaaaataccagtttctaaatactaccaaatactatcctcttaaaaatatacacaaaagacctaaacttcaagagatagtcaacacatgttgacacgaatctgtgttacttgtctggctattaagctatttgaagtctcattgtcgaatgtaggcaaggcagggaggattagtgtgagatttccctccactctccctcagtcctgtctgcttactctgaaggcacttgaattatctctgttttcctttggcttatgccatgccaaggctgtgggagctgacaggaccatgaatgggttttacctgatgtactgcggagtcccccatgggacaggtcattcagctgcaacctgttaccctgagctcgccaacatcttcatctttttttttttttttttttttttttttttttttttgagatggagtctccctctgtcatccaggctgtagtgcagtggtgtgatcttggctcactgcaggctccatctcccgggttcaagctattctcctgcctcagcctcctgagtaactaggattacaggcgtgcaccaccacgtccagctaatttttgtatttttagtagagatggggtttcaccatgttggtcgggctggtctcaaacttttgacctcatgatctgcccacctcggcccaacatcttcatcttatacagcagagattctgttgtgccactccccagataaacaacatatttcagcagctgggccactccaaacagggaggtttgtattcagggttgtaccactgtgggaggcacttgtgtaccttgcaggcagtaataaaccccaacgtcctcagcctctaccctgctgattttcaatatgaaatctgtccctgaaccactgctgctgaacctgcctgagaccccagacttcctgttagaaacttcataaatcaggcactttagaggttggcctggcttctgcagaaaccaattcaagtaagtgtttccatttctatgaaaggggctctgaccagacctgcaggaaatggaggatggctctccaaggaagagtggagtgtgaagtctcaggatgtgaacttggagggattttttttcccacaagaatccagcaaatgagaggataaccttacagcatccataaggtagaagcctatcaaacgtaaggacaacctgagactaagggtagccagggagagaagatctgagctggaaagggtgaaacaaatggaccaaaagaagctgaccgcaagacaggaagttcagaatcagggaagctgaatatgaatctgactagaagatgctcttgagagatttaaacttttcccatgttttatgtttctcatattgcaaatagtttccattgttaagagaatatgtttgtacagaaattcagcttatgacgaactttgaaattccaccaaagagatcgagggaacgatgggttgttgcttttcaggactacaaatcagcctgtctttgagatctgacactgtctattttgcagtggaatctgcgatgaggctgtgaattgggcagtgaagtcagggcagggctgactgtgctctgggtgccacggataacagggacattccttcagggccggtgatgctgggaggctgaggggagagactcagtatgaagccatctgtgagcctccttggcaatgctatctggaccctggtcatcgaatgagccactccaagcagggagttttgccttcaaagttgtatacatggatgcccgtggatggccaaacataggctcaggttgagcagggaccaagatttaggaaggagcaatatgaggctgacctgatgctccgaggtttcagcacaatcttaagggatcatacagggagagaaaggggtcacaaggtgtaattttttcatttgatgctgaatatacctcttcagaccatttttctaccctgtatgtaactactggtatacatttaaccaaagccactgctactaatgatcatttcagtcattgatagtgagaggtgaggccagctggacttcctgggtggagtggggacttcttacaagaggattgtaaaatgcaccaatcagcgctctgtaaaacgcaccagtcagtgctctgtaaaatgcaccaatcagcaggattctaaaagtagccaatcgtggggaggattgaaaaaagggcactctgataggacagaagcggaacatgggtggggacaataagggaataaaagctggccaccccagccagcagtggcaacccgcaagggtccctttccatgctatggaagttttgtcctttagctcttcacagtaatccttgctgccgctccgtgccatctttaagagctgtaacactctccacaaaggtccgtggcttcattcttgaagtcagccagactcaccagcaggaaccaactccggacacaatagcctgtgtgcacagatcccgagaagctggaaatctggaccaccattcaatgtatgaggagacatacacataaagttcacgttttctccatccacaggaggtgactgtggatgtgagtttgagtctgactagaagacggtcttgtgagatttaaactacgatttttcctattgaaaagaagaaacacctttttttaccctttttgcaacaaatatgtattgagccccaacagtcatgcattgtgctaaatgaaaaatttaaagatggcacaaaagagaaaaaaaaaaggaagagaaagagagggggggcttcaaaatcttgtataattcgttgcaaatactacgaacacttccaggtatgtttattcataaggacagtggatgcaactggcagaggctgcagttttgcagtggagggaaactctgtatacagaggcaaacttcttctgccatggccacagcaatcccttgttctaagcttaggaagaaaaatctaaaaaaatgaaattcacagaaatagcaagtagaatgctggttaccagagactgcattgttaaagggtacaaaatgtcagtctgatagggggactaagttttggagatctgttgcatagcatggcgacattattatatagatgtatttctggcaggcttgattgcctattacatggtaagtcagcatacactaagacactgggggctgctgcagagaaagagatttaatcccaaggcaattaaatgagaagacaggaggaagcctcatatctacctccccaagcactttggggttaaagattttaagtggttttggatggagagagagattggttgaagaatgaaggatgaagtcatgggactgggaggtgaagaaactgctttcttatgttgactcggttctttgggaggggggtggtctttagacaagttggtgtcagctattctactggaattcaggatctggtaaatatctcaaagattaggttttatgctcataatggtgaaggtgttatatttgggaacaatggggcgttaatggtctgtatttattgcaacttgacttttattagtgagaagctaagggaagttgctcagaatgttgtctgattaatgcttaactatatttcagtctggaacctggcatactgttcttgttaaccttatgacagtggttttgtagttaataatactatattctgtatttcaaaataacaaagtatagtcaatgttctcaatacaaaaaatgataaatattggaggtgaggactatgttaattaacctgatttgattattcgacaatgtatacatgtatgcatctcattgtaccccgtatgtatatacattactatttgtcaattaaaatcaaaataaaacttttaaaaattcatgtagccattgcctggaataaataaagataaatatgtgtgcacatgcataactatacccctgtaaaaattggagctacgaagtccagtaaaatattgaatcacagatatttctgtctttagctttagtggaaatagtcaaaatactgggtcccaacaatagttatattagtcctttcttcccatatccaccaccttgttattttttaattcatttgtaatacctttagtttcatttactcttgtttgtagcccatttggatactctcatctttcttgatttcaattattttcaaatatttgtagtataaatagagtctccaaagacataaattcacaaaaacaaaaaggtaagctcagagacgtctcgccttccaccccttctgtaccactctcatctcatcccttcaccctgttaccagccccttcctcttatcactccctgccagcctcactctgtctatcctctcaaatttgttgttttcgtttacggttctgtttgtttttaaatctcctctgctttcttacttggaaggtaacacggtatagatatttgttggcactttgcttttttgtatatctgagaaataacttcctttcaattcatagataccttcttccttttgacagctgatacatactccattgcatgaatgttccatagctatttcaacaaaatatttatttatgaatattctgggtggtgtcaacattttacaaatcattacaattaatgttccaatgaataaccttgtgtatatgtatttttgtagtgttgaaggtgtatcttcagagattcctaggaatgggattatgggtcaaagttacacattaagatagttttgtagatgttgtcatattctccttcttaaaaaggtagtattagtttccatcctcacagctgttaatgagaaatcctgtttccctataaccttgcctaaaaatatggttaatattttttggattttcttaaaccagataatactacctcaaagtagtttcaatttgcatttccctcattattgagattacacactttacttgtgtttaaatgctatatgtatatatcttttataatgcattgtctgttctcttttcttcttttttctattggatttttgatccattatcttaacttttaatagagttgtttcatattagaacagtaacagtttatttgtttaatatattaagaatagtttctccttgtttttagttgtcttttgattttatttttgtgtatgcgatttcatttatttacttacaatcttttatctaaaaattcaatcatatttggaacaacatattttgtttacagtgttgatttattttatcctaatttgttttttagttctgtattattttattataattgagtaccccagagaactacaacctgcatccttggcttattgtgttttacataatttagcattttacgagcttccagacctggatcttaagcctcatgatgccccccgcctcggcttcccaaagtgctgggattgattacaggtgtgagccaccgcgcccggccgaagggacatattttttaatgtccttctgtttctctaagaggtttctaattatttttccctttcccaggcatattttacattggtctttaataggctgagttttcataaatattttctattctatttggtatttttacgtattattttaagtgataaaacacccagagggcacaaagggcacacatcttcaaattgtaactgaataaagtttttgtgtattcattggccagatggaactacagaatatttaccttctgctgatgcttcctccatgcaccttcctcttcagtaactgcttccccatctcaaccaaggtaattgtcattctgacatcgaacacagtaatttgggtttttatgtctttaatgtcatataaattgaattgtgtgtttttttctagctttattcttattgtttactactttcgagtccttcattatagactatgggctcaaaatcccacctgctgtaatcttctgtgattctgaaagatttcctcttgaatttcttataaggcagagctgctattaatgaatttattctgtttatcaaggaatatttttagttctgaagaatattttcaccagaaacaaaattgctggttgtcctctttcatttccttttagtatttaaatatctcattccaatctcttccagcctccctcggtcctaatgaaaacttagccaatggcattattgttgtgtctccatatgtagagtcagcttttagtcctgacacattcacaaatttctctttgtctttcaacatttttaagtataatgtattttgttattaatcttgtattatatcctgaaagcgtttcattgagtttctttcatctatagattaaattacctttgtggttcattatttttgaaaagctgttgtcattactattccaagtattttttgatcactttctctctctctgcttttttgtgactcgctttacacacttgttggtatctttcaacctgagctgtaattctgtcaagtcttgcgcattttttcttaaactcctttctttatttagattcaataatttctgtacatctatttttaagttcactgaatcttttgccatcttaaactgatgttggacttatctaatatatttttcagttgagttattgtactttttgtttctagaattctcacttgattcttttccatagtttctattttttaagagtttccatttgctgagtcattgtctttatattttcctctttatatctttaaaactatatgatcatagttttaagaataattatttaaaaatctatataataattgctttgtagtctttgctaaagctgatattcaggacgagtcagaattagctttcattgactgtgctttcttgctgcagttgttttgttttgttccctcaatattgatcatacttttctgtttctttgcaggattttttaatggaaaactgtatattttagacaatatattcctgtacctctatcaggaatatattctatttttcttaaaatttgtgagtttctttatagttacttccctgaacttacagtaagtccctaattcatggtggttgcacttaagatgttttgactttacaatagtgtgaaaattatttgtattcagtagaaacagtgcttccagtactggtacaactactctgtttttcactttcatataatattcaataaaccacattacaataagttataataaattattggtggtgataaatgaaagtgaccagtgaaatcccttttggaaggaagcctttgacaaagctaagacagctgttcctatcactcttcctacttggtcattcactaactttcttagttttgttatttattaaaacagagtacctctctgcaaatgaacagctgttactgagtcaattagttggataaataaatataattttctaccatttaaaatatttgtagaagtcaaatggatagctgcaccatgcactgagctgcgtttactggggagactgagaattattgatgccatgttaagaatcacactgtgagaaactaattctggaaatctgagattctggcggcacagttgaagagggtttggctacatctgcatagtaattatttccaaaaataagcacgttcgcaaatttttaatcttctgatctcaccatcaccatactgtcacccacactatattccaggtattcaggcactgtaagttctcattttggtgtttcttcaggttcactgtggccattctacatccttgacattcccatataatatttagattagcttcttaatttaaattggagtatactttaggattttgatttttcttatatgtaatcaatattttaatcttcgaagaattgacatttttatagtactgagacattcagtctttgaactgaatttctatttacttaggttttcttttatttttcaaaataatattctggagacgtcagtgtatttagtctattttttttaaataattgatactttgatgtttttgtaaaaggtgtgtttgttttataatgttaatttttagcatttttttcattatgcagaaatgaaattgatttttgaatctacgaattaataaattgatcttgaatctaacgattttctatttctcatgtcaattttaatagtttctctgtagacaaatttgaattttatctgcacacaatccttcatcagtgaattatgacagctttaattcttcttttccaattttgattatttgttgctattgttgttgccttatggctctggttgggacctttattgacatccactgacgtaaatctgatccagtggccattactgtgaaactgtgctttaaacctggctgtccatcttggtctgaggaataatgcaggaatcagagtctaaatatatcaagggattacttttttaagatccccaaaatgcccaagcagagaagagatgctaaaattgagttgtcattgcagcagctatctgtaaaggaagcagctggtataatctagtaaacaatgaaggtcttgcagaggtttttgtttcaagctgaatcactgtgggaggtgagctaccatactgctgacagtaatacactgcaaaatcttcaggctccagtctgctgatggtgagagtgaagtctgtcccagacccactgccactgaacctgtctgggatgccagtggccctgctggatgcatcatagatgaggagcctgggcgccaggccaggtttctgctggtaccaggctaagtagctgctgctaacactctgactggccccgcaggagagggtggctctttcccctggagacaaagacagggtggctggagactgcgtcaacacaatttctccggtggtatctgagattggaaataaaatagaaaagtcacccatgtaatctaaatcaaacccactgtcttcccagaagagccagaattattgctttatattgagctttaattattgtattgattcagcagagttgccaggtaacaggacttgagagggttttcactgacatgcaaaaccatcccatgttcccctcacctgggagccagagtagcaggaggaagagaagctgcgctggggtttccatggttccctctgggtcctaactgagcagttcctccccagagctctgacccaggcattgatatgggctctggactgcagggcggctgggagggacatgcaaagcagctgggggggcgggtgctgggcttccagcttcagagaccatctgcctcccctctctgcactcagcagcccatgcccaggtgatcaggccagaaaaggccgttggctcagcctgagggtagaacttctcccctgcggccacagaatttaacccctgtgtcctcttgtctcaccatcacctagattcagccacagaatgtttggtacaagtctgttagaaacaaaatagaaggctgtggtttcatttttctctttctgctccaacttgtgcccagtcagttccctaaatgcatgatggatcaggttgaaaggaagagtctattactactttatcttccggatatacttgtatttacttgttagcaatctttcctgagggtccagaggctgtctcattctttgcagaaattaaaagagtaacattcaattaacctcagcactgtgagtgtgaggactttcacaactgcacagataagtgatacctgggctccaaatcctcagggtagtgataccatttccctaaagacagaagatggttttgtccatgcaggcaaagaactattccttgggtgatcctctaatctatccagtctttttatcctgtatagctggtatggtttacccttagtaggatgaaacaaccacttcagtccgtgacagggtgaggtctgggatgcagatacagtgttttgtcaaattatctgtggtggcttggaagagccttacaaagacatgaagcttctgggtctctgctgcctgatccttgaagaaaaaacagattgacagatcagtgccccacctcccatccaccccaggatctcagggatcccctactcatccacaggggttggtttgagttagtggagggactcagtctgtctgtccctgttctgagactactacctctttgggcacccattgccattgttgcttgacccagtcctttcaccctcggttgtccagttctagaagggaggtcaagtactgtagaaacttgacatgtctgataacgtcatccaccctaatggaggaatcagatgacccccgtaccagtagaaggaaattaacaccctgatatttcttgatcctgtggaacccacagaaggcacccaggggaatcattccatccaattagagttaggaggcctgtctgggttatcatggtggcctaaactgcaacacccccaagaacatcactataaaaggaaaaaaatgattggaaaccctgagtttgggatttcacagtggcagctctatcaggaaactggccttgcccaacttcttcctcactcaactcagtgtttttcaacctgcacctccgtgccgtctttcccttgctctgcagtgcagtgtttaatgtccatttgctgtggtcagatggggtaccactctattagcaggttgtcctgatgtacactcttcagttgctgtgtgagtcagctgttctagcattaaatagatccattggcctttggataacaaggtgtatggaaagtccatcacgtcccatgagagtgtgtccattgacatcatttgggcagtaaagaactttccttggtcaaagcaaagtctcagtgggcatccaaaaacatggcataagttcatctcaagggtggtcatggtagtcccagcatccagctgagtgacatatttgtctcttacaggtggcaagctgttgccatagtccttttctccacagaggggatgctttaatagtccagtcactcggttactattttcctgatcagatagctagactgttggcagtggcccatgagttggtaaaaatatagcaagaggtggcagaaaggcctgcatgaccattaccactgcatgtagtttggaccattgggtggaatgaccatcatcagtctcaggaaagaaaatagtcatccactggctagatggtagccacccccagtctgcatgttttgcagagccctaagtgaaccatgccataccgatgtcggcatgtctctgaatcttggacttcgggtagccaaaagcagagccaaaccatcccccatgggtcatttagtcccttctagcaagctcgccatttgtttatggagccttcagatcccacgggttgctggctgggcctgattctgaatataccatttccatttgataatgcagctctattgagcctgtccagtttcactggttggatttttgcacccaagtgaaaaggagcagttcacccagcagcgccacacttggtgctcagccccaagctgtccagtccctgtcagtttccaatagcaagcaaggagttgccttgccaaagagggacatctggtggctgcttcagctggtttatgtgttcagtatctgagaggctggctcactcagtgacaattttctgttgccacatactccagtcagcatacatagagactgtggacacctgaacttccatcaggctaacaggctctaaaggtctaaaagaagtgtttggaccatgtcctgttgaacttcttccaaggctgctgttgcaaagggctctgttcaaggttggtggttttgtttgtgattttgattttgactaagtggactaaaagcccaccccagagaggtttatgctgtttccaatactcaaagaagcctaccagctgttgtcctttttattaatggttgctgctagtaccaacaatgtttaactatatccgcgatccttccttggtttcctgtccaagtggccttagcattcaacgtgaaatagtccattgttagtctctgttcccctaaagtctttttgccccgccaaactgagttgctccatggtgacaggggactatgtaacattttaatctgtttgtagcaagtcttgaaaaaaacaggtaatgtcttattcttcacttagtacacagtactgtttttgtcaaataacccacggagtcatgcgtagcttaggtggtaggcttcagtggatattcccttttgttaaggcttgaattcttagctgcaagggaatataccttttatgcagcagtgatgttctgtggtgcaaatatcaatgcctgtactgcactctgaggtgggaactacagtcaccagccccaacatggcccgcagggcaccatccacaagcagagaagcaccatggccactgcatttgtccctgaacctctcaatgtcattggttaaattttccccaatggagacctatgggctctggcacccaaaaacccagaaaagtatttccttattttctccttttatttttacatggtctagggccactggtttctggtgagcacccaaaggcattggctgtatccctaactgtgatatttagatcaagaaatttggaactgcaaatattgctttatcaaacaaatacaccaaacagtctgcataggccttccctgaactttttctgtatctcttatttagagagtgagtctccctttgtgtgaaagcccaaatagcatatgttggttccctctcagggatcttagggtccatttgagtacccgtttccctagctctctggctccaggaatgagcaatcatgtaagtgtctacgaaccagaggattttgtgcctcattctcatttctacactcctttctctctgccttaattcaggcagccagctcatctaaactcatggagagagtgatctataacccactgatcctccctcattccccataaagcacccagatgcatgtccaggccttgcaccttccagtctaatggtcctcccctggccaagtaatgggaggtatcattcttcccacttcaccaataagccatggttctgtcatactagaatcttctcaatggggcaattttgttaagcaggttaactgtgcagtgattaccaacttatttgagtccagggagataaaacacccttacacaactagttatgtgaagcaatttacaatttacagacaggcagcaagggatagcaaaatccaagaatttattgtaggtctgttcccccaaggctcaggaaagctgcctggggctaatggggtctagactgtgcttcatatacactgcagctgaggcactcttgattggacccaccctgggttttatatcttggagtcacatatcatgctgagctaaagtgttgaaggaaatcctgtttcaagagggtgtggcaggacaatactccctgtcaattggacagacaggtctgcatgacagtcacacagacaggcctgtgtagcagtccagttataccaacaaatttccacagcactgccttaacactgagcaaataattaaacctaggggaatcggttcccaggcatcaaagctagaagtaaaacataggtcagtgggaggcttgcacagtcttctccctaacctcaagcaagtcaaaataatggagacagccttacattcctagtgccaggacccgtcttgggtcaataaaatgagatgagtcaaggtaacagaggcagctgtttgaatagattcactggagagtctaaggcagctctctggaccaagctgtaaatgagataagatagaaataatcactccggtaccacagtcctcactgattagaatttaggagacaggtcttgaaggtactgggaccctcacagcttaatcggacttagcatttctttggcctctgacctagttgaaacaaaattagttgcctatagacttaggcaaatgttatattgcacataggcacataatgccaacctatataagcactaagaaaatggtaacactttcagcctggccaacatgctgaaaccccgcctctactaaaactacaaaaattagccaggtgtggtggtgggcgcctgtagccccagctactcaggagactgaggtaggagaatcgcttgaacctgggaggcagaggttgcagtgagctgagatcatgccactgcactccaacctgggcaacagagtgagactccatcagagaaggaaagagagagagagagaaagaaagaaagaaagaaagaaagaaagaaagaaagaaagaaagaaagaaagaaagaaagaaagaaaagaaaagaaaagaaagaaagaaaagaaagaaagaaagaaagaaagaaagaaagaaagaaagaaagaaagaaagaaagaaagacggaaggaaggaaggaaggaaggaaggaaggaaggaaggaaggaaggaaggaaggaaggaagggagggaaggaagggaaggaaaattataacacttggagttggtctggtgatattatctctgaccttcttcctgtatccagttaaattcccttctttcttagtttgtctgcttctagttattgggccatgagaacatgcagccagaactcggcacaaggggattggaacagagcctgtgctgtggtggccaatactgccctatctcaggatgttacattcccaggatattctacagtgattcttgaaaactaagagtgagaaaagggaggagactgggttggtccaaggccaactggagactgtgctgcaaatactatagtgggatgacacctcattagtcctgtggcttgctgattttgctgagcatagtgccttcactgttcatctatgtgggagcctgtgtcagaatttccttcctttggaaagttgaataacattccattgcatatatatttatatgccacattttgtttatccacccttccctgcatgaacatttgagttgattccaccttttggctattatgaacaataattctctgaatgtgggtatataaatatttcttcaagttaatgttgtcagttatttggatatatgtccaacggtggaattgctgaattatatagtatttctatttttaatttattgaggaattgcaatgtagtttcttatactaggtgaccattttacatccccaaaacagtgtccacaagatttccaatttctccaaattctcatgaacagttttcattttctgttgagggaaaccatcctaagaggtataaggtggattttgttttcattgccctaagaattagtgatgtggagcatctttttctgtgtttattggctcttcatcagtcttcactggagatggttaatattgagtgtcaagttgattggattgaaagaggcaaagtattgttcctgggtgtgtctgtgaaggtgttgccaaaggagattaacatttgagtcagtggtctgggaaaggcagacccaccctcaatctgggtgggcaccatctaatcagctgccagtgcagctaggataaaagcagaaagcaggcagaggaatgtggaaggactaggctggctaagtcttctgaccttcatctttctcccatgctggatgcttcctgccctcaaacatcagactccaagttcttcagcttttggactcttggacttacgctggtggcttgccagggtattgtcagccttcagccacaaactaaaggctgcactgtcggcttccctacttttgaggttttgagactcaaactggtttccttcctcctcagcttgcagacagcctattgtgggacttcaccttgtgactgtgtgagtcaacattccttaataaactccctctcatttatacatctatcctattagccctttccctctagagaaccctaattcaggaatggtcaggaagcaattaatttccctttaccaatctattttagattgtctttgtgcaatgaattttttctgggttagtaaattaaaggagcctctaaaactagctacacattgtgaagtccacattagaggcagtggaataagtgtcccccagcatttaaaacccaaagatttgagggccctgaatctaagattttttctagctctcttgcttcataaatatgccctctgatttttaattctaccttagagaaggacaattgtggggaagatattaattgtgggcgaaatgaagaatgcccacatcccgtccatgtcctagtacctagaacctatgaattctaacttacgtagcaaaaaaaaaaaaaaaaaaaaaaaaaaatcccaaaacttagtggatgcaacttacttaaggattaaggattttgagtttgggagaaactcctagatcatccagatgagatcaatataatcacgaaggtccttataattgggagggaggagggtcgcagttagataggagctgggacaatggagagggatactggagtgatggaaaaatgggtcatggagccaggaatgttgaggcatctttttttttttttttttttttttttttttttgagacagagtctcactctgtcgcccaggctggagtgcagtggcgcaatctgggctcactgcaagctccgcctcccgggtttacaccattctcctgcctcagcctcccaagtagctgggactacaggtgcccaccacaacgcctggctaattttttatatttttagtagagatggggtttcaccgcgttagccaggatggtctcgatctcctgacctcatgatccgcccgcctcggcctcctaaagtgctggggttacaggcgtgagccactacacccggcctaggcatcttgaagattaaaaaggaaagaatcagattctctctcctagagcctctagaaggaatagagccctatgtctccttgatattagctcagttagacttctcatctccagaaccataagataataaatttgttagaagccagaaatattgtggcaatttaaccagtagcaattggaaactaatgcaaggggaaaaatgtcttttacgtctctgagtgtgtggtgtcctctgttctcccaaacattccatgttgttataatctggtgccagttttgacaagagatgtaaaccattttctatgagaacttgtaccaggattcttcttaggtagaaaatgtctagagtaaaccctttgattagctcttttccaatgtgtgttggagagttaagggatcaggtctcatagcacctgatagaaagcggagggtttgtttgtttgtgtgtttgttttcatgtttggcaggaaagttagaacacaacctgacaaggaaaaacttagagagattggaatctgagaaggaaagacttagagagactggaagggaaagagaagatgtgaacagggtcaggggaaagcaagatgtgttcctactccaaaatataaagcaaagtcatttacaagttttaaagacttcgagagggttatattttgaagagaaaaccacagaaggggctagtttaagattagggccagcctggcatgagacagaggcagcagggagctgtggattccacactgtttttatggtcccttcttcctatttataggctttgggctcaaccatgggatgaaagtggccacgtagaaggaacatactaaagccagacagacctgggcttcaatcccaagtctgaccatgtgactttgggcatttgctgaccatgtgacttttggcaaaccagtcatgagctctcatagctggttctctcatatgtgaaatggagcactttggaagtcatggggtattgtgagagtttaaccaaatgatgcaccctgaagagtgtatatgtgtgcccataaacatacacacacacacattatatgcacattttatatacccagttttctttaaatgcacccttgagtatcttagaaaaagaggctatggaagatattattaaccatatgtcattttcaaatcaaattctttaatagttattctacaactaacatgtgactcactataggcaatggggtttcatgtacattatttccacaataaaaacttccataaatccattcctgtgtagcactagaaacataaacaagatgacaaatgactataacacctttaaaccagatttcccctgagctccatctgtttagtgtacactattgggttccaaaggccgtggctacaggtctgagttctaaatccattcttcccacacccacagccttcccccaggtctcattctggcctcctgcatgctgggaatacagacccaccatcctgctactctcctgggaatccagcactaactacctggaagctttgcttagtaaacgctccaaatgcaacctctgacagagacctggctgaggcagccagcaacttcccataagaaaaccactgagaagggaggaaacttgcagaaccatgttggtgttgaggaaatgcacagtatcaccaggttttatcttttcaaacggttcctgtctctttcttgacaacaattcatgaccttggaaaagggaggaattaaggagaacaaagggatgtttcatgcttaggatataaaaggagaaatggagataatgaaagagcagaattgaggaactctttggcattgtttgggtttctcttgccatgggcatagcaggacgaaggtgccagggagaatatcacttatcatgtttcctgcccttcatgcctcagactcttacaaacacacacacttctgataatatgtttcttcttctgaagcacagtctgtggcccagccaggatctttctcttaagtgtcttttatagataagttggaataattttagaaacaagtcaaagaaataatagtaatggtttaagtaatgacaagaagtctgaaggttgaagcacttaaggttggtacaacagcttggtgacagctgaaaggccccagattgttactacatttttgctttgcacctgcattatcactggcttttcattcttgttgtaaatgccccatggtctcaagaggattgcggcagctctaagcatcatatcctctcttaactgttacaggaagaaatgcaaagcaaagctcttcactttctgtccttttctgaggtataaccattttcccatgatccctgcccactcctctgacattatcattttggagctgatcacatgtgcccttaatccctgctcccatcctgagctgggagaaactcaccaccctcaccatgtacggcaagacatagttggtgccctatacaccaaaggaagaaggggatgactgctgcatagctgccaagagctttgtcacattttaaatttcgctgtgcttctaagttaagttgtatagggaggagaacgtatgaacacttcgatctgatacagctggaagaagccaggctctgaggatgaaaatgaaatcaaatttctgatttctcatacgacatctttagctttaagaattgcgtaaatgtggcctgtgcatttaagaccaggacaggctttcagttatgggaataaatgaggagagatttggaatagggtcctcaacccaggactaaggtgaagcttgcacaacttgagactgctgggctctggccctgggctgtggaggaagtagctgctctcttgagccatggggctgaggacttgggaggaaccaaaggtcctgcccacagagctgcctggcagggtttcagggaaggaaactgctcatacttctatgggcgctgcaccaagcatagagtccactgccagtgtgaaagtctcagatacacgacccttagggctgggcctgagctcctggagctggctgctctcagctctgtcctcactgattctgcatggctggggccctgctggagtcaaagaaggaggaacagcaaatgtccccagagtctttactcagccaggctctgttctggttagaaagaaaaagaacacatgctaaataaacaaacttaaaattacgtgcataggtatatatttgcaatgtaacccttacaaattaaatatacatataatattttagatataagtaattaacaaacataaaattacatgcataggtatatatttgtaatgtaacccttacatattaaatatacatataatattttagatataaattatatttatacatttggatatactgtgcatctatattaggaataagtataatatgcacacttatatgttaatagatataactttaattgtcagtgtaagatatgatttttaaactttgataaattgagcacaaacatttaaaaccagcaatggttgcaccaccccatggccccttcatcactacacagcctgagggtcaggaagctcaggaccaaacctacatccattctgggctgagcggtacctccctgcccattgctaaggacactgactgtcctgacgggggtctggggaatcacagagcagcaggtgctggggagatgggcagtggttctagaccccaactggagggacttttgtccccagagctcagggtgggcaggtcctcccctggtggcctttgtgagacagagtagcacacatggcccagtggctgtgtggtaacagggagaaaccattccagggaccattggcagcctcccctctgcctggattcagcccacatcaggtagggtttggggatacagccaacgcggtggggaggaaaaggctgggcttccagtctcagagcacagagcacagagggagtttcccacaactcagtgcactggcagctcctcccatgtaatctaggtcataaatgagacctcattttagccctaaaatatccctgttgattttcctagtatttctaagatcaggcttatttctggtgtttactgtggggtttgtctgccatctaatggctggttggtgacatagcatcttataggattttagatgctgagtcccagtcaatcttgacggtgagtcttttcatgggtaatgatgaagcagatcctattacatccatcagtaggccagatcctataaggaacacagaatgacacctctccttgataaaccagtcccaaagttgaggacaagggatatccagaaaagatgttgctcacaaaacgattaggaattaggttctgaaatccatgtgaaatgctgaaaatgtagttttggaagagagaaaaaggggtgtgagagaccctgccgggcataatggcaggggctggagaggaaatccaaggtcctcttttatggatctgtcagcccaggctcattcccgttattctggaaactcttccagagcagatctgaggaccacagtggttgcaccagctggagagcttctgaggactcccagttttccagactaacggctggtgagatttatgctctgagctataacacaatgagggaacacttgtcaacatttagagcggttttaagcaaaataattttctaagacaataaaaatgtctacatttatgctgtacaatagggtagccattagtcatatgtggctactgaacacttgaaatgtagctagtgtaactgagaaaacatgtttttaatttttaattctaattcacattatttgtggctgggcactgcaagtgtttaccaggtgagaggatacagtttcagacaataataatcagcaatgtcatcagggtactcgagctgctgaaagttaaggaagtgtctgccccaggaccaccgtgccaagcaggggtggaccatggccaatgtagacaaagcacatgggtggatctttgaaaccttccctggattcatctgcttctaggctggtgatggaaactctctctctgtcttggagatactgagggagaagctggaatctggggcccacaatgttgccactggaatctgaggtggaaacaaaacacaactcttccccagtgttaatgatgtctcactctacaggcctcccagagactcgtgttggctgatcaagcgggagatgaatgctgggcttgctgagcgatggtctgtatctcagcacgggacataagaaccctgtcacatggagctcccatagctgatgccaggacccaagggccagagccccaggtccagtgcttcctctgcctcaggtgatcccaccctaaaggcagcaaccaacccactgataagggcttgagtggcagggaggggctttgtggagcctgcagacttacaacagggatgcaaaactgaacttccagcttctgagccagggaacatttcatgttatgggtgtgacccaggtcaaggtgtttgatgaaagatattagtataaattttctccttaaaggaataaaatcacagaagacatcttattattatggtactggttggctttttcaatgcacaatggtttacctgaaatctcccagtccctgcccttctcgtgatgatcctatggtctttgctgttcctatggtcacttggctgcctcctcaccgttcagaagcatctccagtatgaccccgagaccttccctggtccgcataaataaatggtctcggcctccagataccacatgccactgcctgaattttatacaatttatcagctattgaaatgattcttttcactttcactgtgtaggtattgttctctgaatggctcatttccctactgaatatcagtacttgggatcaaaaattgtcttatttactcaaatgctcctaaccctcacatgatggctttgaattgttcctgaaaactccgatattatgttaaaatccattaaatgcaaaaatatgtttattttttattgaagaagatatcatggcttcccctcagctaaagacaattaactacttttatagttgaaaaagatccactggacatgaaagaaacacatatataggagtaacaagcatcatcttgaaattagataaactcgattttcatgtaagatgtccagtaggcagaagaaaggccctcacagtgggaggggcttgatggagagggtcagggtgtctgtccctggaaggtgggggagggtgtgatgagtgacctcaggcaagcatccaatatcaggaccagacatgactatgagtaattcctttttccatgggttttgatgcaagaggaaagtcctgatggggaagctttgggaatagtcatagcatgagtggaatacgggttggaaacagcatgtttctaaacacatacaaacagctcacagacattcaaacaaaagtatctcacaaaatgttacctcttcctcaccttttcttgccatttgggtttaaccaatcatggcacacaatttgagtttctctacatgagggtctgcaacttgaaactaccctgtgaaagaactggtgactgtctgcctgataccataatgtagaaatacaatttcttgtagtagatcattgcactttggtgtaaaatatatgtgataaaaaatgtattgaaaaccgatataactttttgtgaccaaatacggtgaaagtcactcacaaaaatatcaccaaatctgatatgtctgttttctcaatgactacattgtatgccaaaaattatttttgaatgagtgacttaatgtgcacaggaaacaaagtaaaacaaataagctgagttgctcttggtattaaaaaattctaggagcaggatactggtcctataatcaagaatggtgaaattttttttttaaaaaaagaaaattcaaactgcagtttggattttggaggtggatgaaagaggacataaacaatacctctgatacacagaaaagaatatttactctcagggtggagggttgcccccctgtatttcatatgtcagggcaagatataacataaaatgcccattgagttttccacctcatctgagctcccagactattttctctgacatgttagtgccttggtacactcaacttttggtgaagttattcttattagggaatcgaggattcttaatttcaacttccttgggcctggaatcttgtcctgctccctagactggcaacaaagggctctggatccttctggttttttattccaggtaaatgttctttttggaaaagtctccttttcaaaatcccaagagaaatgtctatagttacattttccgtggaccagttttcagaaatcgcaacccaaatattcagcatttcctgaattctcagttgaatgccgcactggtgaaagtgaaccttaacgttaatctgacttaacaaacatcatgcttcagggggctgctttggaaatagaattaatttgtcacacccgtgaacccacaataactgaaacctcaatccatgggatcttctgtcactatagctctaggccatcacctgcttgtttcctaatctttacccttttaaactcttttgctataaatgagaaactgtagctctgaagagaaatctaaagtttttaccaacttgtaaaagatagtttatggaaagaaaagggagaggtgaccttcaacaactgtccatgtagtttgaaagtaaatatgggtaaagacgaaagtatgtcattatggtcttaatttgcattttcctgataattagtgatgtggagcatttttctatgtatttgttggcggtttgtatatcttcttttgagaattgtctgttcatattctttgcccactttttggtgggattatttgtttttttcttactgatttgtttgagttcctcatagattctggttattccttcaacagatgcacagtttgtgaatattttctcccactttgtgggttgtctgtttgctatgtagaagctttttagcttagttaggttccatttatttattttttgtttttgtggcatttccttttggggtcttagtcatgaattctttcactaagccaaggtctagaggagtttttccaatgttatcttctagaatttatatggtttcagttcttagatttaagcctttgattcatcttgagctgattttcgtataaggtgagatatgaagatccagttttattcttctacctgtggcttgccagtttttccagtaccaattattgaatagggtgtcctttccccactgtttgttattgtatgctttgttgaagatcagttggttataagcatttgggtttatttctgtgttctctattgtgttccattgatctatgtgcctatttttatactagaaccatgctgttttggtaaccatagccttgaaataccaccttactcatgcaagaatggccataattaaaatgtcaaaaaataatagatattggcatggatgtggtgaagagggaacacttttacacagctggtgggaatgtaaactaatacaaccactatgaaaaacagtatggagattccttaaagaactaaaagtagaaataccattcagttcagcaattccagtacttatttttcttatctacccaaagaaaaaaaaagttagtataggaaaaagaaacatgcacatgcatgtttagtccagcacatttctccatttcaaaaatatggaaccaccataagtgccaatcaagcaacgggtggataaagaaaatgtggtgtatatacaccacgaaatacttctcagccataaaacagaacagaacaaaataatgacctttgcagcaacatggatgaagctggaggctattattctaaatgaagtaactcaggaatggaaaacctatatgttttcatctgtaagtgggagctaagctatgaggatgcaaaggcgtaagaatgatataatggactttggggactggggaggaaggatagaaggggaggtgaaggctagaagacaacatattgggcacagtatgcactgctcaagtaacaggtccaccaaaatctcagacatcaccactaaagaacttatccatgtaaataaaaaccacctatacccccaaaaactattgaaataaatcatttttaaaaagatgaaagtatgcagcagtgactctagtttcctctctgctgggtgagccagacttcattgtattggttaactcattgcccccaaagcacctgcaacaatcagaagtattctagggtatcacccagtttctccgttcagccaggctgaactagtttttgttctgggttgtaacacagtgtgaggtaaactactactctgatgacagtaatacgctgcagcatcttcagcttccaggctattgatggtgagggtgaaatctgtcccagatccactgccactgaacctcgaggggacccctgagatggactgggaagcatacttgatgaggagctttggagactgatctggtttctgctggtaccagtgtaagctactaccaatgctctgactggcccggcaggtgatggtgactttctcctttggagtcacagactgaaagtctggagactgagtcagcacaatttcacccctggaggctgaaaatatacagcaaacatcagtacaacataaatatctgtgtatgaaaatcacctttaatcttgctagacatgaagaaagaatatgcattacatttttaaaattaggattttaaaatcaagccaaaaatcacctattgcagagtccccaatgaaagaaattacagattgaaagaatatctccgcctaggtttgtggaaatattctcacctggaacccagagcagcagaaacccaatgagttgtgatggcgacatcttcctgccttgacttgtcagttttgctcatgccacatcccagagaaagaacctcttttaagataccgagaggcagggcctcttcacatataggaggaacgatacatgcaaattatggggatgtcctgctggtttaaataaacagaaatcactgttgccaggagagcgccctcccggccccttccatgaggggtgtgaagcgccctctgctggcacctgcagacgagctccgctgaggctctggcagggcttgaccagaccccagggcacagctgcagagtgaaggcagagtccatcgccatctctgggagagtctgcagttatctggggtgaataacagctcacatcctcagtctcgtcccaggactatgttaactctcctgctctctgtcacaatgtaggctgaaaaagctttgtgaacgttccacaaagcatcaacactatattgatgacatcatggtaattagacgtgatgagctggacattgtaagaactctgaatttcttgtgaaaacacatgtgctctagagggtgggatgcacgccccaaaacatcaagggcttgtcacattagagaagatgtcaagtgtttataaaaggggtatgagtcatgctggcttatcccctccaaagtaaggaaaaataattgcaccttgtacttccaaccactagcaatgaagcacattactggttaagccatcctagagtgttgacaatgcattttgcacttgggtttactataccatcccatttatcagctaacttggaaggctgtcttttatgaataaactctgagaaagaaaatattctgtagtaagtttgagttttaatgcaaatgcctctgtcacttcagccatgagatccagcacattgcctggtgctagataatctatattagatgaggaaactctgtaaacctccatgcaagcaccaaaaaagagtcacagaaaaaaatctctacagttcttgagcaagatcctgaaatgcccccaaaataaacaaacaaacaacacacaaacaactcactactcaaaatgcagctctcaaaatatcacagggtccatgtaggcatgtccatgagtagttgactgtttgactaaataattaagtgactaagctgcccctcataaactgagaatgtcactctcaccaattttaagatcaggtgaagctcagcaccattcaatattgggatgcagatggtagtttagtgactgggttcaagcagattcagaaggcatgcttcatttccatcacagatgttccagttccttatatcacttttctctctcaacttaacacctctgcatcagctctctctatgatatcatgggttttcctgatcagctaatgccagagagataatacaaaaaaagaaaaagaaaaaaaagaaaataagcaaaaacaaagaaaatcaaagcaaaaatgagaacaagctgggcttcctcttgaatggcttggcatcatatgtttgtgtaagtaagtgtggactgtgtccacactatggcaacggtcatgcatggctgtcaaatactaccttgagttatcttacatctgagcagagcacatgttcatcaaattagtgtagatagagaagtgtctggagtcaagtatacatatagatttctgaatagctggctggctaaggtcctggaaaagaagatcatagcaatgggtttttcccaaatgtgtgaaactcataaacctattcatctgtgtgtgttctgaaaagtgtatacaaaatgtagccagttcttatctccctctgttttacttttcactgcaccccctttgatccctgttattcataacggcagcttttaagtcaccagaaatctgtgcagacattattttagcaattctatcattccatcacttccaggagtccactagtaactttcagctggtgtaccacttgccccagctagagccctcagtttgaactagcttgctctgttcatttcctgcagaattcatcacatttagctggaaacactgaaggatcttgcttgactctccacctcaactcaagtccactcccttcgactgcaagctgcaagctgacatcctcattaaaaccccagatctgcaattcatgctgacagagcggagatggaagggagaaatcccaggcaaaaggctacagacataatttccttccttactcaaaacatattctttcatgttatgaatagtatacagtattaaatgttttatactttgccaattttcagagcgctgaaaccgatttgatattttttagctttatgcttaatttgtctttctcatatatttttgctgagaggatttaacaatctctctgtaacacaataaagagagatgccttctaaaatgaattttaatgaatatgacagcaacactgaaaggacatagatatatgttaaaacataagtaattctgaagtaaagaatttgaactcaatacccacggtttgaagagaaatcgtgcacttaacaaatattaactcttggctggggacggtggctcatgactgtaatgccagcactttgggaggttgaggtgggcagatcacctgaggtcaggagtttgagaccagcctggccaacatggtgaaaccccatctctactaaaaatacaaaaaattagccaggcttggtgacgcacacctgtagtcccagctactcagggggctgagataggaaaatcgcctgaacctgggaggcggaggctgcagtgagccgagatcgcaccactgcactccagcctgggcaacagagtgagactctgtcaaagtaaagtaaaataaaataaataaaataaaataataaaataaaataaaataaaataaaataaaataaaataaaataaaaatatatatgtaactctaatcactagatttcacattttcagggaatgcactacaaatctgtaaaatatgccttatgcatattctagaattgaccaagtaagtgaatattctctacataatgggagccaggattgtctttaacagatgattgaaacacaaatatgaaaacatgatgaatcttgtgaaattgtttcataagaatccatgtcctttgttatgttttaattatttttatttatatattttaataacattgaaatgtttttagacttaaaatttgcataatataataagattgttctcatgtactcttccactagcttcttctgtaatgtcaacatcaagcgtaactatagggtaagtatcaataccaaaacattaacataaatgcaatgctattaattaagtaatttgaaatcccctcgtatttcactgattttttcagtaatctccttctttatgttccagaaaaaaaatccaaaatcccacactgcatttaattattgtgtccttaatatttcccaaattgtgacagttttttagttttgtctttcatgattttgaaacctttgaagtgtactggcaagttattttggagaatctcttaagttgcatttgtttgaagtcttctactgattagattcataccttttatttttagcaaaaaaacaaaaacaaaaaaaatggggtgcaacctcagtgcacagcaagaattacaaaatgtcaacatatcctattaatggtgatcaattaatatgaacaataaaaccctttttttaaaaaaaatgttttattatactttaagttctgggatacatgggcagaacgtgcaggtttgttacataggtgtacacatgccatggtggtttgctacacacatcaacttgtcatctacattaggtatttctcccaatgctactgttcccctagccccccaccccccaacaggccctggggtataacattctcctccctgtgtccatttgttctcactgatcaactcccacttatgaatgagaacacgcggtgtttggttctgcgttcttgtgttagtttgctgagaatgatggcttccagcttcatccatgtccctacaaaagacataaactcatcctttttatggctgcatagtattccatggtgtatatgtgccacattttctttatccagtctctcattgatgggcatttgggttggttccaagtcattgctattgtaaacagtgccgcaataaacatatgtgtgcatgcatctttatagtagaatgatttataatcctttggctatatacctagtaatgggattgctgggtcaaatggtatttccggttctagatccttgaggaatcgccacactgtcttccacaatggttggactaatttacactcccaccaacagtgtaaaagcattcctatttctccacatcctctccagcatctgtctgaggcctctgttctgttccatttgtctatatatctgttttggtaccagtaccatgctgttttggttactgtagccttgtaatatagtttgaagtcaggtagcgtgatgcctccagctttgttctttctgtctagattgtcttggctatgtgggctcttttttagttccatatgaaatttaaagtagttttttctaattctgtgaagaaagtcaatggtagcttgatgggggtggcattgaatctataaattaccttgtgcagtatggccattttcacgatattgattcttcttatccatgagcatggaatgtttttccatttgtttctgtcctctcttatttccttgagcagtggtttgtagttctccttgaagagatccttcacatcccttgtaagctgtattcctaagttttttattctctttgtagcaattgtgaatgggagttcatgcatgatttggctctctgtttgtctattattgatatataggaatgcttgtgatttttgcacattgatcttgtatcctgagactttgctgaagttgcttatcagcttaaggagatttggggctgagaccatggggttttctaagtatacaatcatgtaatctgcaaaaagagacaatttgacttcctctcttcctatttgaatatgctttatttccttctcttgcctgattgcccttcccagaacttccaatactatattgaataggagtggtgagagagggcatccttgtcttgtgccggtatttgacaagaatatgtccagttttgcccattcaatatgatcttggccgtgggtttgtcatgaatagctcttattattttgagatacattccatcaatacctagattattgagagtttttagcatgaagaggtattgaattttatcaaagaccctttctgcatctattgagataatcatgtggtttttgtcattggttctgtttgtgtgatggattacatttattgatttgcatatgttaagccagccttgcatcccagggatgaagccaacttgatcatgggtggataagctttttgatgtgctgctggattcggtttgccagtattttatagaggatttttgcatcaatgtttatcatgaatattggcctgaaattttcttttttgtgtgtgtctttgccaggttttgttatcagggtgatgctggcctcataaaacaagttagggagtattctttctttttctattgtgtggaatattttcagaaggaatggtaccagcttctttttctaccggtagaattcggctgtgaatccatctggccctggacttttttttggttggtaggctattaattactgcctcaatttcagactttgttgttggtctactcagggattcaaatttttcctggtttagacttgggagggtgtatgtgtcgaggaatttatccatttattctagattttctagtttatttgtttagaggtgtttatagtattctctgatggtagtttgtatttctgtgggatcagtggtgatacctcctttatcattttttatgtgtttatttcattcttctctcttttcttctttattagtctggctagtggtttatctattttgttgctcttttcaaaaaaaacagctcctggattcattgattttttttgaagagtttttcgtgtctctatctccttcagttctgctctgatcttagttatttcttgtcttctgctagcttttgaatttgtttgctcttgcttctccagttattttaattgtgatgtaagggtgtcgattttagatgtttcctgctttctcccgtgagcatttagtgctataaatttccctttaaacactgcttttgctgtgtcccaaagattctggtttctgaaaggaggtcttggacaaagctaattaagccagctgcttctatcactctttgtatttggttatttgctgactttctgagaaataacctattcctgtctgaaactatttttttttatgtttcttaggctttaaccctcttcacacttactgtacaatagagaatattgaacaaataaatgagttggcttttaaatggcaaatgttactatgatggccatttaccatttaaatgttaatagcctgaaaaaaaacccagaggaatgagatttattaaaatgtagtggtaccaacaaatgaacagcagttactgaatcaactgtttggaaaaacataattttctagcacttggaatactgcaagaatcaaatggataggaacagcttgccctgagctacttctgctgaggagactgagataccatttgtaccattttagtatgcacacagttcagacactctttgtggaaataagaggttctggtccctcagttaaagaacatgtggctacatatgcatgacagttatttctagaaatatgtacttctccaaatttttaagttattatctgaaaatttaatagaattttgtctttggatggtaatgaaacaaaaatgttagaagagaatggaaacttttgggtatatatagagaggatatcagagaagggtcaaccatactttactggatacagttaatctgactggggcttttggaggaaaagatttagagaagaaaagtgtttgaagaagtcatacgtgtttaaaaatataggcacaacttgaaaacccttgcaagaaagaatagatgacttcacaaaaaggtgaagtgacttttcaatttgtcaaatcacactcatacatatgctttttctttctcttttatgccctatacctctgaggtattagaaaggcctgagtttgaaataatttgtcccgtagaaatccagaaagtaagagaatgaacaacatctttagcacagaagcatgccaatcctgggaaaaacctgagatttggtttttgagttatggcagatgtagtagaaaaaatgagaaaaggttaaaaagacagaataaagattatgtaagaaaggacagcaatatgacattctaacctttcataggataaagttatgataatgaatgatgagaagaaatgcaatggacccatctgggtgggcatgattgaaagtctgagcaagttagtatagatcaagaacaaatcattagcattttaagaattgtgagtcagtcagtgaaaatcccatctcagaaactaatgtggctatagatgaaacatccttggattagaattaagattgtttctcctaactctcttctaaattagtctagtgatgataataatgattattacagtgctaaatgttatcataatagtaacaacaaaattaataccagcacatataatgattagatactattgtaaatgctttaccttgtataaattgtaaagagaccttttaggtagattctattattgccaaagtttcacataagcaaatttactaatggcacataatctataaggattaaagctctgtctccaacacaatggatttgatttcagggcttgccaagataacgtcttgacagttagataaatattgttgactctatttccagaatgaatgaagatccaattgaaacttagagcagcattagtaaaactgcttccttgatacctaagagaaaggaagaaaaagcaaacgattttaactgattaaaggaaaggagcagcagtatatgaaatgagattcagggggtgtaagcagaggttctgggaactattaaggagaagagaacctgactctggattgatataagcattgcacagaatcaagcggtgtgtagattagaggatcacccaaggagttgtcccctgcctatatggacagcatcattgtctgttacctgcatggacagcatgattgtctgtcttcagggaaatggcattggtaacctgaagggtcagaacctgggtgcttctcatctgtgcagttgtggtcacccctgcacctgcagcactgtgggtacttgagtgttgctctttgaggaagcttcagggccctcagaaaagatccctaagcagcaagtgaaaggtgtacttgggagataaagttccaataactcttcattccaaccatattctgtcatgcaccagggaaaacaactaggcatatttagggtagaaacaaaagaaatgggaccacacaacttaatttagttcctacaagtcttgtaccacacaccattcactgaatctagataattggtgagacaggaagacacagggatataagacaggaagacacatgatatatgtgatctaagatagaaattctacactcaggctaaactaacagccttttctgacatgaccacctgggtgaaagctgaccaatataatattcacacatccagtcatatagatagatgcatgttatcaaatctgatagcataaatataaatatttagtcatccatttataaagacacttagaggaaattaaagctaaatgatatgaattaagtgaaattcacctcacttatggaaaaagtgcacttacggaaacatgcacttatccactgctcaaaactcagcggataataaaactaagcagatattttcttgttaatagatgtttatgataacaatgatgtggctgatcaaggaagagcttagtggagtggttcttctgcctttagattgtgtttcatttgggatcaaggaagggcctagccaagacacaacatttgtatggaaggcagcaaaaaggaacacaattttcaaacaaaactgaccaggcaaatggtatcctaatgttctctaaaacagtgaacacaatttaatttattcttttactttgttaagtcctaaagtttctaaaaacgtttactgcatttaactatcaaagtatttgatccattgataaaaaataattgtttttcaacttttagaatattaaaaatatttttgaatgtaattttgcattaattagaaataaagcagcatatatttttaagtggttttaacataaatggtctcactgtgggggaaaaaaaaatctttagctaaagtaaatgtcttctaaaacttggcttcttgaaacacccgtacgttacctcttaactagttgaagtgcaggttatcatgcaacaaggtctaaagcacatctgctactttgcatttgtactgtgttcatagtgacgctgagaatgccactggaatctggacaaattttaagtagcaaagtgctcttatattaaggaaaaagtatgctacatgcacctataggtgttcttgtttgttttgtcaatttttttttcatttgtcaaaggattgctatgtatttcaagcaatgttgtcatttttttcttttactttacgacttaataaaattttcttgcaataataccaaactttctaataatacatgtaagaacatccaaatgtattctgaagccaccccatacctggaaaattctgagattttgggaaatacttatcccacttggctgtaattcctcatattcaccatgatttctaaaagcacctttcctgaaacccattaaaccctctatggtttcttgtagagttactcaaagagaagacctctcatcatatttgaaggtaagaagaaggcgattcaatattctttgacaccggtaggcaaacatgttcactgagataaggactggagaatcacctggtgaggtgctgcaacaactgatagcatcagcatcttcgcatacggacttcctagacaaagaagactatatggttagatagcccatgcctttagcggctgatgaactctggcttctggcagacctccagagactcccgtgtttctagtgtcagcttccctaactaccacactcccagttttgtatattcaactctaattccctgtattaaaacaatgccttctggcaatctgtagagtggtttctcttttaatctatgacccagatggatgcaataacacagattcttcaggtattgtaaatgctatcctttattaaatcaggagagatagtgtcatgtctgtgctgctggggctaagcaggaagaaaaagaattagaatgcagatgagacttctgaccattcctacaaaaacctttaaatcttggctgcacctgagaaacactctcagcagatggaggcaccagtggaagcacctggggcagccatgagtcatacttctgcttccctgggggtttattttatgacctgtaacactctaggatggctgctgtaagtctatagacagtaataagttataacatcttcaggttgcaggctcctgatggtgagaatgtgtgaaatgtgtcccagacctactgccactgaaccgtgacgggaccccagattgcaaactggatgcagcatagatcaggagcttaggaggattctctagtttctactgatactagcttaaataattgcaaatgccctgactcgcccagcaagtgatggtgactctctctcctacagatgcagtcagggaggatggagactgagtcatctggaaatcacatctgactcctgggacataaaaacaaataatccacacaactatttgtaagatgatttccctgaaaggccaggctgtactgagcacattggctgagtaaattcctagtgttctccatccttacctgggagccggagcagcaggagcccctggagctgagtggggaccctcatgtccatgctgtgtcctgactgagactgactcctgcacagggtgtgaccagcctattaagaagtcttcagaacagggggttgtgctctgggaacatgcaaatcagcagggaatggagcaggctgggcacagctgcaggactggttcatggataagtatcttagatccagataaaacttaataaatattcatactcttatttttcacattttcagcttggcccaggacatcccagcctagctcagtagcaagaatgtgaatcgtttttctttttactcccataagaacagtaacataaaaccctgtgaatgctccagtcctggaggagaatgtgtgccgagaacaagtgtaaagtacaactggggtaagggagataagcaatgtgttaacaccaccaaatattctcccattaaatatatactagtaactgctaagccaaacaataccaagaatataccagtgctatgttgtcatgtatcagcctcagttgtgtgactggtaggctgaatacatctggttgacaaatgtatgcaaaggagagaggattgagatgagctaagtcacctttcccttcctccttcctcctgtctcctggctcagagggcacttgcatcttctgtaggttctgcccatgctaaggctgcgactgctgaagtgatcttatgtgtgatgcctgaggtgtagcttcatactaatcccctgagttcaccaacatcttcctgttacatagatttagagaatataccctgtctactcctcagtgaaggaactaatttgggcagctgggacaatccaagcaggaggcttttgtttggtgctgaaccattgtgggaggatattgtagagtgtggtggcagttgtaatagccaagatcctcagcctccaccctactgatcttaagcataaaatctgtccctgacctgcaaccactgcaaactcacggttatgtggtgcgtcacacagggccgtaagtcttcagtgactcaattgttagtgaagttcttgtccaaatgtatttcaggtcgtatcacaaatgcctatttaaccataggatatagaccagcttccaaaggttgaaactagtcctgtgatatatctggggatgactggtctactctctcctcccattggggagaacctgtgtgggaaggcagaaaactgattggaagtcctacagatcaggagctgtggagagtggcctggcttctgcaggaactaatacaaataggtgtatccattaccatgtaaaaggttctgactagacctgcaggagatggaggccggctctccattggtgacgggcagagagagtggagtctgggtcatcacaatattcccacaggatcctaaagtaatataaaaaagaagtacaatgttatgtaaatcatgagacattatcataatttctctacaattatttaatgctaaataattgtattgcggcgtgtgtgtgtgtgtgtgtgtgtgtgagtgtgtgtgtaattttgattcatgcaccaaaaaaattcaattaaaaaaaaaaacagacattttgaaggcccaagttgccctatggaagtcacttatgctaccctcctctttctatgtcagaatctgcaccagagcacaggtctttgctttttctggaatcttcctcactctttcacatataaaagtgccaccatacattttatcctggagcacaagacacgtgcatctaacatgtggacggaacacacatgggtgacagtggggcccccagagctcaccctcccaccccattctcctccctcatctcctctgtccttaccaggaacccaaagcattagcagccccaggagctgagcagggaacctcactgtgagaaggtgaactgaggagtcctgatcagttaaggcaaggttacagctgagcttttctcccagactcacaagggaagttcattcctaagggacaatatgcacatcccctggtggttgcagtggtgtggaaagagccaatgtacagtatgcttaattctaaaatgtatctttgtcttcagtattttaacatgccgcatcatggcctgaaacaagcaaacaaaataaaccagtagacaaaactagttactacctactacacatatatactaagtgtttctaagagttcaaaaaatattctcaattacttccagaattgaaaggaagaaaagtccaaatagtattatcagaaaatattattatgtggtgtacatgtttgagactcctgtgagctttgatttgctcaacagccaacatcatgcattgcaggcagctttccattctcctgatggttggtgagagtgagagtcactcagcaaagggagaaagaggtgccctgaaagtcatcagtggcagcaggtgaggtcaggatacactagggtcgcctcccagtgatgtgactaagtgtccctgcattcatgacagcagtagggaactttagtggctgttgcagggaggacatgacaaccacttcctggagagtctgtagggtgtcagcgcactaattggagagaaagggagaggctctaggaattgtcctggagggctctagcccctgtttacacagaagaggagccagtgtttgtgactgaaacctcatggcctcttcctggaaggctctccagccatctctaactgagcccacctggtatggacgtgtggcctgggtaccccagctgctcctgctgcattgagaggctgagcctccttgaggtttgtatgtggggccatcacacaacgcagcgtcccagtgagtgtcttgctaacagtcgtatgtgcagtatctccaggccccacagaagtgattgtgagtatgtaatcattaaaattttgactgcatgtgtgtctccacttttgaatatgtgcagaaaaatactttgaaggattgtcattctttgcctatgttacaaacgtcttgccataatccatttttttctggatttctctcctcaaaaattggattttaacttccctcaccacagaatgcattatcttggaatatacagtcatttctaatatggtttacttccttaacaaggaaaagagtatgttgtcctgctgattcaaatgcccctttactttgatcatatcatgtcatgattagtttagaaatacttttagggcattattttaagtgtcatctatgcaagctatatattttctatacaattactactagaaggtaggaatgaggttcattttcatgtaatgactacattgtgtgaaaacgatgcatgtacttatatattgaaaaccatttattcttttcatgacaattgaataccaaaattgtcatttctaaaacattatttagttgaaaaagttatctccactcccaggtacaataacattgtggttaaaagccctaaagcaactgctgcaaaaggtacaaaaaatacaaaatttatgaaattataacatcagagaacagtggacagaataaggcctaggtaatctaaaattccagggtgaggaaatcctctctaattgagctgatgcttacctgactttttgttctcctgccatatttgccaggttggcatttggacccaagttctgctttggcacaggcagagaaactcatctgtgaaaggagaatctggctgtgcctctttggttgcacaatgcagcctcaactcacagatagtgttctccatggaacattggctgtggtttgatgacatgtgcagtctttgggtgctggtctagaaagacagaaactccccatacagaggattcatggagtttttgttgttgataaattctgcgcagaccattcataatacatgtctgaatcatggatatattggtcatcattgccactgctccccaattgatgtaggctctattgggacttcaggttagcatgccactgcatgatttgtgttctcaaacccaaccacatggcatctgctgggttgttttagtttgactgtgactaagtcacagaacctcaggtctatttgcacaggaacttcaataaacatttgatgattgcagaactaaaagatcattcttgatgaactacttttccttgaaacttgcagtggtgcaggctcaacccatggagccagggagtgatactttctcctctgtgattcttcataagaaagacatttgggctcctttctgagtttatatcaccaacccccaacagtcactgtcatccacaactgtacctaatgtaagtcaaagagcaggttattgggccatagttgacctccactatcttccattaattctcccattcttgaagtcggcccactgtcttcaaactcttacattttggggaaagaaatcgcacatcattctgtgttatttcagtgttctatgaggtaaattctataacctatgtcttctagtttaagtttctgtttatgaaactcaacttctgaaatttcaaaaactatccttttctgtcagcaagacacaattgaagcgaataaaataattttagcattcatattttctatctctcaccaatttacaaaagtccattctgaggctgaaatccaagattttcactaattgccctcatccagctcctcatgatgacagcttgtgcggaaggctctttccaccatcaatatgtggtgggaagataggtggtgaaagagaaaaataagaagttaggaaagttgaaaagttcaattttgggatattaccacatattatcctcctaaatatagactttaaactgctaaacctcaagatatattcaagtgttgcaacaaatctgggttacttgtctggttatttacctctttaagtcttatttcccaatgcaggcaaggcagggaagattggaataggattttcttaagctctccctcagggcagtctattacctgtgcaggcactgggatcacctctggtttcctatggcttatgccatgccaaggctgttgcagctgacagggctgtgaacaggttttgcctgacgtacaactgaggcacccatgggacagaaccctcagatgcaacctgttgccctgagttctccaacatgtttatctcatacagatagagattctgttcaactgctccccagagaaacaacacacttgagcagctgggccactccagcgggaggtttttgttcagggctgtaccactgtgtgaggaaattgtgtagcttgcgtgcagtaataaaccccgacatcctcagcttccaccctgctgattttcagtgtgaaatctgtccctgccccactgccactgaatctgtctgggaccccagagaaccggttagaaaccttataaattaggagtcttggaggctggcctggcctctgctgaagccaactcaagtaggtgtttccatcactgtgtacgaggctttgactagacctgaaggagatggaggccggctgtccaagggtgacaggcgaggagagtggagtctgggtcatcacaatatccccactggatcctgaaataatgagagagaagtgcaaggttatgtagaaactttaagcacaattttaaaataatttttcttctgttatttatttcaggctaaatcaatttttataatttgattcagaccctagtaatatataatttcaaaataaaaacatattttcaaagcacagcagagtgctttgagtgctagaagtttcctctaccattccctctttctctgttagagtcttcaccggagcactggtctttgttccttctggaatcttcctcattcttacagatctaaacctcacatgccttactcacgcagatataaaagttacaagccccatcctggagtacaagacgtacacatctaacatgaggacagaacacacatgggaggcaatggggcccccagagttcaccctcccaccccattctcctccctcatctctcttctgtcctcaccagggacccagagcattagcagccccagaagctgagcaaggagcctcattgtgagaaggtgacctgaggagtcctaattagtcaagtcaaggttggtgctgagcttttatctcagacttgcaagggaaggtcctccctgggggacaatatgcaaatcccctggtgggtgcagtggtatagaaataacatgatatgtgcaggggtatgggggcctttcctatgaacaacatattttgtatgcttgagaaaaaactggcagaaataacaatctatgcagcctgattgggacaggatatatttctatgtttactgtgtttactgtcaatttttttacttcctagtattttcccagtgcttgttacacttctctttaatacggctgagtttctgtaaatatttggtgcttcttatttttttcttcatgtgtgttgaaagggtcttggtttgctgttaattttataaatcaaaataaattgtgccctgagtaaagtgcaaacatgttcactgctcaaccaaataaagtactcacattcactacccagatacaaatatgaatgatttgaaattctccacatgctgccttcattcacctttctagtcaatagcttctgcctctaacctaccaagggaactgcaactctgatatctatcacaaagattcagttttcgtgaacatcaacaacatatgagttgaggtaagtatatttatgaagctttcatttaatttcatggatttaaattactgttcattgtcatttactgtgattctgaattctgaaggatttcttcctgagtttcttataggacatatatgctagtcacggcttcttttcttttctttaaggatagttttgctgaatataaaatcattttaaactgatttttctagtacttcaaatagctttaacattaatggttaatccactattattaacgaagttacaatctacatttgaatttcactgagctttccactgatacatgtatttaccatttttacttttaatgttttaggataaaatttctggatcccatattgcattcagttttcatgctttcttaatttccttcaatctctgacagctttttagtctttgttttgaaataccttgaaacttttgatttatgctggctggttatttttcagaatgtcccttaagttctattgtttggtattttctattgattaaagtcagatttttcatttttggcaagaatattacagcagggatgtgtcttcagtacatcctatcaagagttacacagtatcaacatgtcatcactggtgttgataaatgaatattgctaaggaaccctttttgtaagaaagtcttggtcaaaggtaaccaaggcagctgcttttgtcactcctcctatatggttatgtgctgactttgttaggaattgtctagtcccatctgctatggtttagatgtttgtgatgttccaaacttaatgttggaatttaaagcctaagttgatattaaaaggtagaaccccttgggaagtgattaagtcatgggctctgcccttaataaatgggattaatggccttatatagaagatttcagagagctgcctggcccttccatctctgttgccatgtgcagatgcaagattcaatttgtctcctttgccttttctggctccaccagacagcttcaccgacactgaatctgttagcatcttgatcctagagttctgaactccagaactgtgagaaataaatatttattgtttataaatttcccagtctgtgagtttgttatagttgcatgaaagaactcagacactatctgattctctttttacttatttatttttttcagaattcagttctacttaaagcctgctctccaatagagaatactgattaaataaattatgctcactcttaaatgtcaaatatttccatcatggccattcaacactggaatgttgatgacgtgaaggaaggaagagaggactggtgtctattaaaacatagtggtacccaccagtggatggatgttcctgagtaatttggacaaatatatagtcctacgcatcacttagaatatttcagaaactaaatgaaaaagtttagaattgattgagctacttctaaagtgggaggttgagatgctattggtgccatactaggatgcacacagttgagacatgatttccaagaatctgaaatcctagggactaagttgaagaatatgtggctatatcaacatggtacttatttctcaaaatagatatttttctaagtttttaattcctgctgtgactaatcaatgggattttgtcttttgattgttgtgaaagtagataacttgttttgatttcagagacttatcagtggaagaatatgagtatcagatgtggctttaaacttggacttgggacttttgtgttaaaattacaataaggtaagactttgggcagatatggaaaaggaattattgtattttgaaatgtgaaaaggacatgagatttgagagagcccaggggtaaaaggatgttgtttgcatatttgttactgctcaaatatcatgtggaattgtaatccccagtattgcaagtcaggcctgatgggaggtgactggatcatggagatagatttctcatgaacagtttagcaccatcttcttggtgctgttctcatgatagcgagttctcatgagatctgcttatttaaaagcatatggcaactccttctctctcttctgctctttctctggccttgtgatgggcctactaccccttagccttccatcataactgtaagcttcctgaggccttcccagaagctgagcagatgccagcatcatgcttcctacaaagcctgcagaaatgtgagctgagtaaaactcttttctttataaatcaccagtctcagtatttctttgtagcactgcaagaatggcctaatagatttggtctcttttttttttttctttttttgagatggagtttcgctctgtcaccaggctggagtgcagtggtgcaatcttggctcactgcaacctctgcctcctgggttcaagtgattctcctgcctcagcctcctgagtagctggaactacaggcgtgtgccaccatacccagctaatttttctatttttagtagagacggggtttcaccatgttggccaggatggtctcaatctcttgacctcgtgatccacctgcctccacctcccaaagtactgggattgcagaaatgagccaccgagcccaatctctcctttttttttttttttttaataaagacactaattgaatcagatcagaatctcaaccttatggcctcatttgactgttagtttcttagagctacctccaaatatactcgcacatggagttagggcttcaactggtgaattttgaggggacacaaatattcagttcataaaagcttaccttattttcttgattcatcaaatacttgctctcttggcatattttgtggtcacccacggaggtgagatggatcttttctaattagtagatattatggtgaagctgttgacactccatgtacaagagaatttgggagaaattttctaactcacacaagggaatctgggggaaagcaggatatgcacaagctggtataagctggctcgagttacacagagggctgagtttttatagttggactggagatatgctatcttgcattgctgaggatctatgaggtttgactgtcctgcaggcagttgcacaaatatgtggtggaagggaaagtgggaggtggtgattgaaagctgtcactgatcaaacatcaaaaatggagtcagatgcttattacatagcacttattcgaaggtacatggtaccttagagtatcagctttttatattttgtccagctttttatatctgtttttagcagcttggcatgaaataaatttatctgctatttaacatagtgggagttttaggggaaaaatcataattttgtaaataacgtcaaagaaaacagtatttggggaaacactggatctacataattaagagatgtagcaaaattataatgattattagtaattatttagtgtttaatacatttgaaagttataaacattttataagtattcaattacttaattattataatagtcttatggtatagttacttctttattttcctttattagagataaaaaaacaaggtaaaagtgtttaagtcatttgccaaatttacacatatattaagtgtaagagacaaaattccaaccaatgatatgtgattacaatctgtgtgttctgttatcacagaaactaatatttcaaaatctctttcactgagctttctacctgatttcatcaattatgtatgagtaacttgaacaagataacactgctggatcattgcactgcctttgctcagtttcgtcacatgagagaggcaagatttgatgttgttgacagtaacagtaccctgcatcttcaggcttcaggctgctgattgtgggagcaaaatctacctcagactcgtggtcactcaaccatgcagagacactagggttctggatagtggcttgcttccctcaacctttgtccagaacttgaaaattgagaactcatgaacacaaataagggaacaatacacactggggtctacctgagggtggagggtggaagaaaggaaaggagcagaaaagataactattgggcactgggaataatacctgggtgacaaagtaatctgtacaaggaacccccatggcacaagttcagttatgtaacaaaacttcacatatatccctgaacctaaaacaaaagttaaaaaaataaaaataaataaaactgaggcggcacaatattctcattgacatctgaatttttttgaaaaaatcacataagcacaaatgtcagtgaggttaaacacatcccactctatgagcttatcatgttactcaacactgtgagtgctccatgagaaatcaaatgtcacagaccaaaaaaggtactaaagattcaacttacaatgagaagaaagcaaatttcaccatcatgtggcacctcctcataatccttttcctcatctgggatcaggcagcaggagacagaagagttgagctccttatgtccattatgtacatggctgaggcagacacctgccctgagccagggaacagcccactaataacggctttgatatgtagccaaatgctctatggaaagcacacaaagtcatcccaggctgtgatattttggagcttcttgttccagaacagattatttcacagctgtcacacacacacggatgctccttccccagtgtcttcagtctgtagagggactatgtggaacccctcgcttaataatactccaaatcaccacaacatttcctcagtcctcagctgcagctggtcttgttctgatgatgactaatgcaagtgaccacaagcatgttatatgaaccttataagaccatggtcatcataaataataatcactgatacagctattaattcaagtggcttgaatacagagtcattttcttggtatgaacctaacctgggaatgttccatacaaaatggatcaagattatgaggtcagttaccatactaacagaatttggggatttagagttgagggaagcaaagcaaaagaagaatgtggagaattttatacaaaagccataccgactataactgaaaataaaaaatccatgccttacagtgtaaattcaagaaaaaaaattcataataaagtgaaaacacaaagaattaatgaagaaagtttacattaaactgcctcaaaggataatgagagttttgatcaacatagaagacactgctaaaaactcattatttgttgtttgatttgatgaagttgcttgaagggataaaaagtacagtttgagtgaactcccattcacaattgctacaaagagaataaaatacctaggaatccagcttacaagagatgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgtcatccccatcaagctaccattgactttcttcacagaattagaaaaaactactttaaagttcatatggaaccaaaaaagagcccgcattgccaagtcaatcctaagccaaaagaacaacgctggaggcatcacactacctgacttcaaactatactacaaggctacaataaccaaaacagcatggtactggtaccaaaacagagatacaaaccaatggaacagaacagagacctcagaaatagtgccacatatctacaaccatcagatctttgacaaacctgacaaaaacaaatggggaaaggattccctatttaataaatggtgctgggaaaactggctagccatatgtagaaagctgaaactggatccctttcttacaccttatacaaaaattaattcaagatggattaaagacttaaatgttagacctaaaaccatgaaaaccctagaagaaaacctaggcaatatcattcaggacataggcatgggcaaggacttcatgtctaaaacaccaaaagcaatggcaacaaaagccaaaattgagaaatgggatctaattaaactaaggagcttctgcacagcaaaagaaactaccatcagagtgaacaggcaacatatagaatgggagaaaatttttgcaacctactcatctgacaaagggctaatatccagaatctacaatgaactcaaacaaatttaaaagaaaaaaacaaacaaccccatcaaaaagtgggcaaaggatatgaacagacacacctcaaaagaagacatttatgcagccaacagacacatgaaaaaatgctcatcatcactggccatcagagaaatgcaaatcaaaaccacaatgagacagcatctcacaccagttagaatgacaatcattaaaaagtcaggagacaacaggtgctggagaggatgtggagaaatagaaacacttttacactgttggtgggactgtaaactaattcaacaattgtggaaatcagtgtggtgattcctcagggatctagaactagaaataccatttgaccctgccatcccattactgggtatatacccaaaggaatataaatcatgctgctataaagacgcatacacacgtatgtttattgtggcactattcacaatagcaaagacttggaaccaacccaaatgtccaacaatgatagactggattaagaaaatgtggcacatatacaccatggaatactgtgcagccataaaaaaggatgagttcatgtcctttgtagggacatggatgaagctggaaactatcattctcagcaaactatcacaaggacaaaaaaccaaacactgcatgttctcactcataggtgggaattgaacaatgagaacacatggacacaagaaggggaacatcacacaccggggcctgttgtggggtgggaggaggggggagggatagcattaggagatatacctaatgctaaacggcaagttaatgagtgcagcacaccaacatggcacatgtatacatatgtaacaaacctgcacgttgtgcacatgtaccccaaatcttaaagtataataaaaaaaagaattacacacttaaaaaacaaaaaagaaagaaataatttatcctataggatttcccacatttagggtttgcctgactgtatcctcatgatttcactgagttttaaataataattacattatttccaaggcaaaaaaataaaaaagaaaagtacagtttgagggaaaaaaaatttaaaaaacacagacatttgaagcaggaagccctgaaaggaagctgtggctttatgctctgtggaattttgactgctgagtgccttcttcctgaaagggagtatctacagcattgtctgtcaagtatgtgcatcctagtcctgtctcatcattgttcacaaatcttgagtgggatagggggacaggtgctatttaggaactatgggcaaagaggctcaactgcacagagtctgatctagatgaggagatcttgaactttaacttaccaccatcatgggaaatacttgtagatgttgcagatgaaaattagtatatgttgcatacagtaaaaatgtagattgatttaaacaagcgtagagagttgccaactggatactccaagatagtcacaagatcttccatcttattagttcctctaatagtgtgatgttgataatttccctattggacatattagcatacttttccccctttggaatcttagtgaacctataattgtgatagaagtaacactatgtgtcttctgaggctatagtaagtcataagaggttataaaacatctgtctggtactcttcgaggaagtgtacaagaagccaagcaggagcatgtagagattcacagcctcagctgaggactcatcctatagcctgaattggccaccttttatatgactccatccccagctgctatctgactacatccatgtaagaaatcccaagcagaaatcttggtcagcccaggaaacacctaacaactacaaagataatagtataatgatgtcaattgtaatgtgtcattaagttttgggtgatttgttctgaatcagtagtaactagatgccaactcataaatatagaaagaatttggaagtagaaagtcatctatggttactaaatgaatttgggtaacgtatacattggagttcttatattactttggcaatttttctttaacaatatgcccaaataaaaagtcacataaaatatgttcaacaaaaccaaacagaaatgtacaaaatgcagttggataaaaataaagaaaactccaataaatggaaggttgcaccatgctcatgaattgggagacttaatagtgtatattctccctaaatttgttgaaaacattcacaataaaaaatctcagagaattattgttgcaattgaaaagacattacttaaatatatatgaacattcaaaatgcaaaaagtaaccaagacagtcttgctaagataaaaaatgttggaggactaatactacacaataccaaagcctgtaagttacaggaattaaaatatatggtatcagtgaagtgtcaaacaaattagccagttcaatcagtttgagaatccagaaactgctccacccatgcgtagtcatttgatttacaataaaagtgctacttcaaagtagtagaagtaaaataaattaatcatactggatcaattcagtatctgtattatatgaaaatgaatcttaattctattccatatacaaatattaatcatcaataaattgtaaatataaatatgaaaggcccaagagtaaatcctctacaaaagggtatagaagcatatttcatgaccctagagataaaaaaaaattcttagagaaaataaacaaaatatctagcataaggaaagaaattaataaattagacttcactagtatgacatcctttttataatgtttaaaagaaataaacagctttttaaaggaatacatgtagaagaaataaactacattgataaagaatattgaattgaaaattttgattaacttgatggtggtgggaaataatatgtttaagagattgtggagaacctcaaactggatatgttgatatcttaagtggttgttttgcaggatagtaacatgaatttattatattactaatattaatgaatgaattagtgagtgctaaaaatatgaataaataaataagaaccataatggactaataataaaagtgcattatggaccaacattataattgtgttattaaccatcattgattattattccttgcaatcagttaataaagttgaggcccattaaaaaagataatagaaaaagaaaaatgaaagggaggaaggaggaattgaaaggaggaaaagaagatgttgtaaaaaaaataaagagaaaagttaagtaaaaaaaaaaacactcttgtggactccagaacatttctacattatgttttgcataatcaataaaataaagaaaaatatataacctaggatgaaaaatagcacaaaatatgtaattatcgaaaatgtaagcatagttccttaaactctgctgcaatataagaaaaataaaacaaactgcatcattaaaaacaaaacccaatattcaagacaatatagcagaattggcactgcaattgatcaaaacagtgatatggaaggcaaactagagtagcacttttgtttttcaaaggagagaatcatgacattagataataaagagagagctcagacagaaaaacagagtagaaagttaaacctgagaattaaacattttcctaaggaagaaatgagtccttagaaaagaaccagtaagaagaaatgtaatctgaaataaaatttccatgtctgttaactactaatgagtgtaaattcaatggagtcacacaattgtattcaaacatttataaaatgagaaaacacatatatttcataataaaatacaaattcaaagaatgtaagggttatttttttcaaagataaatgtcaggcttgcttcagagtcctggcctgcaaaatgaactcccagtaatcaatgtaattatatttgaaaatgtgcaaagtttttataaaagaaattatactgcatgcattttctattgaactagggaaataaaatatgaagaaaatttttaatttgaaacaagtaaattatgatatgcataaggatttatgaaactagaaacccttgaaaaatgtattacagctgataaagagatgaagtaaagtcggttgctcaagaagaggaagctgtggtttgtgattgtaaaagaatgttggtgaggataaaaatcaacaaaacctataagttaatctacctaagttaaaaatgtgttgataaatgcaaagtcattccataggaaaaattcctcaaatataaggcatataatgcaacgcaatttaattgtaataatctgactataacaacgacaatattactcatgcaaaattaggaatcataattgaagggcaataacaagttttaccatcatactggtttaatagatgataaaatttaataaccagtattttccttgacttcaaaatttaaaattatagatttatataggcataacaaaaagcaaatatgacatatacgtttatattttgttctttcagtttattcccattctatcttgtttaggattcactcacggtggtcatttattaattttttttaaataaaacatctaacctttcgagatcattctactctatataaggaattacaacaactgacacaaaaagttaattagtgagagaaagagatgtcagtgctcagtccttttatgtcaggcactagtccagaacacaagatcctaaggacagacacactacctaaagaacaaggcattctgcttaaatgttacctccttcctaaaggaaattttcacttcactttcctcagatccccgtctttcattccgattagcactccttagtttgtgtcttgaaccagttcttccttgtctgaaggaacttttccacttcctgagtccattcccaactctaaacaccattgcgagtgagtgccatccaccaggtagtaaaaacatgtaaccaggtttgggaagactaggaaaaatttaaaaactatttaatgggcatctctaagctaccttggatttattttcttacatctggatatattctagttcttctaaatacctcctcactcagaggtttttcttctcattgcataggttggcaataaaatagaatctttgcactgctggtggaaatgaaaaatggtgcagcaggtttggaaaacagtctgcaattcaagtggttaaacatagagttaccacatgatccaggaagctcttaagtgtggacccaagaaaaaggaaaacatatatctacacaaaaacttgtacttcaatgttcttagcaagttactggcacatctttagaattatttaggaacagctttgtcctaaaaaggggtcaccagaattctaagtgatgctcttcaactagctggatgatcttgaataattcctatcaacaaatctatctgggttttagtcatctcatctttactgaaggatatagcaagtataattttgtgtatgtttttatttcactttttatagtgtaaaattaccagtgtcttcagtgaataaataaaagtgaaaaacacattgaagcaaattgttctgattctacaaatattgacttaattggattcgtacatttagggtaaataggaaccatcattaaaatgcaatacattttgagtagcttagaattttgatgctttccaggacaaaaaaataaaagagattatagtgactcatgtgttcctgatgacactaagagtgtggtaaccttgtaaaccctgggcttccttacatttggtgccctggtttcacagatggaatgtgaaaatgaatacagattataattaaatataatttgattagataaggaaagaagttaggatgcattgattggtgcaaataacattatgcttcataacttttttaaaataaacttttgataagataaaacttacccatacatgtatattcacaaatctcaacatgtgtatatgcactcacaaattataatgcaggttttaataaatttttcagagattgaacacactgtataacaaccgtaccaaagcagaacactcccggtctcctagaagcaccttctgtctcctcccaaacattagccccactcttctccaatgcaaatttaaatctcactttcagtaacattgatttagtgatggcggtttttgaactatataaaaaggaatcatggatagtgagctttttatttctaacgtcttttgcgcattattatgctagtaagatacacccacattcatggatgtagtagcagcttttatattttcattcatccatagtatttaattgtatgcacctacctcattttatttattcaaattactcttgatttgtatttagaatattcccagtttggggctatcactaataatgctatgagtgttattttatttatttatttatttatttatttatttatttatttatttttgagatgtagtctcaccctgtcacccaggctggagtgcagtggcatgatctcggctcactgcaaccttcacctcccgggttcaagcgattcttctgcctcagcctccctagtagctgggactataggcgtccgccaccacgcccagctaatttttgtatttttagtagagacagggtttcaccatattggccaggctggtctcaaactcctgaccttgtgatctgcctgcctcagcctcccaaagtgctgggattacaggcttgagccactgcgcccggccaagtgttattgcacatttctttctgtgcacatctgtacacatttctgagtggaagggctggattaaaagggattatatattcagtgtcagttctccaacttgtggtaccactttatattcccaaacataatgtgtggcccttctagttccccctttccgtcactgtatttggcattgtccctttgagtcatcctatcgaagttttagtggtagacagttgtgattttcatttgtaggactgggatgattattgatgttggacagctttttattgttttcactctgttgtgcagtgtcacctttgtccctaaaaagtgtcactatatgtgttagtcattctcagaataccctcttctgttgcattaggcaatttgtttgaactcacatcagcagcacggttcgagtatccaagtagtgtaagtcctcattcttgggcttcttcgggtttattgtggttattcaaactccttaacaatgtaatatgatatttagaatcagcttttacatttccatttacaaacagtttgaattttgatttcgattatctttaatatatcaatctgtgaagaatgaacatctttacaatactgggactttcaacctttgaaagtactatggccttccattggcttagattttctttgatttctttgaattatattctggagctgtcagtatattttgttagttttttctaatgcctcttggtttgatgctactataaatgatgtgtttcataattttaatttttagcagttgttacatttatataaaaataaatatatttttatattgatctttaatctatttactatgtatctcattgattctaataatttctgtgtagacaatttgaaatttctcccccacacagtcctttcatcagtgaattgttatacctttaattctgcctttctaattcttcttctttatcattgtcgttgctactttatcgcactggccaggacctttagaggcgtccactcatgtgagtctgatccaatggccttgaccatgaaattgtgcctgaacctggctgtgcatttgggtctgagaaaaaaatccatcagtgaaactataaatattataaggaattacttttgagaacctcagaatttccaatcaaagcagagatgctaaaactgagcagcaccacatcagatgactaaaaaggaagcaggtggtataatcaaataaacaccttaggtctcctggaggtttttgttgcatgttgaatcagtatgggacaccaactactatgctgataacagtgatgaagtgcaaatcttcaggctccagcctgccgatggtgagagtaagccctgtcctgacccactatcacaaatcagggctgtaccatagatgaggagcctgggagcccgctcaggtttcttctggtaccaggcttagtagctgctaacactgactggccctgcaagtcagggtggcttttttctccagagacaaagacagggaagctggagactgtgtcatcactgtttctacagtgaaatctgagattagaaataaaatgccttacagtctttaggatggctattataaaaaagacaagagataaatattgatgagggtgtgaagaaaataaaacacttgtacattgttggtgggaatgatgattggtgcacccattatggaaaacagtatggaggttcctaaagaaattcaaaacctaaccaccttataacccaacagtgaccctattttggatacatacacagaagagatgaaatcaccaccttcttttaaagatacctacactcccgtgtttattgcagcattattcacaagaaatgagaaaaacctgagcatccgtggacaaataaatgaataaagaaaatgtggtatacataaatgcacacacacacacacacacacaatggaatataattcagccttaaacaagaagattctttattattattattattatttttactttagagaagtctcactcttgtcgcccaggctggagtgcaatgatgctatctcagctcactgcaacctcctcctcccaggttgaagcgattctcctgcctcagcttcctgagtagttgggattacaggcccatgccaacacgcccagctaattttcttttgtattttttgtatttttagtagagacagggttttgccatgttggccaggctggtattcaactcctgatgtcaggtgatgcacccgcctagtgctgggattacgggcatgagccaccacacccagccgaaaaataagattcttctatttgccgtaatatggatggacctagaggacagtattctaagtgaaaaaagcgagacacagaaataaaaatattgcctgattttacttacatgtaaacctaaaaataaattaaataagtaaaaagataaattatgcagaaatagagaatgaaacagtcgttattaagggccgggggtggaacgggaagaaatgggaagatgtaggtccaaagatgcaaggtagtagatatttatgaataacgagtatagagatctactgtagaaaatgagggctatagttaataaaactgtactgtattagagatttttgttaaataagtagattccagctgccagctgctcttgtcgcagacgaaaaagtaactatgtgagatgataaatgttcattctcttcactatagtaagcattttactatctatatgtatgccacaacatcatattacaaacctaaaatatacagaataaaatttattttttgaaaaaacagtttaaacagaaaaacaaataatcacacatgtaatctagattatacccattgtctttccaatagagtcaagaccattgatctacattgagctttaattattgtgcttgctgagcagagatgccaggttgaaggacccaacaaagttgagagagttttcactgacacacagaaccccccacaaccccccgcatattcccctcacctgggacccagagtaacataaagaaatgataaatacatgagctgatgcacatcctaaatatcctgatttgatcatttttcaacatatgtacatatcaagacatcaaagtgtactccataaatatgtacaattacaatgtgccaataaaaacaaataaaatgcaaagttacctattagtgacattagaaagtaatggaagaaatgaggactaggcgatctaaaattctagagtaaaaaaacaactaattctagttgagttggtgttcatctgacattttgtttttctgccttttttttttaccaaatgtgcgttcggatagaaattttgatttggcacagacagagaaacccagcaagaagagagaacataactgagctttgaaggttgcacagggcaatttctgtgcaaccatagccagatttttcatgtggcatttgctgagttctgagtcaggagacaggctgtgggagtttgggtaggaaggcagaaatctccaacactcaggatgttttttcctccagtgctgtgcaaatcatcctttgtatatgtctcaaccatggacattgatcactatccctttctgctgggccttttggttaacacgtcactgcatgttcatctccacaaacctgaccacatcatctctgctataggggcagaatgagttctagaagatctcttcatgctgagttgaatgggattgagtctttttgcacgggaacttcactaaacctttgatgattacaaacctaaacaccttttctcaccattttcccatgaaacttgcagtggcacaggctcaactcaggaagccaggcagtggtctcttcaactctgtgactcttcacaagaaatacatcgggacttgattttaggtttatgtcatcaacttgcaacacccactggcatctgaagttcaccaaatgtaagttaaaatgcaggaggattgtctaatacggtagacacagtagctcatatctactgtgttccttgtgtgttcccattcctgaagtaccctcgaagtctaaaactgttatcattctctattcttctagcaatatatagggtgaattctatgccctgtatattccagtgtatgcttttatttttaaaacccaacttttggaatttcaagaattccttttatgatctatcagtaagaagtaatcaaggcaaatcaaagagttttagcatttggatcttgtatctgacattaatttacaaaagtctaggcactcaaaaaccaagatttttgctaattgcccccaaccagctacccgtataaatggggagccacattttacaactagtgtaaaatgttgtctacagtatctttattacataggaagataaggaataagtaaggaaaatagaaagcttggaaggtggaaaataccaatttctaaatatgaccaaataattatcctattaaaatatataaaaatggatgaaatacatacaaatgaggaggcactcagcatgtgttgccaacatttgtatcaattgcctggcacttatgctgattaactacaattgagaaatgtaagaaaggaggattcgaatgagcttttattcagttgcatcatgaatcagcatcagctccatgggaccttccccattctcctactgcttttgccatgtcaaggcttttgcagctacacaaatgagtagttcctgagatgtaaccaaggaattcatgagaccaatctactcctctgagttgtccaacattttcctcatgcacagactcagagaacttgctgtgctgctccccagacaaacatcacatgtgagcagctgggccacttcaagcagagaggtttgtgctcagggctgtagcactgtgggaggatcttgtgcatcttgcatgcagtaataaactccaaaatcctcagcctccacccggctgattttcagtgtgaaatctgtccctgacccgctgccactgaacctatctggcactccagagaaccggttggaaacttcatagatcaggagtgtggagactggcctggctttctgcagaaaccaatacaaataggtgtatccatcactatgcaggaggctctgactagacctgcaggagatggaggcctgctctccaggggtgatagacaaggagagtggagtctgggtcatcacaatctctgcactggatcctaaaatagatagaaagaagtggaaggatatgtacaaatatcatgtgtcatttatcataaattttcattttttatttcaggctatataattttttgttgtttgtatttatacactaaacatattccaaatttgcaagctgcaaaggggattctagaagtcacctacaccacctccctttctctgtgtgacgatattcaccagagcacacaggtccttgcttctttttgaatcgtcctcactctcacagatttaaacctcacattccccatcctggagaacaagacctgtacatctaacacatgggcagggcagaacacacatggaaggcagtggggtccccaggcttaccttcccaccccattctcctccctcatctccttctgtccttaccagggacccagagcattagcagccccaagagctgagcagggagcctcatagtgagaaggtgaactgaggagtcctgatcagtcaaggtaagggttagagctgagcttttatctcagacccacaagggaaggtcctccctagaggacaatatgcaaatcccccggtgggtgcagtgatgctaagcgcaacaacaggaggatgagggcttctcttgtgggcaaggggacataaaatatcctgcgtgtttcaaggaaaactaaccaagataaaatctgtgttgcttcagttggagaagagacatattataatatttccttttctttccacctgtttttcaacagttctttagcacttttccaggcacattttgcacttgtctttaataaagttgagtttccataaatattggctgattcttttttcttgcctccaattttctttaaaagaatctaggtttggcttttctatttttttttcattgaaataaaccacatataaagggcagaaatcctaaatgtggaatgaataaagttttatgtatattcactatccagctgaaactatagaatatttcaaaatttctggatgattctctcgtacaccttcccattcaataactgcctccccatcccaaccaaagtaactgtctttctgacatctaccacaatagtttgtttgtacttggtagtgaatatcatagaaattgaagtaaacatttttttatcattgtgtctatttttttcccagttctttactattttgaggcctttatttctgtttgtggattcaaattactgtcctctataatttcatgtgattctgagcaatgttttcttaaattgatttcagataatttattgaatatctacaagtaatattttcttttcatttgtgtttatcaaggtaaggactaagctctgattttttttttccttgtctcagttcctatctaaggagtctggggagtcatgccctacaaactataaattctcatcagatgggttttatttaaccctacatatccttggacttactttccaacctgactgtggtggaacattatgcaacaaggcagaaaattaaaatattttaccccaaaacatgtttctttgccctatcttgaaatggccttgcaaagctgtcctttgtggggaaaaatttgcatctgtaaagaatctctattaacatagccagatctttttcttccaggctctcccaatcttaaagaagagtctagcacattttaaagatctgaataggaaatatttgtaatctattttctctaagggcagccactgtatgacttcaaaagaaccttggtcttccgcagtcttttatcttaacctgaacatttattttctattgatcccaggtctttagacaaactcaaccaattgtcaacaaggaaatgctagttagagcctggaacctcccccgcttcaccaccccccatcctcacccctgctttgagttgtcccgcctttctggaccaaaccaatgtatttcttaaatgtgtttgattgacgtctcatgcctctctaaaatgtataaaaccaagctgcgccccaaccaccttgggtacatgttctcaggacctcctgagggttgtgttgggggccacagtcactcatttggctcagaataaatctcttcaaatattttagagagtttgactctttatcgacaaagaaatatgtttagtttgctttattcttaaagtatacttttgctgcatatagaactttgggttgatttttttctttcagcatttgagtatgccattccaccgtcttctagtctccattagaaataatggacccttattcagtgtctacattattgtatctttgtacatagtggtttttttctcttgaagattttccctttgtaactgtatttcagcattttaattacaatgtgtgtagttatgaatcttttttgcttcccctggatgtgtttcatcacatttcttggatctatatagtaatgtatttcaatacatttgaaaagatgttcccattatttcttcacatactttttcagctcctttctctctcccttctcctttgtgactcccatccacatttgttggtgttcttcacactgacctatacatctctgaggtcttgcttggctgcttacatctttattctttggaacagattatttctattggttgatcttcaagttcactgattcttctgacactgtcaactattgtggtgcctatctaaattttcaattgagttattctacttttcagttttaaaattctcttttggtatttttttgtcttcataacttccactgttctactgaaagtcgctattttgaaaccacctttgcaaaaattttaatagtaagaaaattatggcagtaaaagagatctgatctaacccacctccccatcttgcattttccttaattattcctgggcttttgggcagagctaactttggaagccatttaggttatagtttaaatgatgatatgggttacccaaaactcagctacctttgtaaagatcatgaaaggccatcaaatagtgggaaaaaaggagcctgattctgctaaggtgtggactggtcaccagatactccttcagataacaccactattgtagattggccttttaagatatattttcaagtattgttgcttatctgacagcaatggctccacctggacctgctaacccgcatcctgtggccccactcaggagagattcagctccagaggacagctctgacattttatgacttcatttctgacccaaccaatcagcagcaagcacccattacctggccaccccttcctccaaactgcctttgaaaaacccctaactacaggccttcagggagattgatttgagtactaactctgtctcccatgtggtgtggccagccttatgtctactaaaactctttattgcaaatgaaactgactttgcaaaattatgactgagacagtgaaagaggtctaaattaactgactccatcttgcttctaacctccaagttgtccttgttcattcctgggcataggctgaactaactttgagaggaatttagtttagagtttaaaacaaagacaataacagccttttcccaaagcagatgttcttcttgcctggggactagataggctttgtaggactaacattagccacaagattggaaattatggtttatgagtcatgcagctggaggctacaaggttctgaccccctcaaactgctcctaagatcagtgcttgagatattttgatcttgcacttgacggatcagctggcaccacccagatcaataaactgctaatctgatcttatggtctcccacccaggaactgactcagtgcaagaagacagctttgaatccctgtgatttcatctctgaccaatcagcactcctggctcactggctcacccaccacccaccaagttgtccttaaaaattctgctccctaaatgctcagcaagactgatttgattaataataaaactctggtctcccgcatagccagccctgcctgaattactctttctctgttgcaattcccctgtcttgagaaatcagctctgtctaggcagcaggcaaggtgaacacgttgggcagttacacaatgtcgtggtcttcatttgtgcagtggttaggaaaaatccctcagctaggtacaatgtgtttaatcatttttttcatattttccattttaagtatttgatcatagagtactgatcgaaagaaataaattttttaaacatctttaaaataactctattgaattcaacatctcatttgatcttttacaactgcaggaggtgagcagcaggtaagcaagcaaagcttcctctgtctttagagcctctccccattgcttgcattaccacctgagctccaccatctgtcagatcagcagcagcattagattttcactgcagtgcaaacctcattttgaaatgtacatgtgagggatccaggttgtgtgctccttatgagaaactaatgcctgatgatctgtcactgtctcccatcacccccagatggcaccatctagttgcgggaaaacaagcccagggcttccactgattctacattatgatgagttgtgcaattatttcattatatattacaatgtaataataattgaaataaagtgcacaataaatataatgtgcttggatagtcctgaaaccatcccccactctgagacccatggaaaaattgtcttccatgaaaccagtccctggtgccaaaaaggttggggaccactgctatagataatagaaaccgggattgtcatttcaagaaacagaaatcacaaataagaaaatgaggaaaaatagaatgatacttgtggaattgctccttaggagcttatgttcttttcttacttatattttcatttgtatattttaattagttttgaaataaatttagatttatgcaaagtttcaaaagtagtagattgtttcaatatacttctcctccaccttctcttaatattaaacatcttaaataaccaaagtgggatgatataaaatgaaaaattaatattgatacaatagtatttactccatatttggatcccactaaatttttcactaaagattctttcaagttccagtatcaaatccaggatgacatattgcacttaatattcttgtctccttaatctcctccaatctgtgatcattgtttattctttctttgtctttcatgacctcaatgcttgcaaaatgtactatcaatgatttttaagattgcccttctaattttctcaactaattcagattatatgtttttgacaagaatatcacaaaagagatggtcctcgtcagccagtgcatcatcttgagttgcataatgtcaacatgtcttgttacctgtgatgatgaaggaccgtgatcaataaaatcctttttgtaaaatgttttggacaaagggaacacacgcaactgctttcactgctcttcccatttggtcatgtcctcacattattagaaataatttatttttctctgagcctgccattacttatttttttttcagaatttagttatttttgaagtcttctaaccaattaagaatattgaaaaaataatgttcattcttaaacagtaaattttcagtgatgccatttaccaatggaatgttgttagcttgaataatggaacaggggaataggattattaaaacatggaagtattacaccaacagacagctgttactaagccatgtaattggataaatgaactgaattttctaccactaggaatgttatagaaatcaaatggaaagatactgcaagcactgagctgctcctaactggagagattgaaatacaattgctgccatattatataattcacacagttgagacacaatattggagaagatgaaagtctagggcctcagtttaaaatatatagcatttgttatgaagaatatatatttttccaagtttttgcatttgtcatctgatgaatcagtgggattatgactgagtgttgctaggggtacggaaagaggagctattagagaagggctaccagactttactggatataattagcctaacttggacttgtggagaagaagacttagaagaaaagcatttggaaaagccacacatgttttaaaaatcaaatacttgcatcttgaaaaactatttccagagaaaagcaatgacttagcaaaaaacttaatgacagtttaggtgaccaattcagtctcatacacgtgcagctgctttgctctttttgccttgcatccctgaggtctcagaagggcctaggcttgaaaggacttgtttccccagaaatcaagcaagtaagaaaataaattgacaacatacttagaggagaagcctatcaaacttccaggggaaaacctgggattaggggaagccaggaagagcatggctgagccagaaagggtggagcacatgaatctcatggagatgagccataaggcaggaagttgagaatcagaacagctgatttagaacagaccagtacctccttatggatctgacactgtgtatggtccagtggaatctgcaatgaggctgtgagttgagcagcaaagtcagggcaaggcaaactgttcttggagccatggacaacaggagagtatttcttcagggccagtgatacagggggcctgagaagagggactcaggatggagccctctgggagctgcctcagcaatgctgtctggacactgatcatttaatgagagggacccctgggcttagagccacaccacatcttcccacctccttcaagggctcctcaccatttctacctcaccccaatttccttcttctctaagaggagcagctgctcagacactgattccctggaggaagcagatgctcagctgagcagaagggttgaccctgcatgggtgtgtcacgtgtgtccgtgtaaagagagtccaccaacaggctctgtgtgagcaacaaggctgtttatttcatctgagtgcaggcgggctggtccgaaaaaggagtcagcaaagggtggtgggattattattagctcatataggtttgggataggcatacaaagtacattctcaaaggcggggagaatattacaaagtacctttttaagggcaggggacactatatcgtatcagttagggtggggcaggaaaaaatcacaatggtggaatgtcatcagttaaggctattttcgcttattttgtggatcttcagttgtttcaggccatctggatggatacatgcaggtcacaggggatgtgatggcttagcttgggctcagaggcctgacagggtggtgtatgtttagggccgttccactgtatagggtcccagtgagtgcgctgctcacagaaggaatatgcaacatctcctggctccacattggtgattgtgagtatgaaattcctcccagacccactgccactgacgtgggctgggacccaggagcccggtttgtcaccatatagatcagtggttgaggagattggtgtggcttctgttggaaaccgttcaagtagatgtctccattcctatggatgagattgcgactggtcttgcaggagacggagaccctgtctcccacggccacagacaggagggatgggggctgagtcatcacagtagcctgatgggaaagggtggaaaaacaattgatcagtctgaatacaagtcaaaaacaatggttgtgaatgaaaaaaaagatacatcatatctaggtgttcttcaggtttttaagcctctgccatctgaatgaaaggctgaaataaaaactttggccattgatcttcactgtctcacccactggataagagtggccaccactgttctcatcctgaaaattacttatatgtacaaagaatcctgtaccatgaatgcagagcaccaggggcaagaggatccatcccaacaagaccatcctgggcagaggaatcatccagaagtgtgttttcagcctagatgagcagaatcagataacaggttcactttcacaccttagatggagtggtcaaatagcccatgtatgtttctatgcaaaagaccttgagtgctaggcattcatctctgaacctcagtcaaagcttcctatgagagagaatgcctcgctgcggctcccaggccggctgtattcagatgcctgggcatggtccaaccatgggctcaggttgagcagaatcatgatttaacgataaatatcccaggggtcagctgaccttctgaagtgtcaaacatgatattaaaggatcaatatgggaaaggaaaaatgtcactaggttgtgatttttcatttagttcagagagctatttcttctgctcatttttctttcctgaatggagtcatagatataaatctaaccaaatatacaattttcattgtcctcttaatcattggcaaactatatctacacttctggagcatccgggaagctagcccataccagtgctatctttggagccaggtggtaactgtggatgtgagcaaatgacagttagatctacaagtctccaagaccatgaccactggcctgggaggacctgcagggtttgcatgtcctcacacctggatgaagaacatcttgatccttgtccttttgatgcccttcaattactaggccacactccaaaaacctagtcctcactcctctcctttgctagacagaccctctcactcacagctcttcctcatggacatttcctgtgaatcatttctccaggcttacacacactctgcatgtcacagtatgtgacagagggaactgatgtttaaacaattacccattgattaggttgttctgagtcctaagtttaattgtccttctacaatagagtcagctagaaaaataagaaacgcgaagaggtgtaaaattattagtgcgtgaaaatggtaagctatgaactgggatgatgaagtaataatagtaatagtaataataataataataataataataataataatagtaattaataatacccagaaccggccgggactctgggcccttgttaatccgagataccagagccctctctaggatcgctattgcgcacgtgccccttcttgtggtcaactccgccaagacacctggtgttttttcccggtaggtacttgacagtgtcattcctagtgaataaggtaagtcttttttgcatattctcaaacacgctttcttgtttgtttgcttggcttgttcatgatgcctaaaacaatcataaatggttttcaggcactatccaagactgtggaaacataagcgagtggtgggtagctttcagttagatgttaatacctatgaattgggatttcctcatgtctggtttccaagtgttgtggaggccacacaatatgttgctgtccaacgctctctagttagcaatagagtgaccgtaagtttatcagacttgaggcccacagcggctcagtcggtgatttcttactccactctttcgttgttccctcagtcggaatctgtgggcagtttccactatgtctgtgcctctggcctctctcagctcccctgcagtgctgggggtcgaggctgatggctgcacagagaaaggtcttcgtattatcagctctggctagagctcaagttcagagcaggacagtgccctccagatgattatagagcagaaagactgcctcttctatcttctctaaatggagtacattctagatttttatgaaatatttacattccagtatttatggaatgatttaaattatttttcaaaactgtattggaagctgtgtctgaaggcgaggagcaatgctttttttttttttttttttttttttttgaaacggcgtttccctcttgttgctcatgctaatggctagactgcaatggcatcgtcttgacagtctgcaacctccgcctctggggttcaagctattctcctgcctcagcctcccaaattgctgggattacaggcggagcaatgcttttgaaaatggctttgctctctggttccacacaaggcactgaagcctgcggaatttagggcttcacgtgggttcgagggtcccaggctgccacctcatcactcagcctccttttcttgcccagtgctctgtgttctttctctggtcaggaaattctcacacattttggtctaaaatggaaggagtgttgcttctttcacctgaggatcaatcaatttacaatttttgagacaataatttacacttaattaaatcaaatcactttcatcatatttgtctagaaatgattttattctttttatttattacaaattgcctcatggcctgaccaaacttccagtggatcacttgcaagagcaaatttaactgtcaaatttaccgttacattcatccattgagttattggtttgaattactttatatttgacatttgtttgatttctttttatagtttctggttctctgctaaaattcttgatcttgtcatagaatgcattcagcatataatatactattgtcccaatatccgcaaattattttggtccctttctgttgcctgttttttttctctccattttgtatgtttgggtattgttgattgaaatcacactatgtttaatacacttaatatctatgtagatttaaactgatacttgccctacaacattttagaagcaattttgggctctggaataattttcacactccagagaggatttacttcttattctgccagaatgaaatgctagggctgtaccaagttaatgccatcaaaggactgcagtactttgggcctgggtatcaacacggtggtgccttgctactcctggtgcaacctcctcccggtatgtttccctagcaagatttcacctcaagaccttggtatgtgtcaggatccctccttttctgcagtcgttcgggacagtttttcacctgtggccatatgagatttttttaaagctctgatggactccgaggccccttggcccctcctttctttcagattttcaggactgggcctctatttctgagcctgcttatgtctcaagggacactgaaggcacaaaactagtgctcccctgtctatgcttccctgcttttcttgtctccttgaagacctgctgggttgtaatgtttaatgccccatcatggaggtagatgggccggtttcctaattaataattattaagttgaggccaagaaaacttgagagagtgtttattgttcccacgaaggatgcctgtgtggggtgggcacgagctggtgcagacctgcctgaagaggcagagtttaggcttttagagttggtaaggggagagagtgagagaatgttctccctgtgagctggagggttgtggggaatttcctaccagtgcttatagagatatgggcagagaaaaaaggaggaggggcttggaggatgtcagggataaaacatcaaaagtaatcagactctcagacatggtgatgctctaatgccttcaaacacgttttcatattttattcagctttttttaggtgtacccagcaggttggttccacataagccattccaccattttacagaagtggaagttgcaaaacaatttttaaattatgaaatggttcaaattttaaaatatggtgagaaatattatatatataattaccgggtggagcaaaataatgataaataatgttatcaaatgtttactatttataaacattttaaaaacatctattcaactcataatactgtatgatatagttattcctttattttttattattacagatgggaaaaccaagcaaagaaagtttaagtaacgtcctgaaagtcacacagctgttaagtggatgagcccaaattcccatcaaatgtgtatggttttggttcctgtctttcatcatgggataaagtagtatccaaaggccctttctgaggggttcattagatttcccacttagatatcagtcattttgacaagagaaacgagtggattggtgtcctctcgctgtccagagttctcacaccgtgacaggcaagctcctatgttgttgacagtaacaatacgctgcatcttcagcctccaggctgctgatggaggggatgaaatcagtccacccactgtcactaatcctggcaaggacagcaaggtgcaggtcataattactataaataataagattcagaacctgacctggtttttgttggctccaattcaggcagctacaaatatcgtcacagcttctcagctgatggtggcctttcaacttctctcaggaagctttgtctggaagttttgtaagtttgggcacgataatgttcccattgacaactgaaatgaaaaaaaaaatcacatgaaaaatggtgatgtaattgaggttaaatacatcacacttcatggtcttctcaggtcactcaagtgtgtgagttcctcgtgagaagtcacaattcacagatgcaaaaaagccctcagaactcatcttacaatgagaagaaaggctgtttccttatcatgtgggagcctcataatttcagctcccaactgtgagcaaggcaactgtctcagaccaattccactgagtcagggtgaagtcagacaggcgcacacacagtaagaatcgcaggatactaaactggattctgccaataccaggctgagtcactgctcagccctaactgatcaagctgtttttggagaccagagcctgagtcagcacagtgattactgtgacatctaattcagaaatagaacacaaacacatcaaatatttttctgaaaatataagtgttatgaaatgatatttcctaagctatcaaatatcttaagaaatatttcctttatttctaatgcttgtccttacttcatgatatgcacaatttccccactccaaccagtatgtattctatttagatcataagatacgattagtggttatgtttatgtttgccactcaatatcagcagtatagtactccaaaatctcaaattgctagaacggcattgtataaaatctttaagtgaagtgataatccacaaataaacatgaatttcagatttataaaaagaaatgaaaacacaaatgtcctagtagagcaggataaaatacacttttctacacacagagtaaagggtaaaaattataaagggaaatatagttgcacatataagcaatttttaaaaatcaactgctattggctgtgcaaacctcagtcccatcaactctctcactgaaatatttctcaggtttatatctctatcccctccaacatctcgataaccacaaggagccttaagaatgatgttgctcatgttctaatctctcactgtctagtttgataagttatgttgacaactgcacaataagagcgataagatcaaaagactactgaagacatttcaaatggaaaaactaaaagtcaatatctctcataaacatagacaaacattcaaaaaaaaagggaagatttacctctatctctctcagataatctgccatgcccaacttgaatatatttcagaagtgcaaggttattataacattacataatcaatccatataatgcatcatactgacagaattaagaacaataactttcattatctcaatagtagctgaaaatcacttgaaagaagtcaacagctattcacaataaaactctcagcaagcctgggataatggaaaacatcttattctgataaagcatctacaaatgatccatctttagaattactgaggtttaaaattattgagaagtggtacaggcaattctacagcaaacatcttacttagtgataaaatattaaacatttcacttctcaaattataaaaaatactgaaccatccactatatgaaatcataatggaggtcctaagacatgcaaaaattcaaaacaaataaacaaacaaaacccatggagtatggaaatgaataagcaaaacatttgtatttgctgataaactttgtacataagttcttaaagaatctaaaacttaatcactagaaataggtctctgcatacaatgtggattaaaggagatataaataaatagcattttcatgtccatagaacagaagatttgatattgttaagagttaatgggtgcagcacaccaacatggcacatgtatacatatgtaacaaacctgcacgttgtgcacatgtaccctaaaacttaaagtataataaaaaaaaaagatttcagttttctccaatttgatatatagactcaatgcagtccaattaaaatcctcaaaggaatttttgaaattgaaaaggtgattctacaatttacttggaaattcaaaggacgtagaatagccaagaaaatcttaagtctaaaaatctggtattatgtcttctgactttttttttctttataataaagccacagtaattaagactgtactgtaagtacagagatagacaaagagtcaagaaaaatattctttttactcaatcatgagatttttaaacacaggcaatagagtgaggtataggttttcaattgttttttgttttgttgtgttttgctctatttttgcaagaaatggtgaggagttgttgagtatgaaaataaaaataaataaaacaagacatcaaaatacaattcttgatccacctcaccccaggcaaaaaacatgaattagagatagactgtagcctatatgtgagaggtaaaataacgatgcttcttcaagaaagcataggagcatatctttaagccctttggtggtaaaaatttattaaacagaggacacatgtaaacacacaaaacaaacacaggagaaaaaaatgacaagtaaaatgacaaattagattacattataattaagaacttctaatcgtatcaatgtgtatgattaatataacattacacacacagacactcacacacatgatttgaacaggaacttccctaaagatacgcaaacagccaatgaaaataaatatatgaaaagtgactcaacatcattacctattaaggaagtataaattttaatcatgatacaacttcagatttatcagtacagatgttttgtgctggatatgtatagtggaactttgacataattgactccatctcagataaagactgcattatatgtttcatagggcagcttgccaacaagaataaaatgttttgcctacaaaataaaaaaaataaaggctgcatccaaccagataaggtcacaagcaagcacagtcttgcactatgagttcttaccagaggactctgtgaccatgaaagtgcgggctgtcagtatctcaaaagggccatcttaattcacaaccatcccgttgtcatttgtggtaagaactcctcatctgtctaagaaggctctgacacatcagagactcttccttgcaaggaccaagggaccttcaggccagaccaggattctttttgtcttcttcactacccctggattgatttgataactctttctcctattttttttcttttggtgttaaatgttgcattgtgtaaactttaacttataatgtttatgtattgattaagaatactattatgtatggtttgcaatattgaccggcttgtgcaatggttttagcctgtgtgcccgcaacactgacaattgaatggctccttgggagctccatgtagcttgcagcttctgtgttggaaatagcatcagtaaaagtctgacattgtggaaagacataaacacacatgggcctggttaactctgaccttggagtgcacatgacagggtagatctatgcaaacttgaccccaatgcctgaggaagctgaaaggctgaagaaagaggccgacacatccagtttctcagaaagaaacatttaatagagacttaaaaacagaagccgtgtctgtgtctctgacagtaggcagataagatggtcaatcacttgccatgacccctctcaaatagggcttgtataccataggagaccagtggttcagaaaggatgtgtacgacaatcaaagaatgattacatcaaggttgtttaagggcaggatttatgctaagtacttgctcttaaataagataaaatagataaactgaaaatcttagagaccgtcccagaactcaggttaatcagaagtcagacatggaaaattagcatccaagatggggttgctttggcctccaccctagatataataaaagtttgacagtactgagtactgaaaaagattgacagcaattgagacttttatgacgtggttggtttcacgtaaatatgttcagtatttcagtaaactattgtcaatgtttactaagacaaaatctatgctaactttataactcaacacttccattcttaggaatattcccaagagaaatgagtgcataagttcacaaaagacaagcacaagaatgttcttaaggtttttaccagtaatattcttaaaccaaaaacaaatcattagttgaaaaatgaatatattttggcatattcatggaaaattgtgcctcaataaaaaggcacaaattactgccagagaaacaacacagatgaaactcaaaaatattttgatcaaaataagcaaaacgtcaaagagtaaatactgtatgattgaaattatataaagcttaagtataggaaaaattaataaatattgaaataaaatacagcggaagcctaggatgatgatagatggaacacggaattgacagggaagtaacctggggagatatttgagatgctgggaagagtgtggatcttgatctgggtagtgttggaagaaggtgggatcggagcataaatgtttacagtatacatataggtgcaatacgtttatctgatatattgttggctgaacatacttatatgtgtatgtacttatgtctgatctttgaaaggtcataatttagactctaatcccctgtatcaaaaaaaaattctttaaaaatatgtagagtaccttctccttttctgtataagtctgacttttgctgcaatctagacctcctaggtttaattttctttgtcctttattaataataatcaggagagatacttgcatatcagctgatggagctgaggataaagagagatagaatgtaaatgtgcctccctgaccccttctaccaaaacttcccagggagcttcaaaccttggctgcatctgagaactgctgtcagcagacggcggcaccaggaggagcagctggggcagcccagactcacacatctacttccctccatggtttatgttcgggcttgtatcacagtgggaggggcactgttatacttttgacagtaataagttgcaacatcttcaggctgcaggctgctgatggtgagagtgaaatctgtcccagatccactgccactgaaccgagatgggaccccctgattgcaaagcggatgcagcatagatcaggagcttaggaactttccctggtttctgctgataccaggctaaataattgctaatgccctgactcgcccggcaagtgatggtgactctgtctcctacagatgcagacagggaggatggagactgggtcatctggatgtcacatctggtatctgatattaggaacataaaaacacatatccacatgattagtaatgttctaagaagaatttcctgaagtgccaggcattaatggctacactggctgaataaaatttttgttgtttccctccttacctgggagccagagcagcaggagtcccaggagctgagcgggggccctcatgtccatgctgtgtctggactgagagagacttctgcacaggatgtcaccagcctattgataaatgttcagggcagtaggcgttgctctgtgggacatgcaaatctgcacagctgcaaagatgacttatctcaataacactgcacaggcccagtgcctcccaggtgtccaaagtctgcagagcatgtgtttctccctgcaggctacaggaaagaatcagcctactgtcctatgtgtggagtgttcttttgctctcttcatgtttcatgacatgcttctcttgctagctttctatttatgataaggtctgctagggaaaaacatctctagaaactcaagaaattttagaagtttcctgcatttgatacagatgagtactattaaggtcagagagacttcctttttggtccaattccctggaaacaccagtgctgtaaattgtcagtgctaccaacaatggatgcattaaggtataatcatgaatgatagatagatagatagatagatagatagatagatagatagatagatttgctcattaaaaaagaaataaaaaacttaaaaaaaccctaatacttgaaaataatgccacagcaaggaagggtcctgccactggctatctggcatagctaatctcccatctccagacacataattgttatcctccatatctgaatgttctttcctacctctttcagctgggccagccaacatgataaattttctccctttacttctgaaagttctcagctatattctagctctgtatgccatcctacagtctcatgctagatatttccctgtgctccctgaattttatttatgccttttatttctcttatccaagccattccccttcagaagctgaggtgtcctctaaaccaagttgtcaccctctatccctgtgactactctgtttcttatacctgcacatttccaaatcaccaatctcttccagctcctaagagaaaacagttcttaatgactgggtttagggcacttgatccgagcaggttcagaaagaaaactatgcaacaaaaagccagggaattgtatgagatactgagcctacacaatatagaaagtgcacccgtgttgtggggtgtagaggaaagcctacctgtgcgttgaagctatagttagcagagacaagtatccctacctgggtgtgcaggatgcaagacccctcatcccacttatgcaggacatcacagctggatgaggatgagcaggacagtcacaagggtggaggacactgttgctaatgtcagagccccgggggggaaagggcagctatgcagggatgcaaagttcacggtggactggcacggagtatcaagactaatgaaggtgtgtgaggcataagagggaagttgtccgcaaggaaagtttaggtgacagggacagtgggagattggtgtcacacaaaatgtttgatcatttaagtaaatatggtatgaataattacagccaagattctcagtttggaaaaaaagctacaaatataaaaaaggagaaactgtagatgtggattgtaattagagacattaatgtagattcactaatttttggagagttttatacggatatagattaaaacatatgcagatagacaggtaatttttcctagaagcagtaacacacaagtctcaataaacaccttgagtgctcaaatcttgttttattgaatatcaatctctattaaaaagaataattactggaaaaatatctgatctcaggtttagagcagaaaaaatataagatgagcctgcatttcttgtgtcagaaactaaggaagtgctcagaaaatgatggggtaagagaaaaagttattaggagctagcttgaatggggctccccttggacaaaataggggaatgttgactctgaaaataaataatgatagtaacatatttgtttcagtctgtgctgttataacagaatatttgaaactgggtaatttatcttttcagttagaaatctatttctcacagttctggaggtgggaaagtcaaataccaaggtgcagttatctggcaaggtccttctggctgcatctccatggtggaaaggcaagacagagtgagtaagagcaagaaggggtcaaacttgtttttataagtaacgcactctcactataacaaactcacccccatcatgatgacattaaccattcatgagggcaaagctctagtgacctaattacctcttaaagtttccacttctcaacatggctgcattggggagtaaatttctaacaaatgaactgaggaggatacattcaaatcacagcattccaccctactctctccagttcatgtccttttcacatgaaaaatacattcattttatcccaatagcacctaaagtctcaatttggtccagcatcaactcaaaagtccaaagtccagagcctcatctgaatcacatatgggtgagattcgaggcactatttatcccaggcaaattaattccagctataagcctgtgaattatcaagttacatgcttccaaaatacaattagccctccctacccatgggttttacatccacagattcaacaaccatggattgaaaatagagtattcagcagatgcagaatccacagatgcagagggtatacttttcatatttgcaggttcttcagagctgactgcaggacttgaatgtccacaaattatggtatttgtggaggaccctggaaccaattctccatggaaactgagggacaactgtacaatggtggggcaggcataagataaacattctcattccaaaaaagagagataggtaaaaagaaaggtttaactggtcccaagtaagcccaaaacccaacaggaaaaacattaagtcttaaaggtggagaataatctttgacttcaaatctcatatctggggcaatctggggtgggagttggtttaccaatgcctcaggcagccccacctctatggttttactgggctcacttcacccagaagccttcatgggttggagtcttgtgcctgcatctttcccaggctggagttgcatgctgctggccctacaattctgtggtctcccaggctgcctcactttcatggctctactagatattgccctagcagggattttctgtggaggctttctccctgctacaagtctctgcctgggatccagtatgtccatagtctttcccaagactcaatctggcattctccttgctgggaatccagagccactctccggctatcctttttggaattcagccctaagcccctggaagcttttcttttaaaccctccaaacacaacctctgacaggaatctggctggaacagtcggcatcttcagcaaaaacaactgagaagcaggggaaccctgcaaacaccacattagtgtagaggaaatgcatacaatccctagatttcatgttttctccaactgttttttccagtttcttaaccatgattctgtttctatgatcttgaaggatggagacattaagaagaacaaggagctgtttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaatttttttgtatttttagtagagacggggtttcaccgtgttagccaggatggtctcgatctcctgacctcgtgatccgcccgcctcggcctcccaaagtgctgggattacaggcgtgagccaccgcgcccggccaaggagctgttttatgcttaagatataaaaagagaaatggagacaggaagagaacagaatttatacattcttcaaagtggtttggatttctctaaccatgggcatagaatgacaaagatgttaggagaagacatcactttttctgatttcctgtttttttgtgtcttagactcccataaacacaaataagaacccagtcagtctctttcccttgaatattttttctggataagttaaaataattttagaagcaattgcaagaaatgatagcaatagctgaagcagagataagaattctgaagtttggaacatttgaggttggtgcagcaacttggtgacagcaaaaggacccaggtttttgctacatttcttctttgcacttcagtttttcagtcttgggttcaaagcctcatgatcttaggagggctgcagtgcctccaagtatcaatgtgcacgcatacctgtttcaggaaaaaaaatgcaggacaaagctcttcaccttctatgcctttatgagggatcaaagtccttccctgaagtgctgctcacctctgacatctcattgtggagctcatgtgccccactccctgctcctcttcattgtccttgccatgtgcagcagggcgaagctgctcccttatacgcccaaggagaggggatggctgctgtgtaggtgccaagagttttgcaatgttgtatttcactatgtgtctaagttaagttgcatgggaaagagaaagttcaagggcctctttatgtggtgggattggagtgggccagaccctgaggatgacaatgaagtcaaatttctagtttttcagttgccaatgctggcttcactagttaaggaaatgtggcctgtgcaattaagaccaggacagactttcaggtactggaataaatgggggagttatttggcatagggtcctcagtccaggactaatgtttgcattacccaagctgccggtcactggccctggtctgtggcagtagcagcttctctcctgaaccatggggctgaggacctggggggaaccacaggccctatccacggggctgcatggaatggggcttcagagaaggaaactgctcacacacccacgggtgccacaccaagcccagagcccgaggtgaggatgaaagtctctgagaccagagccttagggctgggcctgggctcctggggctggctgtcctcagctctgtcctcactggtcctgagacaccaggaccctgttggagccaaagagggagagtcagcaaatgtccacagactttactcagcgagcctctgttctgcttagaaataaaaggaacacatgctacaaaaataatgaatatatggacatactatgtaaacttttaaattaaatagatataatattatggatataaattattgatgtatctgtatataatatgtatctatattatacatctacataatatgtatatttatatagaaatagatataactgttggtataaggtatgatttcaaatttgataaattgagcatgaacatttaaaaccagcaatagcacaccataaacatgatccttcctgacttcctgaaggtcaggaagctcaggacccttccccatgtccctgttgagcaggacagagagcccccaagacccaaggggggtgtggggaacacaatcagcaggtggctgggagatgggcagtgggtctgggccctgattggagagaagttttgttcccagatctccgagtagacagttcctcccctgggggctcttctcagacacagcagcacatgtgactcagtggctgtgtagtcacagggtcacaggacaaaacccttccacttggcaattggcagcttctcctctgactagagtgatgtgggatctctctgcccagctatcatggctcatgtggctgctgacatcctcttcacaaaacgagatgccatgaaggcagctcagctgctgatggcccgagtgaactctgtccaagcccatcacccctgacccaacaggcattgtgtagagtaggcagcaggagccagcagaagctcagagccagctgtggcttctgctggtgccaggctagaacattgttgagactatggctggccctgcaggtgacagtgaccctctctactagtacacatgaagaggggctagagactgtccatctaaatgtggaataaacatgaacaccccaaatattaataccaagcatgtagtttgttcagtttggttaaattctattcagaaaataaaacaggctaattaactgattgtcaaggaaacattcctgtttattgcaaacaaactgaagatgaagcctgaaccctcccttcttcctcaagagagagtcagaacagcaggaggaataggagcaaagctgggtccccacgtccatgagatatttcttgatgctgatcctgctcagagagggtggggatagtgaatgagccttctttcactgcaacaccaaaatactctgggtgggtggcttgaaccatagacatttattttcacatttctgatggctgggaagtccaacatcaaggtccagcagggttcaatttctggtaaagaccttcttcctggtttgtagatgctaccttctcaccatgctttcatatggtctttccatatgagtgtgggagttagagagagaggaaaaagagagatctctggatcttatgagaaccactaatcctattggatcagggccccacccttataacttccattatattcttataggtcctatctcctacagccacgttggagattagaccttcaacatgaatgtgggaacacaatttagaccacagcaggtggacacaggtaaggcagtagggagggaaaggatatgctttcagcctccaagcacagagcaggttccccacaactcagcacactggcagctcatcccagatgtcccaggtcacacatgagacaccgttctagatttagggacttctcattgataatcggacactatcagtcttattttcccagtgtttctaagaccttggtgttctttattgtggagtgtgtttacacccagagacaggttattgacatagcaatttatgggatttttaattttgttatagtgaaaattacttaataaatttatcagaaataataaactaaaattaatatattgtatgaaaatgagattaactgaatatcctaaaaggagcctgagaggataaaaaaccatattcttttcagaagaggacaattaaagtcatatgacttttataacaaagacattttagtagaaattatcaaatgataaattcaaataggctgccacaaacataactatatactcaaaaaattattttccaaaataattttacattatcatataagagcaaataactgccaggtgcagtggctcacgcctataatcccagcactttggaaggctaaggcaggtggatcgcttcagatcaggagttcgacaccaccctggccaacatggtgaaaccctgtctctactaaaaatacaaaaattagcctggaatggtggtgggtgcctgtaatcccagctgctccggaggctgaggcatgagaatctcttgaacccaggaggcagtttgcagtgagccgagatcatgtcactgcgctctagcctgggtgacagagagagactccatctgaaaacacaacacaacaaaacaaacaaacaaaacaaagtgggtttatcagcagatccactaaatggaaaatttctccaatgcgtgcttaaagtaaaagaacatttatccctgatgggaaactctagatttctttggtctttagaagaaaacagctttctctctagtcgttccacttcatgctgtcgaggatgggcatgggggcaagtgactctgaggaaggaggaaggctgtgtctgagggtggtcgtgtctcctgcccatctgagtgacctcttggagaagagccaccgacaccaccaaagccacccacctgcctctgcactgtcaggcaacagacacagaaaccatgtcacatttagtccaccatattttgaggcttctttgtaacagccttaattgtactctgattctccttggtatttcatctcagtttttggaatcatttattttttcacctaatggggccttaacatgtgggactgaagtacagctgaggctatcatgagccagagtcctcagcagcaacctctgccctgaggtctccaacagcctcctcttctgcagactcagagaccctgctgagctgctctccagacaagcagcacatgtgagcaactgggcaaccccaggaggaggtttctgttaggggttgtaccactgtgggaggagtttgtagagcttgcatgcagtaataaaccccaacatcctcagcctccactctgctgattttcagtgtaaaatctgtgcctgatccactgccactgaacctgtcagggaccccggaggcccgattagaacccaaatagatcaggagctgtggagactgccctggcttctgcaggtaccaatccaaatagttgtatccattactatgcaggaggctctgactagacctgcaggagatggaggccggctctccaggggtgacgggcagggagagtggagactgagtcatcacaatatccccactggatcctgaaataatgaattgcaaagttatgtacaaacctaatgagcaattttcataatttatcttatgtcatttatttaaacttaattttaaaaaatactgatttatgccataaaaatacacattctaaaatgaattcaatttttgtaaagtataagagacctttatattttgaagatcttaatcggagcaccagacgtcatatttcttatgaggcttctaattattcacagagcaaaatatcaagttcccttttctacagcacagattatactcctctaacacagggttagactaaacatgggatcatgggatgctgtggagccctagagctcaccctcccaccctattctccttcctcatctccttcttttcttaccagagacccagagcattagcagccccaggagctgagcagggagcctcattgtgagaaggtgaactgaggagtcctgatcagtcaaggcacagttacagctgagcttttatctcagactcacaagggaaggtcctccctgtgggacaatatgcaaatcccctggtgcatgcagtggtgtggaaagagtcaatggggcaggcgggcaggggatatgtctctcctgtgagcaatgtgatataaaatgggaggaaggatctgactgtgacagtttgaatcttgggtaggtcccattgtgtaggatatgcaactctaggaaagcataacaaccctaacaatgtagagatatgtctagaatgaatatggatgaatgccattcttcttggctccctcccagctaatctaaaaaaggaaacgttaccctttcctacaaacactgatgagcagacagcctacaaataaaacatagtcttgagccagttcaagagtggtctggtatctgcggtttccaggataactgttcaagaatgttcatagcaagtgttggaatctaccctcccctggcacctggtgagtgagccccataagagcgctctgtccaagggcctcatagggaaaataatgtgggtctctatatttagattcaagagcccagtgcaggtaagaggaaagtgggaaacaatttattcctcaggcagtgaatataaaattcctggtgaccaattgttcaatctggtatatattccatcataatcatctcacatatgctagattaacctgaaggatttattaagggaagacttttctaggataattatatagaatgaacaaaaactaactttgcactatgtttttctgaatggtgttaacaaaagctcttcccacagtcttcctcatcatgtggaatgaggtcctatcaggacttccagtttttcgtcaactaccaagtgagatctgagtgtcccctgggcctgtaagtggtgcagccacagccatgagttcacaatttgagtggaaattctctatgtaagaagagcacgaactggatccacagctttactgtctcatggtcaccattacccatgactggcattttcctgagctttcatgtaaagacgatcacagctcagagatgtcaatctaccacacagctgatcatgaaaacagggaaacaatccaactatttgtttgtcaatgatatgctcaagattgagttgaacagctcttgaaagattgtgcctacatcagatcccttcacaaggacactcactgtcctggagagaaaacatctggggagagccaacgtaatagattgcagtactatgtaatctcgggtaatttaacccaaagtcatgcttacttggtaaaaaacacaaacaaatgcagttctaagtatgatcccacaagaaagcttggtctgcatatcttttgggaaatctaccaaaataagactttttaacaagattggaaaaagtaattgagtaaaaatgatcttaaatgtcgaactccatgttaatattctgagttgatgaccacaaattatcatgaggaggtaggagtacaataaaagtcttatatttcagtctttaaaatatttattattttcttttatttaattttgtaagttttgtgtatttaacttttttatcccatgatgttgaccaattcaatgcaggttcttagtcttgaaaatttcagactcttaattaatcatgctagtgaaaggattcagaaatattggtaggtggaaagaaaaaataataaatgcaaactaaacctaacatactaacaaaaaagaacactattgaatgcattatgtctggttttaaaggattactctgaaagtatgttaaatgaaggatcagttctatctactatctaatatggatgcttgaattgagagaaaatgacaaatgataaaaatctgtcgtgctttcttttgcaaggcaattcaagaatatgttatttttacaaaatattctttaatatttttgaatttcagagagtattgctattcgctatgaaaattaacaacaaagctttaaggagtctgccattgtatttggtaatttacttcagaatctgttgcccttacgtattcagaaaatgtaaaatcttataaaaattatttggtgcaaaaaaaagctttgaaactaccctatactatctatgtacttaaataataatatttctaattccaaatagaaatctctgtctcccaaacattaacacattatgccaaggctttgataacaatggacgaagcaggtggctccacagtggacacaggtaagaaggtgtaagaacagtctccatttgatccaggtgggaagcaggcctctgtgtgtctctaatctgaaccatggtcatctgaatgaggaaggactgatacaggtggatcttactgtagttgtgtctcctttgcctgatgctgtgagatcggagcccataaaattggaagtaagtatattacttgtatgacatgggaagataatcatggaaatggaagtgtttgtgtccttggaagtcagtgtttgtggggttggatggagagtgtgatcctgttgtttgtagatcatttgaggactttggagcctgggcaaagaaaaagagatgtccacaggatggcagtagcgcacacaacttttactgggtgaagctttgacaggtttgccggtagttcctgagcaagagtctgtctataggccaaggggccaaggttgttattcagaaggggaggaggaagaaatttgctgtataaggggcttatgtgtctaggtgttgtcacacagcagtgttggggtgatcagacccaacaccaggtcatggggatgaccaagtctggtggagtcaaaggattgagaaaagacagtttgagaagtaaagtgggaccagggggccatcgtgatcatggaggctgtgaaggccccgagctctgggagcccagtgctatttattggttatccaacaaagaaaaaggtggtgagaatgtggaggtcaaaagggcgcgttgcattaggcacaagatttatagctgtgatggtttagcattcgctctgctacttgagataatggagagcaggttcctttaactcaagatacaatcgaacctgggagagcaaggagcaaggagccagcaagtgtagacacattccagagccatgaaccctggattctatccaagccatgagggattttatgccctgggcttagattacggtgtgtcagggtagccttccaccctttatagcacagagcttggtgttccaaacgccacaatgggttttagaccctggaccccagacatgttccaagactgttttacattatgtcagacatgcaagccctgcttaagcttctcccaacactcagcttttcccaatacagcagcacaatggggagtctctaggtcagagagaaccagagggaaatattagtctggggttttcataacctggggcttacctatttctagcagatgtgagcaaggttctctgagatacataatgtaagcattctttacatggcaaaaaatctgctttggggggctgtttttgaaatgattggattgtaaagtttgagtttggcacaggccatagagaaataagctgcaatttggaaacaaacaacatatgggcagttcacacaagacacctttggctcacttatacatcattgttgcacattttgtagactttgttctaaagactatattagtgcagatagacaaaatccacactgctatggatgagactgaagacacgctgcagtcttttccccacctggacctcaatggaggtttttaaattttttgttaaagttgaaagtttgtccttggtgagaaccgagaccaagccacccacagagggagcttcactttgtgaagctgcaggtcctctgcgctggatttctggcttccagggcacgtgagattgaagttgtctgcattatctcatcagctgaaaattgtgaccaactggagcacagattcatggataaatatccaggtacacagagaacacagggaatgagggctctgtggataggtatcttctgcttctgagaatctctctaaacactgggagacacagggatatttacatatttgacctttctgaatcttcagaccctgttcttgatcagcctaatctgagcctgtttccaaatgtttcaattgattgtcctctttcttagaaaaaaacagaaaaaaaatgatataaagtatacactgagatatgagattagctagtggagtcctgtgcttccagggatgcttttcctccatgcatgttcatctttctgtggggcccatctcacccccatcagactgcacaaagtgaggcagtgattttgttgcatccctaagcattctgtgtcccttacattctttattccctctaagattccttctcagttctgacccttaaataaagggatctctgtccttgaaataaggtctccaaaaaaccacagcttccctgggtgtttataaggtttttacattgttgagctgctattctgaccactattaagaattaatttctattccaagcaaattacctttattaaatctcaaaaccacatgccagctataaaagcttgctcttttttggaagcatactcaagaatataattgcccagtaaatatttcctttaatttaacaagttaatcagcagatttcttctttttcttttgtcttagataattttggtgcagtcgagctccccagtaagttgtttaatataaattcccataattgggtttaaatttcttctagggctgctatattccatcctacgcaagaatcaaataatctttgagttttggagttcactagtttccaaagcaagaataggaaacatgtgtaagagctgcctaaataagtaactaacaagtcatcctagcctccagctatttgtaaactttgtgatttcatcagacgactgttctagggaaaacaaaattatttattttattctattctatttaattgtcatttactactaatatttcattttttggttggcataagggtaattttagaagagctaacatgtacatttctaaaagtactaaaaggtgaggccaattgtccttcaaggagcacttaaactttggattattctctctcggccaagaaaagccaagatagatgttgacatggtttggatatttatcccactcaaatctcatgttgaaatataattcccaatgttgaagatggggcctggtgggaggtttgggggtcatgggggtgcatccctcatggtttagtactgtcatgatgatgagtactttgtgagatctggttgtttaaacacatgtggtacctcacgccactccccacctgccttgttcccacttaagccatgggatatgcctgctcctgcttcaccttctgtcataagtaaaacttccctcaggcctccccagaagccaagcagatgcccacaccatgtgtgcacagcctgcagaactgtaagccaattgaacacctttcctttataaattacccagtctcacgtttccctgattccaaaagtgaagtttatactatgctactgctaccacattagaggcaattcaccatttccacctgctagtgcagagcttgtgttattatttaagactaagaatggccactgaataattcattcagcccgtggctctttcatgttctgaattttggatttttggtaacttggtatggaattaaatggttgaaagaatacttttgttaattttggaaatcaacagaagttatttagtttggtcttttattcttccttgggatcttaaaatagccttattcaaaatctgtaaaagccctggcccccattcatacagaagaagagcccgtgccccttactgaggcctcatggcctccttaactcaaaggctctccagccacctccacctgagtttggtgtggatgcatcctctgggcaccacagctgctcctgccacactgagaggctgagcctttttggaaggtttgtgtttggggccttcacactgtgcagggccccggtgagtgtcctgctcacaggagtctgtgcactgtctctaggctccacactgacaattatgcaagtgaaatcaatccaattttggttaaatgtgtgcatgtgtattcaacttgttttgctacaaagcggcctgagttttctggctgttctgctacctgtatttgttaggcatctgcacaccagcagaaagaatcaagatgagctttcattgagcctttcctctggcaagatgtggctcagagcccactgcatcctcctttctgctgttgttctgccctgccgaggctcttgcagctgaaggggcctttaaatatgtcacatattcttccattgttaaatgtgagataatttgttttgctctgcaggaaagcttcattcacttgaagaaggagattaaagatttctaaagcaggatgctaatcttttgatctttgtgcaattttgttattaaagctgtctctttctgagagtaaaagaggtataatttgatttaaaagtttccagctttaacatctgtcaatgtaagccttccaaagaaaattctggcactgctcaagtcaactaaatattttcttatgaaccatcagttttgctccatgtaattttccaaataatccccacaatccaaaacacacacacctcttagaagacaactaaggagatatccacaaggcttttgtatcattatttctaaagatgaggagttagagacaacctgggtatctattaccaggaacataggttaaatgtagttgacatcttgactggatcatcaggcagcaacgagaagtaatagacaagtttcacccttaacaacactgaaatattttaactcatacatctcagtagaaaaacagtgagcataatgacatatttcacaggatgatatttacataaaataaacataattgtgaacatacgatatgtataacacattgaatggaaaatatactaaaaatacaaaacaataagcagagagaaatgttcacttctctagccccacaccagcctctccttctcccctggcttctcctagcctagagctgtccatcagcacagggaaggaatattatgtgcaggccccaagcactctgagctcaggaaccagctttttgaggaaggcctggatatgccaggcattcagctcctggcaacctggaagctatggaaaatcatagcacctctttccagggaaaagaagcaccaaacttcagccagtttgttaccaggcaactgagaaagagccctggggtattttctgacaacctgtgaattatttggcctccacccccttaagagaacctaaggaataacagtccatttctaaccttcttctctgcctccttctattagaacctaattcaatcatgcaccaagacaagtcaaagccttggtgggcatatcaatcctgatgtgtgacattttattcacttttttattctgaaagtaagtatcttcttaaattttgcatctatattataaatcaatgtaatatatgtatttatacagaaataaatataactttgttgttataatgcatgactttaaattgtgataaattgagcaggaacatttaaaaccagcaatgggtgcaccactccatggctccttccccactgcagagcccgagagtgaggaaactcaggctctacctccatgtccctgcagggctgagcactgacctgctcattgctgagaactttgagtgaccagagtgggtctgaggaacacagagcagcaggtgccagggagacaggcggtggagctaggccacagtggaggaacatttggtgcccagagcttcctgtgggcaggtccttcccataggggatcctgtcagacagagcagcacctgaggtcagtggctgtgtggtcacaggatgaaagccctccacagcctattggcagcctcccctctgactggagccatgtgggacctatcggcccagctttcacgactcacacagctgctggaaccctgttcacaatggggttccttgatcagcttcactgctgatggccagagtgatatctgtccaggcagttgaaccctgacccgggcaggtgttgcatccacagagaaccaggagccaacaggagctcagagctgggcctgttttctgctggagccaagctaaaatagaacgctcttaacactctggccggccctacagatgacagtggccttctctctggggacataggaaaaggggtaagagatggagtgcacacaacatacccactggcatctatgttgggaacaaacatgaacatccccaagtattaataccaaacaagtagttcattcagtttgatgaagttctgatcagaaagcaaaacaggctaaccacttcatcttcaaggagacattctagtagaaaatgcagacaaataggatgaagcctgcatcttccttcctcactagagaatcagaacagcaggaggaacaggaacaaagctgggtgcccatgtccatggggagcctccggaggccgattctgcttggagctggcaaggatggtgtagtagtccactgggactcccacaccaaaatggatatggctggacaacttaaactgcagaaattaatttttatatttctggtggctggaaattgcaagatcaaagtccaacaaggttcactttctggtaaggaccttcttcctggtttggagatagccaccgtgggtagaaagttgagttaggggcaagagggaggagagagagagagagaaaaggagagctctctggtttctattcttataagaacattaattctattggatcatggtcccatccttttgacctcatttagcctcaattacctcaatcatctcctacagctgcataaggggaatagggccaggcttgcattctcagatcacagagcaaagaggggtttccccacaagacagcacgctggaagctcctcctgggtgctccaggtcacacatgagaccccatttcagccttaggggctccatgttgataagcagacatcatcacccttacaatgcaagtaatatttttagatcatggcaatctctttggtttattgtggggtttgtttgccatctagaggcaggtctttgacatagcaacgttcaggatttttgactttgtgctagtgaaaattaatattttttcttttttttattattatactttaagttttagggtacatgtgcacattgaaaattaattattaaacataaataatgaattaaacttaatacattgattgtttaagaaaaacccaaaggccatcgaagggcttaaaatgggtataaagggataaaaagacagagtccttccaaaggaggactgtctgtcacagatgagtctttttttatcaaatgactttttagcagtaattctcaatggtaaatgacaacttcaggtagactgccacaatataatcacatattcaaaaaaattattaccaggaatcgtgtaaatacattttcagattaaaaacaacaaaaagtgtgagtttttcacaagattcacttggtgaaaaatttcacaaacctgtgctttacacaaaagaacatctatccctggtggaaaactggagttttctttggcctttagaagaaaacagctttcccttcactctgctccacctcatgctgctgaggatggccgtgggggcagagactgtgaggaaggaggaaggctgtgcgctgagggtggtcgtggttcctgcccacctgagtgacctcatggagcagagccaccgacaccaccaaggccacctgcctgcctctacactgccatggcacagacagagaaaccttgtcacattcaatccaccatattttgaagcttctttgtaatacatttgattatgctctgattctctttgtatccctttccgtatttggaatcacttatttttcaccattttgacttgagagtatcgccccttgaggtatcagcaccatgtaggctgtatgtttgtttggtttttaaaggtgtccaaccaccttgagtggtttgggccttttcccctgtctcacatcaaagcagaatcttaggtcactaggtgctgtcaatcacttgatggccaaagatggtgatgacagtggttagttcctgcccttgctacttatgcttgtcttctctccctgcattctgtaataacttttaagctccatgatgaattaattagcattttaaacagtgtattaagtgtcttatgtttcttattttcacagtttcagtctgcttgatttctatataaatattgcaatgtctactaaacccaacagaaatggcgcttcggaattttaattgcacttgccatgaaatccattatcttagagtagaaaatcatctcaaatatactttaaaccttaaatctgaagcaggagcttcttgttctgttgcttcaatcattttgtgtctatcacacaatattgtaatatgtaactgacatagctcatcattgagcttgatagaatattataacactagaacactattttacatggaatctattgaaataataaattttctatgtttttacaactaaaacatatgatccagattcattttctggtaatgatgatatcataagtaaataatacatttttgtaacatttgaaaccttttattatgatgacatagtactaaatttatcatccctaaaatagtacttagaataaatacttttacaattagaatttggttgaggaaaaaaaaacctctcatataattctgcatttttcctgtggcatatttagtaaactctgtgtttttcatctttcagtttatgctgctttttttttttttgacagagtttcgccttgtagcccaggctggagtgcagtggcactatctccagctcactgcaacctccacctcccaggttcaagtgattttcctgcatcggcctcccaactagccaggattacaggtgtgtgccaccacaccctggctaattttgtattttcagtagagaccgggtttcaccatgttggtcaggctggtctcgaactcctgacctcaggtgatccatccacctcggcctcccaaagtgctgggatgacaggcgtgagccactgtacccggccagtgctgcttatttctgaagctcacttttggagttgcaagaactccctcttcactgggaaaaacgtaattgaggcaaatcaaaatcttttggcattaagatcttatatctgccatggatttacaaagtctaagaatagtcagaaatcaaacatttttttctaattattcttttccatactccccttgaggacagcttgtatagaacacgttctcccacatgacactggaaagtgcagtttagtgtgagtagtaaagtgaaatagaaagtaaggaaagtgggaaaataccaaattcgcaataattccaaatattatcaccaagtattaatttgtgtaaaataaaccccaagctggtcatttgccacatgtattccacctgtgttgtcactaaactgcatctatgttctggctgttatgctgattgagtgtactcggcaaacgtgggcaagacaggcagggtgaggatgagcctggcaactgataaagctttgaccatgtgggactgaggtgctgctgagactctcatgggccagagtcctcaacagcaagccctgccactgagttctccaacagcctcctcttctgcagactcagagtccctgctgagctactccccagacaagcagtgcaagtgagcagctgggacaccccagcagggaggtttctgtattggtctgtaccactgtgggaggaagctgtatactttgcatgcagtaataaaccccaacatcctcagcctccacccggctgattttcagtgtgaaatctgtccctgacccgctgccactgaacctatctggcactccagagaaccggttggaaacttcatagatcaggagctgtggaggctggcctggcttctgcaggtaccaatacaaataggtctttccatcactatgcaggaggctctgactagacttgcaggagatggaggccggctgtccaggggtgacggacagagagagtggagtctgggtcatcacaatatctgcactggatcctgaaattatgagagagaagtgcaaggttatgtgaaagcataatgaacaacttttgagatttgccttatggtattgatttatggctaatcttttatttttacaaatttgtattcatatcataaaaacaaactctttaaatgaaccctttattaaataggcacaagagttctttcatttctcaagatattattcagagcactgcttttaggagttttcaaatcatcatcagggcaaaatatgaattcctctccctggagcataggccatattcctttaacacatggttagaataaacacgggaatcagtggggccgccagagctcagcttcccaccccctcctcctccctcatctccttccatccttaccaggtatccagagcattagcagccccaggagctgagcagggagcctcatggtgagaagatgaactgagaagtcctgatcagtcaaggcaaggttagagctgagcttttatctcaggctcacaagggaaggtcctccctaggggacaatatgcaaatcacctggtgggtgcagtggtgtggaaagagccattgggtggggggtgaagggggtagatatgtcttctctgtgagcaatgtgatataaagtgtcccttggaggaaactaataaaacctaattcatcatagaggaggaagaaggacctgaatttgaaagtttcaatcttgggcaagtaacgttttataggatgtcagggcttccaaattcttgtcaactctgagggtgaacccgtgtctccccctggcctgtatgtggcacagccacagccatgacaccacagttcaaaatgagattctctatgtaggaagagcaagaactggatccctggttttaagtctcagggtcagcagtactatggacgacattttcctaggtttttattgaaagatgatcacaggtcaggcatatgaatctaccacacaactcatcgttacaataggaaaacaacttgagtattcttcatttgtcagtgatgtgcttaatattgaatttagctgctcctgaataacggtgcgtacatcaaatcacttcacagagactgccactgtcctgaaaaaaacaacaaaaatcctgggagcaattaaaagaatagtttctagtgctatgtaatcttcagtgatttaatacaacatctgatttacttggtaaagaacacacacccagaaaagcaaaacagagctctaggtgttttgcacacaaagcttgtcctgattatcttccgggaaatgcactggcatatgatgttttaacaaagttggtgaaaaaaattgagtaaaaatgatattgaccttaaaacgttgaacgtcatggcagtaacctaaattgagaatatcaaattgtagtgtggaagtaggattagaataaatgtatcatatttcactatttaaatttttatttattctattctttcatcactttttgtaaatcttatgtgtttcactttttttttttcttgagacagtctctgtctgttactcaggctggagtgtagtggtgcaatctctgctcacagcaacctctgcctcctgggttcaagcagttctcatgtctttggagtagatgggactacaggcattctccaccatgcccaactaatttctgtatttttagtagagacgaggtttccacatgtcggccaggcttgtctcgaactcctggcctcaagcgatccacctgccttggcctctgaaagtgctgggattacaggagtgagccacggtgcctggcattgacttcttttttcttgtgatgctgagcaggtcaaatatggttcttagccttggaaatgtcaaactcctaattcatcataatagttaaaagagtcagaaacatcagatgctgaaaagaaaaataaaagtaaagacacaatctaaaagagaacattaaggtacatcttatcactggtataaacggattagtctgaaaaggtgttaactgaataatcagttccacccactatcctatatagaaacttgcattgtgggaaaacgaataacagtaataaatctgtcaagcttgcttttactattagtcaattcttcaaaatcttagttttacaaagtattctttaaggtgctgaatttcagagagtactgctgtttcctttgaaaattaatgacagagctttaaaaagtttacgattgggattggttgttttatctcataatctcttgtcattacatatctgaaaatgtaaaaccttgtaaaaaattgtttcaatcataaaaaggctctgaaattaccctatactaaaggccttgaaattaccctacattattaaacttagagaataatattcttaattctaaagaggaacccctctctcctgaaggtttaaatagagtacacagaggcttcacaacagcagacaaagctggtcgctccatgctggacacagttaaaaaggtagaagaacagcctctatttgattcaattgtggagcggcctctgtatttctcgaatctggaccatgatcagtcgaatgaggaaggactcatccgggtggggtttattgcatctcacttgccagatgctgttagtttgcagtccataaaattgaaggcaagtgtattatttgtatgacttgagaagacagcctcggaggtggaattgtgtccattatgctggagtcagtgtttgtggggtggatagtgtggtcctgtttatagagagtttgaaaaattgaggttctgatcaaacagaaagagatgtccatagggtggcagtagcacacatgactgttgttgggtgaagctttgacagatttgcccaaaggagtccctcacagcaggagactgtctagaatgaaagatgttggggctgctactcagaaaaggtggagaacaagggaaatcctaaggtaaaggaacactggagaaaggcattctctgtctaggggtagccagacaacagcttaatctgggtctgagatatccagagggcaggagtgatttgcaattttcatctcctggggcttatcttacctactgctaacagatgtgggtgaggtttcctgtgatatgaaaagcaagcattctctgaatggctaaaaatcttctttcgggctgggcgcagtggctcacgcctgtaatcccagcactttgggaggccaaggtgggcagatcatgaggtcaggagatggagaccatcctggctaacatggtgaaaccccatatctactaaatatacaaaaaaattagccaggtgtggtggcaggcgcctgtagtcccagatactcaggaggctgaggcagggtaatcgcttgaacccgggaggcagaggtggcagtgagcagagatcgtgcaactgcactctagcctgggcaacagagcaagactcggtctcaaaaaaaaaaaaataatctttgggctgtttttgaaatgattggattggaaaacttgagtgtggcacaggccatttagaaatagcctgcagtttagaaacacaccacataggggcagtttgcactggccatctttagctcatttctacaacactgtcacacattctgtaaacttttttctgccgactgtacttgtccaaacagggaaactcacactgttctggaggagattgagacatacagaggcctgttctccacctggacctcaatggaggtttttcctgactaaaagtgagagtttgcccctgtgtaagaggcgggcggatcacgaggtcaggagatggagaccatcctggctaacacggtgaaaccctgtctctactacaaatacaaaagattagccaggcgtggtggcgggcgcctgtagtcccagctactctggaggctgaggcaagagaatggcttgaacctgggaggcggagattacagtgagcggagatggcgccaccatactccagactgggcgacagagcgagactccgtctcaaaaaaaaaaaaaaaaaaaaaaaaaaaagaccaagtcacctacaaagggagcttcagtctctgacgctgcaggtcctgtgactagattcctggctccagacacctgagattgaagctgtctgcattatctcactaactgaaaattgtcaccactggggcatagattcatggataaatattctggtacacagagagctcagggaatgaaggcttcttgtacgtctatatcttgtgcttctgagaatttctctctctaaaaactggagaaaacagagttgtttacatgtttgacctggaaggcaacatgtaacatgtttctgagtcttcagaccctcttctaacctgccaaatctgaaactgtttctaaacgtttggattatttgtctttccttttgcttaaaaaaaaatggaaaaaagtcctataaaacaacagactgagctgtgagattcagtgctggagttttccttcatgcatgttaatctttctgcagagcccacctcaccaaacatcaatacaaaaagcgaaacaataattccattgcctccctgggccttctgcatcttataagttccctcgaaattctcacccttatagaaagtaggtctctataaaaccactcctcaaaagtaggtttctagaaaatcacaacttgcctggaaggttattaattttttccaccatgtgaacatgaaagttgtctttttgactttatattaaagcttggtttaattgagaggtggagggtggagaccccaagaagattctggggacggaatcgggaatttgagccttttaaactgcagtggaaactgcctgtgatgtaaaaatttgtatgaatataccaagaagacaaataaatttgtttcttactttttaatttagagagcatggttcacctacagaaaaattaaaattataatttgagaattttgacatttattactcctcattttatattaattttaagatcaacaaaatactcatataaattttgaatgcagaaatgttaagaccttcaggaaaaaatcagagacaaaatcaaatcacttaatttataaaatcaacagaaattctcttttagcctcttcctgtcaactcctgttcataaaaatctaaagttcagaataagaaagaggcaggggctgaacaaattacctggtgttcattccttgttataacaacaataatggtaataataacaataactgcacagcctctacatggacacctggaaatggtgactctgccttatggaagcagcagcttcatgtcatagtggtaaatttcacttttactggtcctttcttggccaggagtcaacgatcacccaaagttcacatgtgctatgaagcattaactgtgctcaaatttcagtacttctccaaatttgtttttctaaaatatatcctagcaagaaaagaatgcaagatcagtaataaaataaaattaaataaaataaattttaacctcctagaagcagtcagggcatgaaattataaagtgtaacaaaggactatagatatgaccgtgtcttagagacttactttaccagctcttactcctatttaatgttcttaccctagaaaatgaagaatatcgtcaacccagaaaatgactttttgtattgtgaaatcctagcagtcctaggtagaatttaaagcctaatatgagaatctctgttatccgcttatcccagaaaatctgattgcacaaaaagtgtctatatttagcacattaaaacagaaaacctattgatcctgtggaatactgtagcaaatatgtgcaagtttatgatactcatgaatagacttttaaacttgagcaacatcttttgtttccaggttgatgctaaggtattaaatttcagtaaaagtaatttgtcttgagctcaaactagcttataatatttgtcattacatacagttcagcctattcagaactggtaagaaaatatgacatcatgagaaaactgttattaaatttgccccaatattaatatttgcagagagactgagaggcatgatttgcacaaccgtattcaagatattaaaatgtttaatggaataggcaaatccataaaagaaataaaaactttagaccagggttaatatacctatcgagaatttgacttgtgtagcctactgagttattgacaggactgggtaagagttggtgcactagaagtcaggacatcacagtgtcaacttttaccccttcctcattagaaagccaggccagaaactgccctgacacaaggaaaattatcagaaaattcctggagaactctttgtgactgcctggtcatactctggctatggttgggaggctgacctctcccagctggtattgcactgcagctcatatttctgggtactcagctctatagctgccatcaaatggcattaaatggtttacccaaatcaataaggttatgatagtatgtgcttcataaacttggagagaatcagagttcctgatgataggtatatgtattccgttccattctgtttcatgagagtctttatttaaaaaaatgaaggaagctcacagcggcctttttggaatctagaggcaacagattctacaccgtggaatactggtcatgtcaccatccaggtgacatggaagtcttcccagcctttagtggagacccagggcagaaaagggctctgcagcagctccagcctgcactgtaggcaacagtgtctcttgggcccatgcagatacagatgacttgccaaagccgtcaaccatgtgggtaggattgacactgagagaacactctgccacaacagcagactccatagccattttaaaacattagctaagagagatcatgctttgagccacaagctatttcaaagaaattaaatggatttaaatcatataaaataaagtttcagaagccaagggaaatttattaggaatcaatgacagaaagctatcagaaaaaaatctcaatattttaaaactatgtaacatactactaaacaaagcctgggacaaagatgaaaccaagagatggacatttcaaagcaatctgaagtgaaagaaaacacatatcaaaatttgtgggatgcaagaagacatttaatttataacaccgaatttctagaaatattcatgcattttagcaaataaattttcaaaccgatcccctgagctgccaccctgacatacgagtatgagaagagcaatttgtgctcaaaatattttattcttaaaaatgtgggcatgtgatgagcacatgtctattattgcagcaaggaaatcacgtcagcctggaaataaaaacccacattagcagcttcacaggagaaagtggatgggcagggtaagtaagtgtgcagagaaaattggaagaagataggaaaagtgaaaataggaattgtgtgtaatattaatacaggctatgcatgtgtgagactcctgtgagctttgacttgctcaaaagcaaaaatcatgcagtgcagacaactttcaatcctcagagtgttggtgagagtgaggtcatttggcaaagggaggaaaaagtgccccgaagttcatcagaggcagcaggtgaggtcacgacccacaaggatcccctcccagtgacgtgaacgagcatccctgaagccatgagggcagcagggaacttcatggttgctccagagaggacatggcagccactccctggagagtctgtggggcctgaacaccctaagttgggaggaaggaagaggctctgggaggcttcctgggggccctggccctgttcgcacagaagtagagcccatgcctgtaagtgaggactcatgacctcctcttcaaaggctctccagccatcttcacctgagcccatctgctgtggactccatctctgggcgctgcagttgctggtgctgcactgagaggctgagcctcctagggaggctgcgtttgaggccctcgggctgtgcagggtcctggtgagttttctgctcacaggagaacgtgcagcatctccaggctccaaactggtgcctgtgatgaagaaatgaataaaattttgattgtatgtgtgtccttactttttggtatgtgtaaaaatatactctggagacttgttattaattttgtcttatacaccacttgctataaaccaaatttttactgtatatgttgtctgtctggttaaaactacagatttaattatgcttgtcatggaatacattatctttaatagaaaattatctcgaatgtaacatatttctttaatctaaatctggattactttatcctgttgattgcaacattgttttactttagtcataccacgctatagcacgtaaatcacaggctcattactaattcacaaatattcatagagaactattttaaattgactctatggaaagcatacattttttatatcactattgttagaatgtgggaatcaggtttatgtccaagtactgacgaggtacagtgaaaataatacattaatttattgtttaaaaatgttttactttttttgaccaaatagtaccaacatagtcacttctaaaactttatttgtgtttaaaaaaaaaatgaaaggaatcttcattcccaggtacagcaatgtagatagaagtggaaaggccaaaacaaccactgcaaaaggtacaaaccatttaaaataatagaataccaaagttagaattaaatgactttggaaagtagtggaaggaataaggaatgaacgatgtaaaatgccatagtaaaaagaacctttcattgttgagctgatgctcacctgactttttgtccttctgccatagccgccaagtttgcctgtggaaacaagctctgacttggtgcaggcagaggagctctcctgggaaaggagaatccagctgagccttgggggttgcacagggcagcctctatacgtggcccgtgctttccatgggacacatgttgaggtctgagtcagcaggcagggatggaggtgctgggctacaaggacataaaacttccacagattcagcgtgctcccccaatccccaaggctacacagagcatcccgaatacatgtctgaatcatggacactggtctccatccccactgcgccccctgctggtgtagaccctgctgggccttctgctcagcatgtcagtgcttgtgacatctccagacccaaccagcagtctctagggacagaatgagtttcagatgctctgcttggctgtgtggggttgacaagatatgagtgacatgacctcaggtctccttgcacagggatttcactaagcctttggtgattacagatctaaaacccttcccaaagcattattttcccagaaaattcgcagtgatgcaggctccacccaggaaaccaggtagtggtgccttcaactctgtgattcttcacaagaaacacatcaggcctcctgggtccacatcatgaactgccaactccaccaccatccacatccctacctaccaaaggccaagggtagtttaattgaagctgacctctcctgggtttccttcatgctttcatccctaatgtctgcccaatcttaaattcttaacatttggaaataaaaacattcacatcattctgtacttttccagttttctatggggaaaattatatactctacattttccagtatatgctttttatttttgaaaacaacttctggaatttcaggtactccttttttctatcattaagaggtaactaaggctaactaaacagttttagcattaggatcttgtatcttctatgaatttacaaaaatctatttgatactccaaaatcaagatttttactgactgtcctcagccagcttccgcttaggataactggtatagaatgctgtctctactctattttgggagtgggagaaaaggagaagcaggaagttagaaaactggcaaaataccaacatcaaatattatcaaatgtcctctgaacaatatgccaaaaactgctaaacccaaagatgtatcccacatggatagtcacaatctgtgtcaatggcctggctgctctgctgattacatttaattaacaaatggacacaaggtagggagagttagggtgagctttcattctcctctcccttccatcttgcttgtttactcacagggcacttggacccctcattctcctgctgcttatgacagtcaaggtggtggcaactggcagggcataaaggagtggtgcctgaggtgtgactgggctctcaaagtccagagtcctcagctgtgaattgttccctggttctccagcatcttcctcttacacagattctgagaccctgctgagctgctccccagacaagcaccacatgtgggcagctgggccaccccacagggaggtttttgttcagggctgtaccactgtgggaggccagtgtgtaccttgcatgcagtaataaaccccaacatcctcagcctccaccctgctgattttcagtgtgaaatcagtgcctgacccactgccgctgaatctgtctgggaccccagagtcccagttagaaaccttataaattaggcgccttggagattggcctggcctctgctgaaaccaattcaagtaggtgtttccatcactgtatacgaggctttgactagacctgcaggagatggaggccggctgtccaagggtgacgggcagggagagtggagactgagtcatcacaacatccccactggatcctgaaataaatagaaagaagagcaaggttatgtataaagtttatgtgtaattttcataaattttgatttgttgtttatctcaggctatatatgtatttgttcatatttcaaaaatatacagtttcaaaatggaactcaagggatccaaggctcaaaggggtctccagaagaccccacaccatcccctttctgtgtcagtcttccccagagcacagatccttgtttcttcttgaatcttcctgactctcacagatctgatcatcacatgccccattctggaggacaacatgtgcatgtccaatacaggaaaggaacacacataggagtgtagtgagacccccagagatcactgttgttagaggcagtggggccccagaactcaccgttccatgccattctcctccctcatctcccttctacccttacctgggacccagagcattagcagccccaggagctgagcagggagcctcattgtgagaaggtgaactgaggagtcctgatcagtcaaggcaaggttagagctgagcttttatctcagactcacaaggaaagtcttcaccaagggataatatgcaaatcacctggtgggtgtagtggggtggaaagagccaaggggagggtaggagcctctgttgtgagcaaaatgacttaaatatcttctctgtttggagggaaatgagtaggcatataatctatgctgtctatgtgggagaaatttaagtatttccttctgtcttccctaacagatttcttgtttcatagcactttcccaggcacattttatacttcttgttaataaggccatgtttccacaaatatttactaattcttatgtttttgttcatttttgtttaaaagagttcagatttggccctttcaattttttaaaaatttaaataaaacacacacaaagtaaaagacagaaatgttaaaaagtgcaaccgaataaagttttacatatattctccaccgagattaaactgtagaatactgcagaatctccagattcttccctcatgtacctacctttcaggaaacagctgttccccccatcccaatcaaggaaactggcattctgacatctgtccaaatagattggctttccctacatgaaacctcatataaacggaagtaaacatgttggtttggtctagctctttttttgttcccttagcacttttgaggccttccttcctccctacagattcaagttactgtctgctgtcattttttgtgaatctgaagaacttcctagagaatttgttatacagcatgtctttaagtaattatttctcttcatttttgtttatcaagaaatgtttttactttacttttattttgaatgcatactttcactggatattgaatcctaggttttgttttcttttgtttcccagcatttacatatgtcattccactgttttctagcctcctttggtcatgatgaaaagttagctgatggctttatcactgtatttctgtatatagagagtcattttatttttgtacatttgcgatttcctccttgtcattggttcagcattttaattataatatgtatagttatgtgtatcattgtgtttgtcctgaataagttctttcaatttcttttctctatagatgaatgagtttcattgcttcttgaaagcttttgtcatccctccaaaatttttttggccactttttctgacttctcgtttctgactcattgcatatttctggtcttcttcacattgacttgtaaacctctaaggtcatgattatttttctttagtcgttttctttctttttcagattagatcatttctactaaattgtcttcaggctcattgatgcttctgccaacttaaactcctgttgccctatctagtgaattttccatactgctttttatagttttcatctagaattcctatttgttcctttcccatagtttccctttctctgttgagagttctcattctttgagtaattgtctttatattttcctttttcagtccttgctcatagttttgaatattctttgaagcatttatgtgacaaccacttaaaactcttagcaaaatccagtatttaggaacagtcaagagtcagcttccactgactgatttatctcaatatggtttatgattttctctttcttttcaggaattttaatggaaaaatgccggttgataatatattttttacgtctcacaaataatatataattctgcattctgttttatttttctaagattgttgaatttcctcttaatagcttgactggtcttatgctgcagaatctatcccttactagctgtttggcaattgatatttctgatttttttcattttaagttttagccagaagccctacctgtgtctgcacagtttggtaatcaccagtaacttaggcatttgtgttgctcaaactccttgacctcaataatctactttctgccaatgtatatgtgtgtggcttgaagcgtgcccataaaagacacctccttcacttttattcactgggcccacttgggtctctgtcactcaaatacgcaatttctaagtcacatctgctcattctaagaatgtgtgcagggatgatctctataattctatgactccatggtttccagtaatccattatcaagttttagctggtgtaccagtctcccagggtcatcaccttggacttgcaaaactctgggccttttctgggcatttcctgcagagttcagcaccattagctgaaaacactgaaggatcttgttctactctccatcccagctcaagtcaatcccgtttggcaacaagcttccagttgttgctgccatttcagctggtaaaactacagttctaaaattcttgttgacgaagcttgggtgagaaaaagcagttccaggcaaaaggccatagacttttcctatctgttagtccgaggtgcaccattttgtaagccccccttccattttgtagaccttggtcaaagtgaagcattccacgggggttagaactgtgagaaacatcctgcctaaccacgtgaatacaggaacatccctatcgtcttctgctggacagtgggcccaagaaacattcttatcacaccccgctgggcaaaaggcccaaggaacatccttggcaaaaccgcctgaccacaggaacatgttatcaacgtcctgccgggcagcaagtaataccgtctagacccctcccgcccatacctataagtaccccagcctgtaagcggcagcgggttctggtattaagctagtcccccacctccacagtcttgtgctggacataaaacctgctttgctgtagagccgccaactctctctctgtctttctttaacccttcccttcccttcaaaacctaacactgtccttacccaaagctctcatccttttcaagatacagccatatctccttttattgtgttttgctttactgtgctttatagatactgagatttttaccaattgaaggtttgtggcaactctgcctcaggtaactattttggtgccgtttttccagtggtaggttcttacttcctgtctctatgtcagtattgctcagcaatagttttaaaaaattaaggtatgtacattttttaggcataatactattgtacatttaaccgaatacaagattgtgtcaacataacttttatatgcactggaaaaccaaaaaatgagtgtgactccctttatgataatattcattttattgcagtgattggaaactagaccagcaatatctctgaggtatgcctataaacatgtctcaatttctttgatgtctttggcaatttccagaacagccacagtgacgaggtctggagcgagggtgcacttgcagtgacagtgggtctggggctgggcatgggctagtccacataaaggtggcttactgtctgagttgccagggcagggtgagacctggaggcctgggtctggggcagtgcagagggtaaggttgatgccaaggggctgggaggtagccctgtcacaggagagaaaacaatggctcctcactgcggagtgcgtatagcagcatctccctctctggggagtgtgcgactatggctgcaggtaaccgtccaggcaaaagcaccagtggcccctgtggagcaggctgctgtgatcctcgacaagaaatattaaagggcctccactgggaaagctgaatggtgggggattgcctgggtggctgctgaggttatcagcagcaaaggctgcagggtcctgccacagagcaggctatggggcccacagtggcaccacctctggctgataacaattgcttcccctttctttgttcctagaggtatcagggctctcaggtgtgccatcagcttccagccatcctttgcatgtgcttattcttggctttttactctatcatgttgctgcatgtttgtaattgaactcttcagccctcccagggtattggccttcttggataactgactaattgctgggttttgtgagggctgaagcctggtatctcttactctgctatcttgctaacatcagtccccaggacatcattttggtgatgatattttgaattttgccctgacactattatggaataatacttagacttgatggggtgagaattagagcatttaacatgtaagagggatatgaattgtttgggccacagggttgactgatgccagttatatccttcaagatggctgtcacaaggcctaccattctacaggttcctctaaaagtgtgatctctgggtggggtttccacgatgccatatgcctatctccccccacagttaatcagaattctgaatctcatattctttataatttgactttcctctctgttaatttcttctatatgtattcatcaaataatatttttaatttatttgtttaaaaccctataagaaggaattcatacaaataaaacctaattcatgaatctttgtctttgtgcctagtgctttgtgtgttctctttaagaaatttatttctgcacctgtttatgatatatgtttttatgctctttactaaaagctttattattttgccttcatatttcattttatgattcatttagagttgatatttatataatatagaggtgaaatgtagaggtcaggattcattttgatgtaatatagatatcttattgatccaatacagttcacttattatatatttttctactgatcactgctctggtctgaatgtctgcatctcatccaagattcctgtttaccccatgcaacaggattacaaagtggggcctttgggagctgattattcatgaggattccaccccggtgaatgggatgaacgcccaataaaagtggcttcacacagaatttgtctcttttgcccttccacctccacaacgtgaggacacagccacaagccaccatcttggaagctggagcagccctcatggtacaaaaagattgccagtgccttgaccttggacttcccagccttcagaactgtgagaaagtacatgtctcttgttttaaattacctgaccaagatatttttctctttcagtatgcatcatctatggtaacagtgtttttttcttttttttttttttttttttttttgagacggagtctctgtcacccaggctagagtgcagtggtgcgatcttggctcactgcaatctctgcctcccaggttaaagtgattcttctgcctcagcctcctgagtagctgggattacaggcatgtgccaccatgcctggctaatttttgtgcttttagtagagacggggtttcaccacgctggtcagactggtctcgaactcctgacctcgttatctgcccacctcagcctcccaaagtgctgggattacaggcatgagtcactgtgcctggcccgtggtaacacttttatcataaattgggtgattacatatgtgcggatctgtagttacattattaattagtgttatttgtaacagggtttgatattgcctggtgttattccttcaattttgttctttttttttttttttttttttgagacagtcttgctctgtcacccagactggagttcagtgctatgatcttggctcatttgcaacctctgccccctgggttcaagcgattctcctgtctcagcctcctaagcagctgggactacaggaatgtgcaaccatgcctggctaattttttgtatttttttagtagagtcaaggtttcaccatgttggccagggtggtctaactcctgatctcaagcgatacacttgcctcagcctctcaaagtactgggattataggcgtgagacaccatgcctgccctgttattctttttttgttttgttttgttgttgttttttgtttttgtttttttgagatagattctggctctgttccccaggctggagtgcaatggtgcgatctcagctcactgcaacctccaccacccaggttcaaatgattctcctgcctcagcctcctgagtagctgggattacaggcatgtgccaccacacctgactaattttgtatttttagtagagatggggtttctccatgttggtcaggctagtctcaacctcctgacctcaggtgacctgcccacctcagcctcccaaattactgggattacaggagtgatccaccacgcccagcctgacctgttattcttatgcaagattccaatggctatttttgtcctttttaaatgcatgtgtgatatgtatgtatctatatatatacacacacactctctatatatatattatacacatacatatcactatatatatacatacaccatatatagtgtgtgtgtatatatatatatatatagtgtgtggtatgtgagtacatatatatatatatatatatatatatatatatatatatatactatatatatatgaaacatcatttcaatttcacaaaagtcctctgggattttaattgtcactgtattgaattaattaagggagaattatgttactcacaatattaagttttataatgcatgaatgtggtataaacttctatttattgaagtctccattgttttctctcaataactaagcagccaccatagtagcttcccataagtaaacagaaggcttgaggaaaaaacaccagctgtcttgtggaggtttggtttcctgtggaatcactgtggaatacccaccactatgctgataacagtgttaaagtgcaaaatcttcatgctccagcctgctgataatgagactgaagttttccccgaacccactgccactccaccaggctgggacattggtggtcctggtggatgcaccatggatgaggagcctgagagcctgtccaggtttccactgataccctgctaaggagctgctaatagtctacttggctctgtaggtgagggtggctttttcccctagagataaagacagggaggctggagactgtcatcacaagttctctggtggtatctgaaattggaataaaaacagaaatgtcacacatgtacactacatcatacctattgtcttcccagtgcatccaggaccattgatctacattgagctttaatcattgtgccttcccagcaggtgtgccaggtaacaggactcaacaaggttgagaaagtttcactgacatgcagaaccatccgatgtttcctgcacctgggagccagagtaacaagaatcagagcagctgagctgcagcttccatggttccctctgggtcctaactgagctgctctttcacagacctacccccatggattgatatgggctctggacagcagggtggctgggagagacatgcataacagccacagatggcgctgggcttcgaaactgcagagaccacctgcctggttcaaatgattctcctgcctcagccttctgagtagctaggattacaggcacccaccactatgcccggctaatttttgtatttttagtagagacggggtttcaccatgttggccaggctggtcttgaactcctgatctcaggtgatccgcctgcctcggcctcccaaagtgctgggattacaggcctgaaccaccgtgcgcggccaccattgcttcttgaagtagatttcccagcactccttttgcctttctggtttcctaaccattatatcctctggtctttgaaaagttgtaatttagacatggatttcccatattaggaaaaactttctatttgggttacctacaatagcttctcttttgttgtatgaacctggaccagtgctgtaacccagagtcctcataggtaatgactcttctatgaaattaggagaggcattgccatgtctgctgctggggctgaggaggataaaagaaactaagggtgtagagacacttcccttaccccttctatgaaaactgctcagtgaccttcagagtgtggctgagtctgagaaacactctcagcagatggaggaaacaggagaagcagctggggcagcccaccctcacatatctgcttccttggggagcttattgggtttgtaacactgtgagagggtcacttttatactgttgaccaataataagaagttgcagcaacttcagactggaggatgctaatggtgagaatcaaatctgtcctggatccaatgccacataactgcaatgggacccaggtttgcaaattggatgcatcgtagatcaggagctcagaagctttccctggcttctctttgtatcaggctaaaacatggctaatgccctacctgactttcctggcatgtgatggtgactctcacctagacaggaagacagcgaggatggagactgggtcatctgcatgtcatatctggcacctgagatgggaaacaaaactattaacactattaaccatgttatgagaggactttcctgaatagccaggtagtactgaccacactggctcagtaaattcctagtgttctccttccttgcctgagagtcagagcagcaggagccccaggagctgagcagggaccctcatgtccatgctgtgtcttgactgggactgactcttgcaagtggtatgaccagcctgtgtacaagtcttcaggaagttggctgtgtttttttgaaaatgaaaatttcaacagatgcaagaatgactttatctgcataatattgcacaggcctagtgtcccccaggggtcctaagattgatcaggcctgcatacacttgttagcagagaacaagtttctctctgggggccacagaacagaatctgtctactgtcctgcaaggagattgcttttctgctctgcagaagtaggtcatgacctacttttcttgctagcttcccgtctaagacctggcttgttggagaagcacatctccagaatctgcaataaattttagaagtgtcctgcgtttggtactgatgaatattattgaggccacagagacttcttctttgctctgatcctctagagcccttgatgttgtaaatcatcagcactatcagccagagatgcaatgatgaggtataagaaagatggatggatacatagatggatggatagaaggacagatttatttattaaaaataagaaaaaggaaaatgttaacacaaaatatgtgaaagtagtgtaatgctttgcaaggattgggtaatccttgtacactgggtaaacgacatggcaaatctcttatctcagacatgtgatcatcttcctgtatttctacattttctttcctacttcttacatctaggccaacatcagaaatcttctccctccacttctgaaaagtgtcagctactctctacctctgtgtgccatcatgcattcctatgctagatgtttcctgagctccttggattaatatgtgtgccttacgtcattcttaagctaatatcttccggaaactgagatgttatctagacccagtgctcacatctactcttgaatctactctgttccataaactgtatatctctatattaccaatctcttccagtttttaagagaaagcagttcttaatgactgggtttagggcatttgaccaaagtaggttcagaaagaaaaccatgcaccaaaatgaaggggaaaccaaaatattgcacagagtgtgaaacccacatggcatggaaagggcagttgatgtgcagtagagagggaagaccaccagaggtgttgaagctatagtggagggaggagggtatccccacataggcgcaggatgtggggcaacatcctcccactagcacatatgtcacagctgaagcaggatgagcagggcccttcaaaaggggtaaagccagtggtactagcaaaacggcccatgtagattgagaaggtcacccatgcaggagtcaaagttaacagtgagctggcaaagcatatcagggctaatgcaggttgtgaggcagaagagggaagttgtctaaaaggagcgtgtaggtggcaatgacagcaggagattagtgtcacaaagagatgttgatcccataagtcagtgtagtaaggataattagagccaaggtacccagggagaaatgttagaaatattttaaaagcgcgtactagaataaactctatgactctggattatagctatatcagtgccaattcatggtttatgtagatataggtaaaaagatagatgaatagatgatgatgatagatagacaaatgatagataatagatagctcattttctctagaagcgatgacacatcagtcccactgaacacatttagtgtgtagatcttatttttctgaatgccgatttctactaaaaggaatcagtaatctttggagaaatggctgatgtcaggtctaaaataggggagatggaagatgagcttgtaccatctagtgccagaaactaaaaaagtgctcagagaatgatgggataaaaacagcaggtattcagaggcagtgtgaatgaggctcccattggacaaatcagaggagggttgactatgaaaataaatgatgatggtagcagagtataacccattgaagaaaatatggatccatgtctatatttcgattaggagagggatattcatgaagtatcaagaacatctccacaaattcttatctctttcaaacagaacaacagtgaaggtgcagggagaagcctggcagacacccccttcagcaggagtcagactgaacctcgtcagtcatgtggcagatggaaatcacacacatcccaataggattcagtgagagcacagtatcgcttctggatattcccgcaacagttacactaacagagttcaatcctgaagaaaattcaaacaaatttaaattgacaatctacatggtaactggtgtgtaatcttcaaaagcaatgtgttcataaagtccaaacaaggacactggaactgttctagatggaagaaaactacggaggtacaggccagcaaaggcaacccgtgaatcattttgttacaaaagacattattggaacaattaacaaaagttgaaatacacttgaggattagatggagtgatgcaccagtgatgattccctggttccacagatgtattgggttatgtaggaaaatgtcttgtctgaaggaaatacatagcaaagtcttaaagggtggaactatgaggtcatcaagttactctcaatggtttagggggaaatgtgttactttgtactctacttacaaactttctgtaaatgtgaaattgtttcaatattttaaaaataaaaatggcagctcttaagagcatacccaagctattctaaggtattttgtgatggcactgagccacacctgttacaatcataagacatggaaatttactgtagacgcacaaagataacactgtgctttctcaaaggtgtgtagttcacagacaaattattatctgaagacacaggtctctttagtatccatcaactaaatgggcatcctattcttggtttggggacctacatagtctacccctcacgacaaatgtaacttgtttgttttgttttgtttgagactgggtcctgctctgtcccctacactggagtgcagtggcaagatcacagcttactccaacctcaaccccttgggcttaaacaatcctcttgtctcagcctccccagtagctagaaccacaggcgtgtgccacggcatctggctaattttttcatttcttgtggagatggggtctcactatgttgcctaggttagtctcaaattcctgggctcaagtaatcctccagtctcagcctttcaaatgctggcattataggtgtgagccactgtgcctagacccatgtaactttatttctctcagctcatcagcatgaaagttctgactgaggatgccaaacctgattatcaaaaaaacaaaaatcaaatcaaatacagtttctttcatcaaccaaataggatagctgtgaaactgaagcctgaattaggataaatgtacaaccttaaataccccagaaccactcaggatcaattctcttcaaagtaggatgaagacaagatcacatcacctggggaattgctccgagtttcacggaagacacagaggaagggaggatgaggctggagacaaagctagctctgctgcgaactcatcaaggccagggagccctcaacagcctgctggatcataaaggagccctgtcaacactgacagagcatcttggttggaggtctccaatcttgtatttcaatggagctattgagtgtctcagtaataatgcatcaatcaaagctacatgcacactcaacatgagggacctcttgctctgggccccagaagtgaagggccctcaccaggctctcctcccctccagtctttcacagagagagactgagactgtgctaatatagagccaattttcttctacatcacaccctgatacttggggtcctgaaactaccaattcaaatgttctaaccctaacttccagggacttggccccttctctgggctcgttcctctgagagtagctacgcagtaggcgttccccgctcagacacaaagtgaggccaggtttctgctgctgggaggcgggatggcatgtgaatgtgtgtgaagtgtctgtatatgtgttcaggagaacttgtgtggtgtggaaaaagcaagagatggggtaatggcagtaaagtcccaattgcaaccctaaagcacgacctgctatcctcacactaccaggtgctggtgaagaaccttgaggagcgaaaaatatttaaattcagacgtaggcttccagatattcaacctgtagccaaaagagattagaatggactaggtttacactcctctctggattaactaaaacacaggacacaatacatgaggcaaatgttttcaagaaattggacattagaaattaaggatattgagcccagaagattttaaaccaaaggagatgaaatttggaacgatccatctgagaccctgaggagagttgccagagcattgtgtagtgaaaggaaatccatgaggtgcctgggagtgtccctgaagagaggaaaaagaattggaggtccagaaagacagagaaacagaggagggagttcagagagagcccaggctatccccagatgcctccctcagtattccacagagcactgatgagtacatgcacgtggagaccctacctaaggctgcagaaagactggctgaaggattacaggaagattcctcagtctcctcttttcatgtcatgagacactgcagatgactgagaacccggtggctcccctgagcttatttgtcatgcacttttgatgacatgaaggttattcatgttggccttctctagtagattcacctggaaagcattaaatttagcaggaaaaaagggggcaaccatgccctcaatgtggagtggtcattagtattggttacaaatgtgaactgcactaagcataaagggattcattatgggatattaaatagctcaaaaattgttggaaagccttaagaacaggctccaggcaaaacctctggaacaatctcacaaactgtactgccgattcaggctgcggaggagtccttactgcctgagaccccatattcagactgcctcctgcagagaagacagctgttcctctcactacggcccacagaaggacagcatccctgccagcagctaccagagatctgactcctatcctgcagctctccctgtgttgataatatccctaaattcagtcccgttcacattcatcgtttttcatgactacatatctttttctatctccatccacccttgtggcttgacatcaccaatacacactttcccacacttgaattcctttttcacacattaaaagcaatgtattaacacctaacatattgcaaacgttgtctttacaagtaacatcaggatcacttctacctaaagaatggggacacccaagactgaaccaggaagaagttgaatccctgaatagaccaataacaagttctgaaatcgaggcagtaataaaaagcctatcaactaaaaaaaagcccaggaccagatggatttacagttcaattctaccagaggtacaaagaggagctggtaccactccttctgaaacaattccaaacacttgaaaaggagagactcctgtctaacttattttaagaggccagaatcatcttgataccaaaacctggcagagattaaaaaaaaaaaaaaaaaaaggagaaaaccttcaggccaatatccctaatgaacattgatgcaaaaatcctcaataaaatactggcaaaccatatccagccacacatcaaaaggtttatccaccacgatgaagttggcttcatccccggatgcaaggctggttcaatatacacataattcatcacataaagggaactagagacaaaacccacatgattatctcagtagatggagaaaaggtcttcgataaaattcaacatcacttcatttcaataaactacgtattgaagaaatatacttcaaaataataagagccatttatgacaaacccacagtcaatatcatactgaatggacaaaagctggaagcattccccttgaaaaccattacaagacaaggatacccctctgtcaccactcttattcaacatagtattggaagttctgaccagggcaatcagggaagagaaagaaataaagggtattcgaataggaagagagaaattcaaattatctttgtttgcagatgacatgattctgtatctagaaaatgccattgactcagcccaaaagcttcttaagctgataacttcagcaaagcctctgaatacaaaatcaatgtgcacaattgacaagcatctacacaccaacgacagacaaatagccaaattaagaatgaactcctattcacaattgcaacaaagagaataaaatacctaggataacagctaacgaggaaagtgaaagacctcttcaaggagaattacaaaccactgttcaagaaaatcagagaggacacaaacagatagaaaaacattccatgctggtggataggaagaatcaatatcgcaaaaatggccacactccccaaagcaatttatagattcaatcctattcccaataaactaccatgacattcgtcacagaattagaagaaacaatttggccgggcgtggtggctcacgtctgtagtcccagcactttgggaggccaaggcgggcggatcacgagatcaggagatcgagaccatcctggctaatacggtgaaagcccatctctactaaaaatacaaaaaatgagccaggagtggtggcaggcacctatatttccagctacccgggaggctgaggcaggagaatggcgtgaacccaggaggcggagcttgcagtgggccgagatggcaccactgcactccagcctgggtgacaaggcgagactccgtcaaaaaaaaaaaaaaaaaaattaaaaattcatatagaaccaacaaaggttgtgtagccaggacaagcctaagcaaaaagaacaaaactggagacatcatactactcaacttcaaactatgctacaaggatacactaagcaaaacaacatgctaccggtacaaaaacagacacagagaccaacggaacagaatagagaattcagaaataaaaccacacatctacagccatctgatcttcaacaaacctgataaaaagaacaaaaacaaaaacaaaaacaaaaacacaagcaatgagggaagcactccctatttaataaatggtgcagggagaattggctagccatatgcagaaaattgaaactggaccccttccttatgccttatacaaaaatgaaggcaagatggattaaagacttaatataaaaccccaaactattaaaacccaaactacttaaagtataattaaaaaaaaaaaacaaagaaaacccaccaaactacaaaaatctaggcaataccatttaggacatagacacaggaagagattttatgacaaaaatgcctacagcatttgcaacaaagcaaaaattggcaaatgagatctaattaaactaaagagcctctgaacagcaaaagaaactatcatcatagtgaacagatgacctacagaatgggagaaaatttttgcaatttattcatctgacaaagttataatatccagaatttacaagaaatttaaacaaatttacaaaaataaaaataaaaaaaattaaaaggtgggcaaaggacatgaacaggcgcttctcaaaagaagacatacatgcggccaagaaacatgaaaaaagctcaacatcaatgatcatcagggaaatgcaaaccaaaatcacaatgagacaccatatcactccagtcagaatggtgattattaaaaaatgaagaaacaacagatgctgtcgaggttgcagggaaatagaaacacttctaaactgttggtgggaatgtaaattagttcaaccattctggaagacagtgtggcgattactcaaagatttagaactggaaataccatttgactcagcagtcacattactgggtatatacccaaaggaatataaatcattctactataaagatacatgcatgtgtatgttcattgcagcactattcacaatagcaaagacatggaatcaacccatatgcccatcaatgatagaatggataaataaaatgttttatatatacaccatggaatactatgcagccataaaaaggaatgagatcatgtcctttgcagggacgtggttgaaactagaaaccactatcctcagaaaactaacacaggaacaggaaaccagacaccagatgttctcacttagaggtggagctgaacagtgagcacacatggacacaaggaggggaacgacacacactggggcctttcaggggagggtgggtaggagaagagcaccaggaaaaatagctaatggatgctgggcttaatacctaggtgatgggttgataggtgcagcaaatcaccatagcacctgtttaccaatgtaacaaacctgcacatcctgcacatgtatcctggaacataaaataaaatgaatggcaaaatccaaaaaccttcagtccagaatccagcattcctcatgggtcacaaatttaacctaaggtctaaattacaaaggagaccagacaacaacactttataaaactttaaagaaaatggtgactgtaaaaagaaaatttttcaacaaaatgtatgcatgcctcacatgatgttttgatatctgttttattaaaattcttccatcctctgagtactgtctgtaacctagggtctagaagggccaaaatacatttccttggcactgtgataattttgtatatgtgcttgtagcttgtgtgtatgtgagtatatacacacatatgtggtcatacaactttgttaaaacataactgtttatataagtttatgcagaaagcaatgtctaaatatatatgcaaatgtatatatcatatataaaaagataaatgcacatatgcacacatatatgtataaacatatgttttattcctggaatgtcaacctaatgattttcaacaatctgtagtgtatatgtaaagttccattctgattattctgttgagtattgctacatatgtgtatcctcaatactaactattcctgttagatgtttccataaatgagctaagttgtattttatttcttctgatttaagtattatttcttctatgtttttgtttctttatgattttctaagtattcatatttatgcagtcaattttcattaaatgcgtctatatatgtggatgtttaataatgtattagcttttcaacaataatagtttgtaacaaaccactcaaaatgcagaggcttacaatactagtatttattttcatgtttacggatgttcatattaacaataatttagctgatctagacagggctcagctgcgtggttgtgctgtaggtcgctgagcttatctctaatatatggatttttttttaattggggtcaagactgaaggagcagtgatcagccagggcagttaacaacatcctgaggtcaagctacacaagcaaatttaagtcccatcagctgcaacacacgtatacaatatgtgggtttcttcttttgctttagcaattactcaaggttctaaaaccttttctccaattaagtttcaaggtatgtgatcatgtcactgacaaataattaagtatttcaaccttcagcattaaaaaagtaaatttattcttaaattaattaaagttaaatcaaattgagtaaaaaaaattggatgtgttttcaacatgtgactttaatcagattttcttaaattgacatgttggataaaaacaacaaaaatttcttagctgaagtaaacattccctaaaacatagcttcttaaaccttcaatggatcatctgttatcttatgaaaatacagattcccattcaattgatctaaggtggttttgctgttttgaattggtaacatgctcttagtgttgctactgggttctggacaaattttgagtagcaaggtttttatattaaaaaaaagaataagaatgttacatctgtgtgtatacacacacacacacatatatatatacaaacacatataagcaaatgtacacatatatatgtatgaacacattttatttatggaatgtgaacttaatgattttcaataaatctatattatactataaaatcctgttctgattacctatatatatgcatacacacacagacacacacacacatattttatatatataatacatattatatattatgatattatatattgtatatattatatatgtatataatatactattatatattatatattaatataattttattaatatatatattatattatattatatattatattatattatatatatataatattaatattatatattatatatattatattatattttatatatatataatatatataatatataatagtatatataatactattatatataatatataatagtatcatatataataatagtatatataatatataatatatatattatatatattataatagtatatataacatataatatagtatatatattatatattatatataaaatatttatgtgtgggtgtttgtgtatatataggtgtgtgtctgtgtttgtatgcatatatataggtaatcagattatatatatatgtgtacgtatatatacacacacacatacacatacaggtattcaacaaaggttttttttggtccaatgattgctatattatttagtgcaatttctatttttttttttaatatgcagctttttattcctcaccccccccaccctctccacttctgtctccaatgttcattagaccactctgtatgcctctgtgtacttgtagcttagctctcacttataagtgtggacataaggtatttggttttccattcctgagttacttcactttgaataaccgcctccacctccatgcaagttgccgggaaagatattattaaatttatttttatggctaagtcatatacatatacatatatatatatgagtcaaccatatacatatatatatatgtatatgagtcaaccatacacatatatatataatgtttatatatataatgtatacatataatgtttatatatataatgtatatatataacgtttatatatataatgtatatatataatgtttatatatataatgtatatatataatgtttatatatataatgtatatatataatgtttatatatataatgtatatatataatgtttatatatataatgtatatatataatgtttatatatataatttgtatatataatgtttatatatataatttgtatatataatgtttatatatataatgtgtatatataatgtttatatatataatgtgtatatataatgtttatatatataatgtgtatatatataatgtttatatatataatgtgtatatatataatgtttatatatataatgtgtatatatataatgtttatatatataatgtgtatatatataatgtttatatatatatgtaatggtttttcttcctcaacttttactttaaggtccagggcacatgtgcaggtttgttacataggtagacgtgtgctgtggtggttcgctgcacagatcatcccatcacttcagtattaagcccagcatccattagctattcttcctaatacgctccctctcttcctccttctccctccaccacagacctcagtgtgtcgtttcctcccgtgtccatgtactctcattgttaggctcccacttatatgtgagaacatgcagtgtttggttttctgttcctgccttagtttactgaggataatggcttccagctccatccatgtccctgaaaagggcatgatctcattcctttttatggctgcatagtattccgtggtgcatatgtaccatattttctttatctgttctatcattgatgggcatttgagttgattccatgtctttgctattgtaaatagtgctgcaatgaacatactcatgcatgtatctttatagtagaatgatttatattcctttgggtatatatccagtaatgggactgctgaatcaaatggtatttccagttctaaatctttgaagaatcaccacactgtcttccagaatggttgaagtaatttacattctcattaacagtgtagaagttttcctatttctccacaacctccgcagcatctgtcgttttttgatttttttttttaatctgagaaggaatatcattctgtcacccaggcttgagtgcagtggcatgatctcagctcactgcaacctctgtcttccaggttcaagcgattcttgtgcctcagcccctcaaggaacagggatttcaggcatccaccaccacctccagctaatttttgcatttttagtagagatgagatttcgccatattggccaggctagtcttgaactcctgacctcaagtgatccacttacctcggcttcccaaagggctaggattacaggtgtgagtcacgttgcctaacttattgttttttgactttttaataatcgccattctcactggtgtgagatagtatctcattgtgtttctgatttgcatttcttcaatgattagtaatgttgatctttttttcatatgattattggcctcatgtatgtcctcttttaagtgtctgttcatgtcctttgccaaccttttaatggggttgtttttttttcttgtaaatttgtttaagttccttatagactccggatattagacctttgtcagatgaataaattgcaaaaattttctcccattcttaatgttgtctgttcactctgatgatagtttcttcagctgtgcagaggctttttagtttaattagatcacatttgtcaatttttgcttttgttgcaatgctttgggcattcttgtcatgaaatctctgcccgtgtctatgtcctaaatggtattgcctagattttcttctagggtttttatagtttggggttttacacttaagtcttcaatccatcttgagttcatttttgtgtaaggtgtaaggaaggggtccagtttcaatttttggcatatgactagccagttctcccagcattatctattaaatagggagtactttccccattgcttgtttttgtcagggttgttgaagatcagatggttgtaggtctccagcattatttctgagttccctattctgttccatttgtctgtgtatctttttgtaccagcactatgctattttgattaatgtagccatgtagttctatttatcatatgactaaatatcattttcatgctatgatttcaaacttactcatagtatatggaagtacatccaagtgtattctgaggccatcacttcactgaaaaaatcctgagagtcgagatacatgaccacactacgatgtcagctgtcacttccccatcatcactattattctggaagcacatttgccagaaaccctatgccttctctggtttttggtggagttgcccagtgtggggcctgccctgagattgagaagtaagaagaggaggattcaatactatccatcaacacctgcagcaagacatatggaccgaggtgaggactgcagaagcacctgatgaagtcctctaggcagctgagagcatctgcacccccacccatgggcttctcagaaaggtctgaggaccacatgattggcagttgtaccttctctatcagatgcattctggattccagaagagaattcctcttctctagtatttgcgtctttgactactatacttgcaaacctttaaaaggctgtagtttagattctcacatcttgtatttaaaaaaaatcctacttggaatacctagagtggctcactattgctacatgaattccaactgatgctacaactcagacccctcaggtgtaaccatttcttctcaatgaaatcaggagaggcattgccctgtctatgatactggggattaggacaaggaaagacagctacgatgaagtgggccttcatggcccttttacaaaaactctccagtgaacttcaaagtgtgactgcaatttgagaaacattctcagcaggcgaaggcaccagaaggggcatctgggacagctgagcctcacgcatctgctcccctgggtgatttatgttatgacttgttacactgtgggagggagattatcatactgttgacagtaatatgttgcaatatcttcaggctgcaggctgctgatggtgaaagtaaaatctgtcccagatccacttccactgaaccttgatgggacccctgtttccaaattggatgcatcgtagatcaggagcttaggggctttccctggtttctgctgataccaatttaaatagttgctaatgtcctgactcgcctggcaagtgatggtgactctgtctcctacagatgcagacagggaggatggagactgggtcatctggatgtcacatctggcacctgcgattagaaacataaacacaaatattcatactattagtcatattataggaaggcttccatcaagagccaggctgtactgagcccactggctgagaaaattcatagtgttatccttccttacctgagagccagagcagcaggagccccaggagctgagcagggaccctcatgtccatgctgtgtcctggttgggactgactcctgcacagggtgcgaccagcctattaataagtcttcagggcagggggctgtgctctgcgaacatgcaaatcagcaggggatagggcaggctgggcacagctgcagggctggctcttctcagtaactcagcataggagcaatgtccccagtgtcccaggtcggaccagggcatcacagatttgtccgtaaataagtgtttcttcctggaggctgtttggttacaaagaacttttttgagttaattgtcaaaatttgaaatattcctgaggactagatggagtaatgtattttattcgtgtatggagatggagattattttttaaaaaatacaatatgcacttaattggaagaaagcactttgtgctgtacttacaacacttctgttagcatgaaattattctgtttttagaaaggaaactaaatagaaaatatatcaagattgcaatccctgtctacaggctatgcctttccctttcgctgtactgctgctgacttccaatggccatctatgcccctcattgctctttctgaacctggagaaggcagctctgcctgcatgcatagcagaccacaggggctcgaatggccctctctttgggcagtgttatggtttcactgtgtccttcaaaacccatctgtttttaaatttatctcaaagcaacagaattgggaggtggggcctaatgggaagtgttgaagtcatgagagctctgccctcatgagtggataaatgccactataaacagagcttgtgctgtggaaccgaactggagtccactcactcagctcagtcagatcagatattcacactgagtttgcagcaggagaaagtaaaggtttgtttgtttgtttgtttgtttttttgtagggcatcaggtaaagagaatcaggcagctaagattcaaatcctggcctcactgatggcttgcaggtaagggttttttaaggcaggagtaaatttcaggaaagcagaagttacaggtcaaattgaaaattaatacatggaggtcacatattggttttggcctaaaagggcaggatatcttgaaacaggggcttacagatcaagggtggattacaagatttctaatttacaattggctaaggaagaaaagctttgtttaaacatttgggttcagcagaagagacgaattagctcaggtttatggatatgacttttaccagacccctctgtaagatatttagaacaaagtaccatggtcagagctcagtccccagttctcccttttgtgagatctatgtgctggcagattcatttggagggggtcttgtttcctcaaaaacacctcagagacatatactaaaatgtcaccttcagtttctataggggaacccaccatcttctgagtctagcttatttggccattttaggctgtttttacttccttgcttatcacgttacttacttacgtcttaaggctaggtaggtgcttggaatttcctttgaagagagtcaagattttctattctttccatgcttggggtgtgggggttgcaggctcctgagagtgagtccttgctctttcccatttgtgggagtagggtttctctctctctcttttctgctcttcagtcatgctaggacatggacttccttccttctggaggactcgggagtcatagtgccatcttgaaagtagataaactgattcctaatctgacagttccttgatcttagacttcccatcctccagaagtgtgagagaataattgtctgctctttatcagttacaatttcaggcattctgttataccaagacacagcagactaagagagacactatcagtagatgataacaggagtatgataacataccccagctctctcccctcagatggaatagcccagaggcattgtcccgatatttccacatgggatgaagcttcagtcatcctaagagttaagtggcttttaggggagacttttgccacccatcttctatttcctgctacactttccttcttccctcccagtgtaaataggctgcatgcacatagttccttcttgctggtcagcccagttcaatgtggaacaaatccttcaggaacccttcagccagggtaaaagtctgagagaccaaagccgtagcgcagggcctgggatcctaggtcgactttcctcagttctgtcctcactggtcctgagtggccaggaccctactagtgccaaagagggagggtcatcaaatgtctccagagtctttactcagccagactctgttatagttagaagaaaaagaagcacatgctaaataaataaacataaattatttgtatatgcatatatgtaattgtaacacactttacaaattaaatatatttctatgctatttcagatgtaatttgtattaatatatttgtatatcttatacatatataatacatataatatgcacttttcatgtaaataaatataatatgaattgttgttataaggcatggttttaaactttggtaaattgagcatgaacaagaaaatccagcaatagtgccccaccccatggccactttcccactacagagcccaagggtcagaggctcaggactcacttcatttcctttctgggtcaagccctgactcatagattgctaaggatgctgaggattgctgaggattgctaagattgctaagggtctggggaacacaaagcagcaggtgccgaggaggcagggagtgggcctcggctcctggtagaaggatgttttgtacccagagctcagcatgggcattttgtcccctgggggtccctgtaggacagagcagcacatgtggctcatagaattaggctacatgtggcttataagaaaggcttacaggtgtggtcacaagacaaaagccctccatggctcgttggcagcctcccctctaactggagccatatgggatctctctgcccagcttctatggcacacacagctgctggaactctgttcacaatgaaacatttctcccccatgcaaaaccttctgaatatttgttatttttattgtgtgttattcaaggacgacaacttgttgaccataatatttccaaaaggattcatggagtgaagtcaaaactaggttgtcaacactgtgacaggatgtgagagaaacaaggatcacatccctgaagacaagggcagctcatgtgtgaggcgaggataaattggccttataaattcagagcaggatgtgggagaaaacacattgacattctctactctgtgatgctcatcagatgctcaggaggtgcccatacggaaggtgggaagctagtgggaggagaagggggtttaagatttcagagctgcctcccattctgctccactgagaaggccccagatcttcagcagcactccaggcagagcaggagctggggcgaggtttgtgcaccagtaatgacgggaggtgggggcatgtgcccctgaaggcagcttggatgctgatagtcagaatgacatctgtccaagcccatggcccttaaccagggcaggcatggtgtccaggggatagcaggagctcagagccaggcctgggttccgttggaactgagctaggatgctgttcatactctggtcagccctgctggtgaaagtgaccctctcacttgggacgccgggataggggctggatacagggtccacacgatgttgccactggcatctaagtgggaaacaaacatgaacattcccaaatattaataccaaagaagtagttcattcagtttgattaagtttcaatcagaaagcaaaacaggctgaaaacaagtaaatctttctgcttaatgcaaacgaactgaggatgaagccgcagtcctccctcctcatcagagtcagaacagcagcaggaagaggagcaaaggcgggccccatgtccacgagggcttcctgatactgatcctactcagagagggtaggtagggtggagtgtttgcagggattgtgacaccaaaatggatgtgactggatggcttaaaccacagaaatgttatttctaacagtttaggagcctagaaaggcaaagctcaaggtccagaaaggttttcttgctggtgaggactctctttttaatttgcagatgttaccttttggccatgtccccacatgaccatccctcagggcacgcagggagggtaggggagggagaaagctctatagtgtctctctttataaggacagtaatcccgtggtgtcaggatcctgccctgatcacctctttaaccctagttacctcctagcaggctctctctccatctgcagccatattggaggtaagagattccaaataggaatttgtgaaacatagttccttccgtaagaagagggctttggggacacagccaaggcagtagggaggggcaagatgaggcttccggtctcagagcacaggggattttcccatcactaagcacactggcagctcctcccaggcgaaccatgtcagacaggagaccccagtcccgccttagggcctccctgtccataaggggacatgatcacttttacttcctcattacttctaagatcagacgtctatcttttgtttattacggtgtttgtctgccatctattggccagtttctaacatagcatcttacaggatgttagatactagggtccagtgagcgttgactatggatgaaatcttttcatgggtattcatggagttgatcttatgacatccatcactaggacagattttgtagaaaacacgaaatggcccctcccctcaataaaccagtcatctagttgaggacaaacggtatgcaggaaaaatatttgtcacaaaacaattagggtggctagattctgggatccatgtgacatgccaaagatgtggttttggaaaaaagagagggctgtaaaggaccctgtagggcataatggcagggactggggtgagaagctgacggcccctggtttggatctgtcaacccagcctcattcctcccatcccagaaacacttccagagcagctctgagaaccacagtagctttccgagctgaggaagcatccggggacacctgatcttctaaaagaacaactgctgaggtttgtgctctcagctatagcactgcgagtaatcagatgttatcatttacatctgtgctaagcaaagtcattttctaagatgatgaaaatgtctgtatgtatgaagtgcaataggctagtcattagtcctttgtggctgctgagtacatgaaatgtacctgatgtaactgtgaagctacttttctaattttaagtatttctaattgacacatctgtggctatcactgctagtgtttcccacgtggaacagcacagttgtagacagtaataaccagtaatgtcactgggacacccaagcttctaactgttaagcaaaggtgtgtcccaggaccactgtaccaagctggggtggaccatggccaaggtagacagagcacatgggtggatctcaggaaccttccctggatgcttccaggctggtgatggaaactgtccctcttggagacactgattgggaagctggagactggggcccacatagttgcctgtagaatctgaggtggaaacaaaacacagatcttccccagttaatgatgtccctctccataggcttcccagcagagtcctgctggctgatcaagtgggaggtgaatgctgggctccctgaacaatggcctcaatctgagccattgtcctatgggacatatgaactctgtcatgtggagcccccttagctgaaaccagggaactagaacccagagggccagagccccatgtccagtgtctagtgctgcccctgcctatggtgatcccaactcaaagacagagactgacccagtgataagggcttgagtggcagggaagggctctggggagcctgcaaactgtcaacaaaggaaagacctgggcttccaacttctgaaccagggaacattctatgccatgggagtgacccagaccaaggtgtatgatgtaagatattacagtaagttttatctttacgggaataaaaatcagagaaggcatctgattagtttagcacttgctgactttttcagtacacactggtccctgcccttcccataatgatcccgtggtctttgctgtttttgtggtcacctggctgcctcctcaccactcagatgaatcttcagtatgaccctggggccttccctgatcagcacaaatatatggcctcagcctccagataccacagaccattcctgctttttacacaatttgtcaactacagaaattattctacgcacttttattgtgtggttattcttccttcatggctctttcccctactgaattgggacccaaaattgtcttatttactcacgtgcacctaaccttcactcggtggcctttacttgttcctgaaaatgctgccattaagtgaaaatttattaaatgaaaagctatgtttgttctactctattggaaaaaaaaagagtgagccactgtgcccagcggcacctgtgtctttaaaggcatccatgcaggtgagtctgtctgaaggccttgcagtaaaattgattcaaaacctaactctgtaaataagtctgagaaaaatacagacattggagtcaccatcttgacaacgagttacttttcagaatttcaaaatttccaaatagaggcacagttgctaaaactgagcagccatcatagctgcagcccataaagctgctggttttagaaaaaaaaaatcaatggttttgtgaaagtttttgtttcatgttgaattactgtgggacacccactgctgtactgatgagggtaataaaattgtgacatcttcagggtctaggctgttgatggttggggtaaagtctgcctcaggcccaccaccactgaaccgggctgggatgctggtagccttggtagatgccctataaataaggagcctgggaaccagaacaggtttctactggtcccaggctgaatagttgtcaatgatctgactggcctttcaggtgagggtggctccttcccctggggacaaacacagggtgattggggaccatgtcagcacaacttctccagtggtatctgagattggaataaaacaggaaagtcaattgtgcaatctagatcaaatccactgtcttcccagtacagctgggatcattgatgtacattgaatattaattattgttcttgctgagcaggtcacaggacccaataacattgacagagtttcactggcatgcagaatcatcccgtgttcccctcacctgggagccagagtaccagaaaggagaggagctgagctggaacttccatggttccctctgggtcctaaccgagcagctcttcccgagagctctgacccaggcattgatatgggctctggacagcagagtggctggaaggatatgcaaagtagttggagtgggtgctgggcttccagctgcagagaccccctgcctcctcctctctgcactcagcagcccctgcccaggtggtcaggccagaaaagtccattggctcagcctgatggtagaacttcttccctgtggtcacagactatagcccctgtttcttcccgtctcactagtcacctagacccagccagatggtatttagtacaaacctgttgggaataaaatagaagcctgtggttcttttcctctccttatttctccaaagaaccgagtcatctccattggtgcatgaatgtacctggctgaaaactagttcatcagaagttcatcttccacacacacttttcctttgcagcttagccatctttcctatgagccctgaagcctcctcattctttgtaaaaactattaaagggcaacacgcaattaggcccagcactgtgggtgtgatgatcatcacggctgcacagatgagcaggccccgggctcagacccttcagtgtgtgtaattccattccctgcaaacagacgacaatgctgtccagcaggccaggaacaattccttgggtgatgccctactttctatgccaccccatcctgcacaacacatccattcaatcagactcaggcctttctcactttaataattttggaaacctctgctcatgtttctgatctaaacaataattcaatttggggtttccttgtgttccttaaaattgtgagcatttggtggtaagtgacagttcactggacaggctgagaagctctttgggttacattccatctgagttcattaatagacattgcagaaatttgttttctctcttctctaagtactcacataatatattcaattttgcatcttgcctcaccaaacctaaatatttattatctgactcctgagataatctgataatactgtcttttaactaaagagtcaataaatttactatagttgtgattaatatgtgttattatatatcatattctatacaaaatttgataaattagaatacaataattattatatgctcttgggaaatactaccaaattataactcgagacaaagtacaaaaacaaagctctgagaattatgatttttattttattttctgaaggctgaggatgaaacaggaataaaagaaaagagaacgttgtcaataaaacaagctgcttaatccactacttagttcaaccattgtggaagacagtgtggcaattcctcaaggatctagaactagaaataccatttgacccagccatcccattactgggcatatacccaaaggattataaatcatgctgctataaagacacatgcacacatatgtttattgtggcactattcacaatagcaaagacttggacccaacccaaatgtccatcaatgatagactggattaagaaaatgtggcacatatacaccatggaatactatgcagtcataaaaaaggatgagtttatgtcctttgtagcgacatggatgaagctggaaaccaccattctgagcaaactatcacaaggacagaaaactaaagaccacatgttctcattcataggtgggaatagaacaatgagaacacttggacacagggtggggaacatcacacactggggtctgtcgtgggggcgggggagggaggagggatagcattaggagatatacctaatgtaaatgacgagttaacgggtgcagcacacaacatggcgcatgtatacaaatgtaacaaacctgcccgttgtgcacatgtaccctagaacttaaagtataattaaaaaaaaaaaaaagacagatggaagaagtgggtgggagctgaggccaggggaggggcagatgagccaacacttgatttttttgtcccaaattgtgaagacagttagagattaaccctgaattagggtttatcccacctactgagtcaagatatgactaaaaaatgattttcatatgacaccttgcaaaacatttcaaaatatcccataaatttaattgagaaaaatacaaacaaaattataaaatacagctatttgtatactttggcctattttgtcacctcactcagcccacagcaaatatacttccttggtgagtgcaaagagtaaaatgagaggccaaggtggaccaccgggggccagacaaaccctccatgagggctgaggaccacagatccccgaggacaatcagacatccagagggagggctgaggaccacaggcccctgaagacaatcacaggtctggagggtcttagcccatgactttcctctgtagagacagattctcccagatggttgagggctgtctgtggctgtgtccttccttccgcatgataatgggggcagagcaggtctctaagcaaaccctgagcaaggccttcccctgtgtgctgctctgacctggccataggtggaactggatttacttaaggaagtgatttttgatcatgaggaaaggagagagaatggggagaaagagagagataaattgtgtatgtatgcacagaaagattggatactttaataagttagttccttgatacctgtgagtgttacctaaattgagcaaaaagacttcacagatgtcaattaataatattaagatggggagactatctggattaaccataatggctctaaatgcaatcacaaatgtccttgtaagagaggatgtgagaagtttaacacagacagaagagaaggcagtgtgaccacagagaaagagacgggagtgatgtgaccgcagccaaggaaagctgcagccaccagaagctgaaagaggcaagaacagagaggcaaatgccattctctccctgtgtgtgtttcctgtagctcctctatcaaatctccacatccttgctggcttcaaacagcatcagtttattcttttacagttctggaagggagaaatctcacataggtctcactgggataaatgaagctctcactgggctaaaagtaagcttccctatggatgctgggggaaagaactttttctctggccttttccagcttttagaagctgctgtctttccaggcccctggcctttctcttacatcactcagcgtctttcttccttgccaaatctcctccccaaatctgatcctcctgcctcagttttgtaaggacactggtgattacatgtgacccatctagataatcttctcatctcaagatctttagcttaatcacatctgccaagtttcttttgccatataaggcaacattcataggttccacagattaggcacaaacatctttttttttttttttttttttttttttgagaagagatggggagtgctttactcacactaccaatcattcttattggccccaaactgtccttctctaaacaagaatccaaaatcacatagctggaagaaggatagaatgtgggcaaccaacatctttataaagcaagagagctggagagatctgagtcagggtcctctggtctggggtttccctgggctggaggattctgctgctgctgctgctgctgctgctccaatgtggacctcacatgtgtagctatttgttagagactattctgattttgggacccagaagaaaagaattgctacttaattgcaatctaagagagattggtaaaggaaaattaaatgtttccctaactttctgaatttttctacccgtaaaaaaagaaatccctagaatttagataaagatacctctacacatgagaatttgcctattgtcttaaggtgggtcttacaatgacaagaattcccatgctgacaacatatttacaaagcacagaaaaccctgggagagaagggggaaagtgaggcagggaagacatggccagtgaaaagctcatcaataagcagctgctcatgaggaccatgaggaccactaaagctcatgccaatgtaaaaacacaagaacctctgggctattctacctgagagatgagggagctgtggtatgtatacacctcctttagtcaccacagattgagggctgtcctaggggatgctcattccaggctctgaggtctaccatgcatgaagtcagaggtgccttctgtagtttcagggagagcagtgaggggcagatatcaccatgagaagtcagcagaaatgcagaaaagaattaggacaactactgctacatccactcaaaaaagatgtgtatgtgaaatctggagggtccatgtgggccacatctctctggaatgcaagaatgtgccctagaaattcaggctgcatgacaggcagcagggattctgtgcccacactgcaccaccattgcttggctacccatagtcaagcatgcagttatactccccgtagtccccaggctccagggcattgatagtgaaggcatagctggttccagttctgctgccactatactgggctgggatgcctaggaccaaggtagtgacatgagatgtaaggggttcaagtctttgtccaagttttttactgattcaagatatttctccatgtacattgttgctggcttagcaggagacaaaaactctctttcctgaatgtactgacaagcaagcagtctcctgtgttgggatgatttccccactcactgcaaagagtaaaagaagaaagtggcattgatggtgaacagcaggaatatgcacccagttttagctgccctcactgaggagagagggttcactcacttagcctttccccaggtactccccctcaactgctctccaaaaagccaggccccaggggagctgcttctgagccaccaggaacatgctggtgaggagtgctcagagcctgggtagcgcttgaggcatcagactttatagagacttaggttcagggaaaggcataaggcaggtgcacactaaaaagaggcaccgagggaaggactcactagacctatgcagttgctgggttttgacctaagactggggccagtacgcttgtatggaaatgagcaatatttagtggaaaactttcctcttttgacaatgaccagaaggaaaatgatgcctctacctggagggaaaggcaagaagaagcacatctcttgtgatacttaagttcatggtcagcctagaatcagacaaggcattagttcaacatgcagaggagactgactgtcaggaagttggggaatccttgacattaggaaggatgttagtaaaattggtataaacttcagtaattactgttttttccttcaggccatggactctggtgtctcacttttgaggctaccctcatacttcttgtgatgaagcttgcttcatgtagactggttcagggcctgacagccattgctttgagggttatgtggagccatcactgaaggtgaatctcaacttgaatgacagatggtggtggccactgatgagatggggcttcctatctaagaatcaactcaggtttcttggctctttgataaatggttcccatgcttggatcttaaggtggaggccacaggtctgagttctaagtcttttctttccacaccaacagcctttcccaggaatcaccctggcctcctccatgctgggaatctagacccaaccctcctgctaccttccccagcatccaacagtaactgtctggaagcttttatttgtaaaccctccaaatgcaacctctgccggcaacatggctggagcagtcagcatcctcccatcaaaaaacactgagaaggaggggaaacctgcaaacaccacggtggtgtggaggagatgcatgtaatccttagattttatgtgttttcaaacttttttgtctgtttcttaaccatggttctattttcacaatcttgcagagggaagaattgaagataagaagggttcttttatatttagaatatgaaaatagaaatgacgacagcaggagaatggaatttataaactcttcgaagcggtttgggtttctctagccagggacacagcaggaccaagatgccaggagaggatatcacttattttggttcctgcccttcatgcttcagactcccacaaatgcacacatatgataatgcctgtcttcttctaaagagcaggtctaaggcccagccgtggtctttcactgagtatcttttctgtctaaatgaaaataattttggaagtagtggaaacaaatgatagcaatggcttaagcaaagaggtccaaaggttggagcttttcgagttggtgaagcatcttggcaacagcagaaaggccccaggttctttctctatttctactttgcaccccaccacattggctttgcagacgtaggctcactgcctcatggtcttaagatggctgcagcggctctaagaatcagttcctctcatcatgattactggaaagaatgcaggccaaaattcttcaccaccttcttctttttttttttttttgagatggagtctcactctgtcgcccaggctggagtgcagtggcacaatctcggctcactgcaagctccgcctcccgagttcacgccattctcctgcctcagcctcctgagtagctgggactacaggcgcccgccacctcgcccggctaattttttgtattttaagtagagacggggtttcaccgtgttagccaggatggtctcgatctcctgacctcgtgatccacccgcctcagcctcccaaagtgctgggattacaagcataagtcaccgcgcccggccccaccttcttctttttataagggatgaaaattcttcccagaatctctgctcatccctcactccctgacatcttattgtggaaccaaactcatgtccccctaatttctgttcctgtcctgggctgagagaaactttctgtcctccccatgcacagcaggacagagttggtgcccaagaaaccaaaggaggaagatggctgctaggcaggaggccaaagcctcgacacatttaaatttcaccttgtgtctaagccaacctggatgaagcagaaagatcccaacattctctgaatctggtggggttggaacaagccaggccttgaggatgacaatgaagtcaaatttctaattttccacatgacaatgttagcttcagcagttgaggaaatgtagcctgggaatttaaggccgggacatacttccaagtactggaataaatgagggagagatctgcaatagggacatgggggagcagtggctatggaagaaggaggaaagctgtgtgctaaggttggtggtgccacctgcccacctgagtgcagccctccctgtgctggttgcatccccatttcagtctcatgcagacccctctgtttacatgactccaggtgctatttctgctcccatccaccctgtggctttctgtcatgagtacatatcttcttacacttgaaccctctggtattcatgatatcaacagcaatgtgataacacctaacagaatgcagacattccctttgcatatagcagcatgctcacctctacccaaaaggtgaaaaaactcaaatctgttcagtccaacaccatctaggaaaaactgaccttccctcatgagtcacaagtcaatctggatatcatttaatctgtggtataaattatataggtgaccaaaacagcactttgtattaaaagaattttaataaagggacagttgagaaaaaaatatttaacatatgtaaatgtgtgcgtgactcattcagatttcatgagttggttttctctgtattctttttatcccctggcctccagcacgatctttatggtcgtttctggtgaggctaaccttcatgtctctggcattcagggtcccagatgtgactaaggctctgcacatgagatatgcccctgcagagtggttttcagaagttaataagggaaggggagatgccttccagaggggctcattctcctggtctgggtcctggccaggcagcactgtcctgtgggcacagcatcctgcctcacaagtttcctgtcacaatcagaggatttttctgcatagaaacgcaggaagaaacagggaagtgaaatgaatgcctgagcccactcctctgctctttccatctggcttagttcacctaatccatgacaataaacgcgagtttgcttcaccagccataatggcttctcttgtatctgactgcttcgatgacagaagaaggaagaaggaatgagtggactggctcctgtacttctctactatgaagctgacctagaggctgtagctggtgttcacatctcctaagttcactgtgcgtttcatctcccctctgctgcactagtgtctaagtacatgtgatgcttcagctgtgttacttaaagcttcactctggtgtctgtagaagtttctcttcacttttaccagtggaaatggtggtaaatggaaacattcccagctgggcacaatggctcatgcctgtaatcccagcactttgggaagccaagccaggtggatcacctgaggtcaggagtttgaggccagcctgggcaacatggtaaaaccctgtctctactaaaaatacaaaaaaaaaaaaaaattagccagacgtggtggcaggtgcctgtaaccctaatcccagctactcaggaggctgaggcaggagaattgcttgaacccgggaggtggaggtttcagtgagctgagatcgtgccattgcactccagtctggacaacaaatgtgaaactctgtctaaaaaaaaaaaaaaaaaaaatcctgaagttccaaatgtgaaactctgtctaaaaaaaaaaaaaaaaaaaaaaaaatcctgaagttcctctgggttccacatattctctacttcctctctaaaatatgtagaaggaaacctatacctatgactccagcccacaccataagaccctttattgacagtttatcttacatcataatgagaactaaatggccgcatgttcattgtttcttccaatttattaatgatttatcatgctaacccattggatcaagaactgtcaaccagaaaaccccggacctgagtgaacagaaagagaacttttcaatctgctctgtaggcataataaatagtgatgggctcaccccccatgtctcagataccactattctcttgatgggagtaacaataccatacaccttggtgttttggggcctccgccacatctggcaagacagtgatttgacattacaagggtttgtgtgctcacttcacctgcctagtaatggggtttctcctgtctgtagggatagctgcctctgtacacatgacagcatcatgaacctactttgccttactttttttttgctataataaagttactttttccaatgataaattatgtaagggtttcttgacttgaaagcacttgaaaaactttcaagtaattattctagcagaaacatggctgataagaaaggcaaatgtacatataggaaaataaccacccccaccccaatgtgttgggttaggtccaatgtactcacctgataccagctgttagtctgatctcagatgtgtagtacaatgttagggtttcaggaagggtcatggtttttggcaagtcagatactcagatgtgccattagccttgtgagcctcattaaatgaaattcagatgcataaatctccatggcttaagttcatgagactccctgggaaaggtgactgactgaagtccatgtgttggatcaccttaattattaagagttccctgctaggcaatggcatttagatgagtattcacttgggtagcatttatttttgatcttggcccattttgaaagatccagtcacagctcttctaaaccaattttgtccttaagttttgtttcttctgagacctaatgacctgtgcaaattaataatcaatgtcattgcattaccagcctctctttgcaaagtagccaatgatatacccttgtagttaacccactattgtgatttctagtcttccagggcatccttgatgatggcaggggtgtggctttggtccagcacccaatttagaactctgcccagcaggcatcattgtgaaattttaacattttgcctaattttaacattaggcaaaattacctttcttcatatcctttacccctccactaaaagatattttcaggtgcacatacccatttggtgagtgttagaaataaagattacaaaggaaatccctgtagccagagcaggtaacatatatagtcctggacatcagtttttttcatgggagtaactggaattatcttaacagatttaatttatacaataatttcatacgtatgcatgtgttgcttatatatatatatatatataaacatatttaaataatcttatctacacatgaatatgtgtacatagtatttatagctaacaagttatcaaataaatatatatggattaatatgtatgttatatacactcaaatatgtgcattttccataaatgacacaaattttactgtttttatagatatatgatgcaatatatttgatacagtgacaacatttttaagttttatcttagtatctttaaaaacagatcaataaatatttatatttttgcatcagagaaccccatctctagtatctgcttcatgaataacatatgccaggttttcgaaggctatagtttagattctaattcactcagttaaaacaattcctgcttggaatgtgtggcttccattttactgtaagaatttcaattaccccataacacagactcctcaggtagactaatctcctttctttactaaattcgaagagacattgccatgagaggaaagagacttagggtggagagacaccttcatggccccctcttccgtaatctcccaataaccctcaaaactcaggctgagtctgagaagtgttgtcaccagatggctgcacaaagaagagcaggtggggcagcccagcgtcacatgtctgctttcctggggggggtttgttatggtttgtaacactgtgatagggtaatttttatactgttgacagtaataagttgcaacatctttaggctgcaggattctgatggtgagagtaaaatctgtcccagatccactgccaccgaaccgcgaaggagccccagattgcaaactggatgcagcatagatcaggcccttaggggccttccctggtttctgctgataccagtctaaattactaccaatgctctgactcgcccggcaagtgatggtgacgctgtctccttacagatgcagacagtgtggatggagactgggtgactggatgtcacttctggtccctgaaattgcaaacagaaaaacaaatatccacacaattaatcatgttataagaagacttccctgaatggccaggcagtacctagcacactggctgagtaagaggctagtaatttcttttcttaactggaaaccaggatggcagaagtcccgggagctgaatgagggtcttcatgtccatgctgtgtccagacaaaaactgactcctgcacggggtgtgaccagccaattaataagtcttcaggaagggagctgtgctctgggacatgcaaatcagcagaggatggggaaggctgggcacagctgcaaggctggctcatctcagtaactcagcacaggggcagtgtccccagggtcccagatcagagcagggtagcatcaacttacctgcagataatacatttctctttggtggccatactattacaaaacgtatttttgggacaatttccaaaattttaaacgaacctaaggactacattgagtaatgcattttatagttgtattggcagtatgtaggagactatccttgtttgcagggaatgcataataaaatcttagaaagtagagctcttgggtcttcaagttactggcaaatgtatttggtgagtgtaaaaatattttgtgttgtgttaacaatatttctgtcagtgaggaattgtcttttttaaaatgaaaataagactttatcagaagcatttttaacaatattcaaaaatagtttgtcataactttaagccattgttgttactggtataaggacaaggaattgactgcagtttcacaaagataataccatgatttctcatgcatgtaccacgcacagaccctccattttccagagctatcggtcactttaatacccaaggattaaatggatagcaccttattcttgccttggggagaatattctaccaccttttctgtcactgtgtaatatttcttacagatcatcgcataaagggctggctagtgatgccagatctgattagttcaacaagattctctgtttcttcattgaactataggagccttgattaggataaacttgaaaccctgtatcaatccagactcttataatcaaatgtgtccaaagtaggaagacaaagatcatatcccctgggtaatgctccaagctgtgctccctaccagcatgttcctagtgtctcaggtgcagctcccccgaagcctggctttctgaagggcaggtgaaggggaggacctggggaaagacaaagtcagtgaactctctcttctggtgagggtggctgctgctcggtacatgcccttgccttgaaccatcaatgtcatttgcttcttttactcttttgcagtgagtggggacatcaccctgacccagatgtcagcctcactgtctcacagccaggacacagggtctccatccctggccaagtcattgctgatgtatacagagatatatctgaaaatggataaaacttggaaacaaatttgaacctctgtacctcatacctctgcctatgctgagggcatcccaacctgattcagcagcaggggaattggaaccaactacatcagcatcagtgggctggagcccgggtactccaggcagtattactcattcatgatcacgcatggtcccaccacagtggtgcagtctgtgcacaaaccttctgctgcttttccgggggcttggatttcaagagaactggccagtaaacagcctactaatatccaggttcaagacatagggctctagattgaaatacacatcttttttttctgaatgtagccgtctctcttgctacccttggcctttccccttcactgtacttctgctgactccatggtcatgctgctgtctctgagctgggcagactccatggtcatgctgctgctctctctgagatgggcagactccatggtcatgctgctgctctctctgagctggggaaggcagctctgcctgcatgcatgccagaccacagtgtctggaatagcatcccctaggacagccctcaatcggtaaggacaggggaggtgtatacatacatgtggccatgtggaaggaacatatataagttctgacagacctgggttccaatctcagtccctacttctgctgaccatgtgactttgggaaatcacccctgcactctgatgggcagttttcttacctgtaaaatgaagtactgtggatatcaagcagtgtcaggcttcaccagatcatgacccatgaagagagaaagagagagagagagagtacccggtgtccatttcatgcatccttgactgtcttagaatgaagacgttatgtaagatattactagtcagatgtcactttcaactaaaaattatcaatatttattctaactaatagatctctctctctctatacagtgaagtttcacgtaaatgttttcccaccatatcctctcccatcaatctatttatgtgtagcagtagaaagttgaacaagaagactgaaaaccaccagagcacgtttcatctgcactttccctgcacttcattcttattagtgtccttgggctgctgtaacacagttccaaaaatctgatggcttaaaacagtttactctctcatacttttgtaggccagaaatctagaatcagtatctctgggccaagatcatggccttggcggccaggctccttcagaggctccaggagggagtctattcttgcctcccccagctcctaatggctgcatctttccttgactgtggccatacccctccagtctttgtctctgtggccacattgccttctcttctgtctgtgttaaatctcaatctatctcactcttaggaggatacttgtgattgcatttagggtccacttggtcaatccaggataatctccctgtttctagattcttaatttatacctgcaaaggtctttttcccataccagttacattaattggctccatggaaaagaacctgataatgtgggggtgatactcagtgctaaaccattacaggacccagtttcagtgtcggtactgtacacacgttacattctctctctatgtctttcgctcactctctcccccttcttccctccctttcttatgatcacaaatcattccacttccctaagtgtatccactgccacctaggttcagagttcagagaggaacacacaggaaggtcttgctcgggtttgcatagagatctgcccagtccccgctatcatgtacaagaaaagacatagccacagacagccctcagccatctgggaagaagctgtctctacagaggacagtcatgagctatgactctctcgacctcttattgtcttcagaggcttttggccctcatggagggtgtgggtggcccctgactataggatttggtcttcatggagggtgtaggtggcccctggctacaggattcaccaggactttcatcagaatatctgattcacagaaggcagtcagtgatagggccacacagagggactctgcagggccagctgcacagagcactctggaacagcctgcctcctcatatttcttcctgaacacacatatttggatctcctaatactattttgctagtccattacttgctctgaaggtaataggtaggattaactaagacagaatttttaatagttacaaatcagaagaaaaaaagtaattttttaaattgctaagctgataaagaagaagataacatgacggcaaaaaacaaaaactctagactgagggctttgggtaagagcttgagactctcagtagtggagcacctgggccatcgcctttcagaagagagggacaatcaggaaagaaagcgtgcagtagaggcaaaaatcttgcttactcagacaaagcctcagaagaaaggagacaccttcttcctgagcaccagcaatcagagaaattctcaataaaaataaatcataatgaaaaataaataaataataatgaaaaaatcgagaatagttataagcgctgcatgcactgctcattgcaccaagtgccttgtaatgaacgaagtgcagacaataatcatagaccccaaatgtgtcccaaacctgaccactcccccgacttctaccccaccacttcaccccaatgcaaacctccattatcttccacctgcaagataatctctcaaatattacccaacttcttctttgctccttgttccttgataagtggtccccactctcagggtcctaaggctgtggccacaggtctgagttctaaggtctttcttctcacacccacagcctttctcactctggcctcctccattttgagaatccagacccaatgtcctgccaccctccctggaatcaggcactaattgccagtagcttttctttgtaaaccctccaaatgcaacctctaacaggaacctggctggagcagtcagcatcttcctgttacgggcagttagacaggcatgagatgggcaggagaggtctctttccccacccactaggaatgtggggtgatggttcagcaatgatcacattgcctctctaaaagtgataagttggcagctggcactagagggaggccatttcctgatggtccacatcttttgcactaaggtgttaattgaatgcaagcaccagggaaatgcaacttcccaggcatgttaaaataaataatacaataaatataaatacaaaaataaaaataaaatgtttatatttataaataaatttatattttgtattcacatttatactttatgtatatttatatttatatatttgtatatttatatgtatgtattcatatttatatttatgtataaatataatttatatatacataaatttatatttatacataaatataaatacaaaacagtgaagtatgaccttccaggggcacaccaccagaaaagggaaggaagcctcagataggcatgtgtacaactttctgaacacactgagcatgctcacctcccaagggtaagaagggcactgcgcatgcgggcagcccaccctaagagaagaatcatgggaaagagacctgcctataaagtactagaatcaaggttaaacaccggacttcttcttcaagtcgcccactttggtctctttcaagtgtactttcctttctcccctgttctaaagcttttcaataaactttcacttctgctctgaaatttaccttggtctctttttctcccttatgcccctcagtcgcattctttcttctgaggaggcaagaattgaggttgccgcaggccaaggattgaggttgctgcagactcatacggatttgccactagcaactagaatatctttaaccagtaacattcccagcaaaaagtgctaagaagaaagagaaacctgcaaacacactttgttgttaatgaaatgcataaaatcccctgtttctatgtcttctccaactatttttgtttcttaaccacaattatatatgtatgatcttggagcagggaggaattaagaacaggcatttatttcatgcttaggatataaaaagaggaatggagagggaaagacagcagaatttataagttcttcaaagtgatttgagtttttctagccatgggcatagaatgaccaagatctcaggggagcactgcacttacaattcctgcccttcacgcctcagactcccatgaacacacacacacataaaaatgcctgtcttctcctaaagagcaaatttaaggctctgtttcttcccttgagtaccttttctcataaatgaaataaaataaatgaaagtaactttagaagcaatggaaagaaacaatagcaaaagcttaagcaaagatcagaagtctgaaggttggagtattagggttggtgcagcagcttgggggcagcatgaggaaaccaggttcaccttccccacattggattttcagtcttggactcaagtcctcatgatctccagaggactgcaacagctctaagctaaggacattagtgtcatatccactaaaaactcttccaggaaaaaatgtggggcaaaattcttcaccttccttctatttatgaggaatcaaattctccccagaagccctgcccacctactcccctaccatctcatggtggaggtgaccacacatgctcttaatcctcactccagccctaaattgagagaggttcactgtcctcaccaggcatggcagaaaggagctggtgccctctacaccaaaggagaagggggatggctgctcagagagtgtcaagagcttggcaacatttaaacctcactatgcttctaaattaagttgtgtggggaggagagatctcaagagcctcttggtctggtggagttggaacaagccaggccctgaggatgacagtgaagtcaaatttttaatattctagatggcaatgttagcttcagcagttttggaaatgtggcttatgcaattaagatcaggacagactttcaggtactggaataaaagagaagagattagaaataaagtcctcaaaccagggctaaggtcaggcctgcactgaccgagagctgctgggctctggccctgggctgtgaaagaaacagctgctttcttgaactatgaggctgaggacctgggaggaaccacaggccctgtccatggggctgcctggcaaaggattcaagaaagaaagctgctcacacactcatgggcgcggcaccaagcccgagcctggggccatggtgaaagcctcagaaaccaggaccttagagctgggcctgggctcctggagtaggctgctctcagctctgttctcattgtatataagcagtcaggaccttcttggaagcaaagggagagggtgagcaaatgtccccagggctcttgctgagccagattctgttctgatgacaaagaaatagagcacatgctcaacaaataatatatgcatacatattatgtaaactttattaaatacatataatattttgaatattaattatatattgagatagatgtatacgctatgtttctacatttcacattaaaataatatgtacaattgtatagaaattgatatacttttgttgaaattgtatcacctggccctgcaggtgacagaaagataaacaaactataacttcattatcaaggaaatgttcatgtttaatacaaactatctgaagccgaagtctgagttcttcttcctcatcagagagtcagaaaagcaggaggaagaggggcaaagctgggcacccatgtccatgagggcctcctgaggctgatcctgctcagagagggtggggacagtggatgggccttcttgcactgctacaccaaaataccctgggctgggtagattaaaccagagaaatttattctcatagttcacaagcctggaaagtccaagatcaagttccagcaaggttcactttctggttagaaccttcttcctagtttacaggtagtcaccttctcaccatgtcttctcatggcctttccatagggaagcagtgagttagagaaataaaggaaaagagaagagttctctggtttctgtccttataaggacactaatcctattggatcagagccccacccttatgacttcatttaaccgtaattacccctttataaccccaattatctcctacatccacataggggaatagggccaggcttccagtctcagagcacagatggctttttcccaccattcagcacagtggcagctcctcccaggtgccccaggtaacatgtgggacattattctagccttatggggtccctgttaacaatgggacactatcactcttgcttttctagtatttctaagataatggtactctcttttttgtggggtttgtttgcaatctagaggcaggtttgacatagcaacttacaggatttttaaattttgtgatagtaaaaataaataaataaataaatttatcataaataataaattgacttaatacattgaatctgtaaaaaaaagataaggccaattgaaaagcttaaaaagagtctgaggggtttaaaaaggcaaattcctttcaatgagagttagagaacggatgaccgattttttttaatagatgacgtttcagcagtaattatcaaatggtaaacaacaacttgaaaaaaggtctcacaaatataatttcatagtcaaaaaacatttctgagaatcatataaatacatattcagattaaaacagacagaaaaatgtgaccttatcggtagatctactcaatggaaaattcctcaaatatgtgcttgaggcaaaaggaatatttatcattgatggaagttcaagttttctaataaactccaacatccttagtctccgtcctactgactttcagtgtaaactcagtacctgacccattacccctgaacctgtctgagaattcggaggcctggttggaaacctcataaatcaggagctgtggagactggcctggcttctgcaggtaccaatacaaataggtgtttccattattatacaggaggctctaactagacctgcaggagataaaggctggctttccattatgaacaactttcatgatttcttttatgatattgatttatagttacatttttcaagttttgattcatgtcatgaaagtagactttctaaaataaacccattatttaccagccagaagggaactctttttttttttcaagatcttaatcagagtactgttcattgttccctggaggtgaaccttgattattcataagacaaaaatatgaattcttttccctgggcatagaccatgtgactctatcatgttggaataaatgatactgctctgatgagtagaggacaccaggttctttgtctcgagtcaaatgagaaaaaatgacactgacacacttagaatagttttaaggagcagggagtttaataggcaagaaagaagggggaagaaagaaggatgaagctcccctgtacaaagacagagggaggggggctccaaagccgagggacgaaccactctttcaggtaatatcagccagctatatttgatggctggaggaggcggtgtctgatttgcacagggctcagggtattggtttgaccagacatgtcattcacggtagccctcgaaagaactggccctcccaccctagccttttaatatgcaaatacagggcgccatgatgttccacacacgtggggatatgtaggggcaaccatgctgccaggcgcatgttggggcaagggcaagaggacaacggtggaaatcaccatgttgggtgcatgttggatggacccagtttctaacggcttgcatttgcatataaaaggttgcctgcccggggctaagacccagggctttcatgctagacaacagctgtgaaaagtctcccaaggatcccttttttcctctctatctgcctaaaataatatcttaataactcctacctcataaacacgtgaagctgtggagcccacagactcacctcccacccagttctccttgccctggcacatacatccagcttctgtgaagaattggatgtggctagagacttggggtcccacggacaagagttgagatgcaacacggcaagctttgaatagggggctggtcaattgtaagcagatgccatagaaaatcaggaaggtcctccaggcagcgcatcaacagccccgaacatgggcttcccagacatgtctgaggaccacatgattggcaattataccttctgcaccagatgctctctggattcttggggagatccagagaatcgttttctaattatttgcatctttgagtaccatgctcccaagcctcccagaggctgtagtttagactctcattgcgtgtatttagaaaaaaaaaaatagacttggaattccaagagtaggttttcctttgtggtattgattccaactcacaccatagccaagactcaggtgtaatcgtctcttttcttaatgaaatcaggaacagtattaccatgtttgtgctgcaggggatgagaaggaaaaacagttaaggtatagaggagttgtaatcgcccaaggggttcaccttgcctgctgcttagacagagtcgatttatcaagacacggcaatagcagtagtgaaagagtaattcacacagagctggctgtgtaatatcttccaccgtcataattttctcagttatgatttttgcaaaggcagtttcagagtcttcatggccccttccatcaaaacttttcagtgactttcaaagcttgactggaatatgagaaacgctctgagcagctggaggcagtaggaggagtatctggggcaggccagccccatacatctgcttccttggggggtttatgttatgccttgtaacactgtgggaggggcattgtaagtccgttgaccgtaataagttgcaacatcttcaggctgcaggctgctgatagtgagagtgaaatctgtcccagatccactgccactgaaccgagatgggactccagattgcaaattggatgcactatagatcaggagcttaggaactttccctggtttctgccgataccaatttaaataactgctaatgccctgactcacccggcaagtgatggtgactctgtctcctacagatgcagacagggaggatggagactgggtcaactggatgtcacatctggcacctgagattggaaatataaaaacaaacatccattcaatccatcatgttataagaagacctccctgaagagccaggctatactgagcgcaccagctgagtaaattcctagtgttctccttccttacctgggacccagagcagtaggagccccaggagctgagcggggaccctcatgtccatgctgtgtcctgactgggactgactgctgcacggggtgtgaccagcctgttaagaagacttcagggcagggggctgtgctctgggaacatgcaaatcagcaggggttggggcaggctgggcacagctgcggggctggctcatctctgagccagtccctcgtgtccccagtgtcccaagtcagaggagggtagcacagatttgtctgtaagaacatgtttcctcttggggccgttttgtaacaaagaacttttttttttaataattgttaatatttgaaatactcttgagtactcgatgaagtaatgttttctatttgtatatggggattaattaaggttttttttttttgagacagagtctcgttctgtcacctaggctggagtgcagtggcacgatctcacctcactgcaacctccacctgccaggtaccatcgatttctcctgcctcagcctccagggtaggtgggactacaggtgcgcaccaccatgccaggctaattttgtatttttagtagtagaaatggggtttcaccatgttggccaagctggtctcgaactcctaacctcagatgaccccctcgcctcagcctcccaaagtgctgggattacaggcatgagccaccacgtccagccaggggaatatttttatttgtaggaaactcagtaaagttttagagggtgggaacatcaagtcttgaatatactctgcaaaggagaggatactttgttccatacttataacatttctgtgagagtgaaatggttccttcttaaaaaaaagagacaattttacaagataatgctaaatatatttgaaagtattttgtaatgaccttaagccattcttacatgactgtatggtcacgcaattcactacagatgcataaaaatgaaaccacaagtcctcaaggccggtatcactcacagattcaccattatttaaacctgtaagccaccttaatacccagagattatataagctgcatcttatttttggtttggtgatctctatattttaccctctcttctgccattaagtattatttcccaggggttctcagcatgaagagctgactagtgatgccagatctgattgacttaaataactagtttcttcctgcatttatcagagtctggattaggataaacttgaaattatccagggttcagttgtctccacaagtaggaagaccaagattgcatcccctgagtaatgctgaactccccaccagcatgttcctgggtgctcaggtacagctcctctgaatcctggatttctggagagcaggtgatggagagactttggaaaagatcaggacagtaagtcctccctcccagtgagggcagctgctgctcagtgcatgtccctgccttgcacgatgaatgccactttcctcttttactttttagcagtgagtgggaacatcattctgatccacataccagcctcctgtctcacatccagaacagagtctccacctcttatcaagcaaatttccatacatatggagaaattaattggatcctaataaaactggtaatggatttgcacccaatcatatctcacatctctaacagggcccaagacatctcagcctgcttcagcagcagcattcaactacatcagcgtctgtgggctgtagcctgggttctggaaagtattactcatgcctgactaggagtggtcaaatcactgtggtgtaagctctgcacacaccctccttctgtctattcagggacctgaatgttaagggaacttgcttttgtagagggaaaaggggaaagagaaaagcaaaccttctaaaggtttgctgaaaatgaatagacaaaagacaaattaatagaaaaaaaggcaaacaaatgtatttaacatgtggggtgggggtgtggggataacacacgagagggattacccaaataacccagtgaggtccaggtgcttctacatcctttatagggaagagggaagtagagagtatagacaactaagggagagtaaataacctaaaataaaagaaaagggtcctgaaaaggataggtagtagcctgtctggataaagtcaacattcaatcttttctggatttaacttctagtgcatgttaatattccctggtagataaacattcccagggagggttttcatgacaattggcttccttctggagaaactgcccttagacaggtaagggagatttaggaaaagcccctttatatatttgttgttttctaaacaccttcagtttgaagcaatcacaataccaatgtagcatatcttgagatgttacttcccagattccttcatttgcaactgacctgccaggaaacaccattccagaaggttgcagctccaggtggaaaatacaggtgcttttttctaaacggttggagcagtccctgtctgcactgaggactttccctttcaccgtacttctgctgattccccatggccatctctgccctctctgagaaaggcagctccgcctacacgcatggcagaccacagggcttggaatgagtctttcctcagacagtgctatggtttcactgtatcccctcaatttcatccactgttaatttaatccataatgcaacagaattgagaggtggggcctaatgagaagtgtttaaatactgaaggttctgcccttatgaatagattaatgctactataaaaagggcttttattatggaaccaaactggattcagcttgctcagtgcagtaaaaccagttatccaaactgagtttgcagtaggagaaaaaagacatttatttgcaggacgtcaagcaaagaggaccagacagctaatgcttaaatcttgatctctctaatggcttacaaataatggcttttaaaagcccaggtaagtttcagggaatcaaaagttacaggcaaaattgtaaatcaatacatggaggttacacattggctttggcctaagagggcaggatatcatgaagcagcagaatatcttacaggtcatgagtagattgaaaaattttctgatgtgcaattgattaaggaagaaaagctttgtttaaaaattggggtcagcacaaaggaatgttggctctggcctgtgggtgtgactttctccaggcccctcaggtggaaattcagaacaaagaaccatggtcaaatttcagtcccctgtttccccttatgtgaagtctatgtgctggcggatccatttgttggagatctgggtttctgaaaaacaactcagagacatatgctgagatgttctctttagtttctgtagaggaataaaacataatgtgatttttagcttctttgactattgttttagtctattatcgtctccttgcttctcatgttgcttgtttacttctcaaggcttagctggacacctaacatttcccttgaaaagacccaagattttcctttatttccatgtctggggaagcttcaaagacccctaagaaggggtcagatccctgaactatctcaattatgagagcgagctcccagtctctcacttctgctattgtcaggccagggcatggccttccttctctctgaaggactcagcattcaaattccatcttgaaagcacagaaattggatcccaagctgctagttactcaatctttgacttcccatcctccagaaatgtgacagaatgttctttactgattacccagtctcaggtattctgttatagcagcacaaaacagacttagacagacagccctcaattggtgatgacagaaggatatgtatacataccccagctccctcccctctcagctagaatagcccagggacattttccccgtgtttccaaatggggttgagcttcagttatcctaagagttaggtggcttgttgaggtgactttaaccttcaacctctgttctctgcctcactttcctccttccctcccattgtaaatatgctgcatgcatagaaatccttcttgttggtggacacaacccaacacagtggacaaatcccagttcttgggagggctacatctcttgtctctcctttttttttgagactgagtcttgttttgttgcccaggctggagtgcaatggcacaatcttggctcattgcaacctttggctcccaggttcaagtggttctcctgcctcagcctcccaagtagctgggatcacaggtgcctgctatcacgcccggctaatttttgtatttttagtagtgatggggtttcaccatgttggccaggctggtctcgaacccctgaccttaggtgaactgcctgtctcagcttcccaaagtgctaggatcacaggcgtgacccactgcacctggcctcttgtcttagttcttattatttctccttttttgatgcatacaaaaatcagaaaacactaaatttctttttgcccatctatcttaaatttgatttatgcagtaatccctttcttctgactcacaaaataaaagaagcttcttaaaatagcagcacacaggccgagtgaggtagctcacacctgtaataccagcactttgtgaggccgaggtgggtggatcacctgaggtcgggagtttgagaccagccaggcaaacatggtgaaaccccgtctctactaaaaaacaaagattagcggggaatggtggcaggcacctgtaatcctagctactcgggaggctgaggcacgagaatcgcttggacccgggaggcggaggtttcagtgagccaagatcgcaccactgcactccagcctgggaaacagagagagagactttgtctcagtaaaaaaaaaaaaaaaatagcagcacaccatgaggtccacattagaggcggtggaataactaacccctactcttaaaacccacaggtcagagagtctccaaatcacaaattatttcctgcttccttgcttcataaaacagccttgtgaattttcatttgactttaggggtgggcagttgtgggaataatgggagttgttttggggataaataaggaccccccaccctaattatatttatgtcctaatatttggaatctatgaatgttaccttatatgtcaagaggaactcggcagatgtgattcagttaagaaatttgacatgaggagagtatcctagattgcctgtctcaaaccaatgtaatcacaaggtccttataatagaaaatacaggagggtcacaattggagaggagcccggacaatggaggggaatgctgttgtggcagaatggggccaagaagcaaggaatctgagagatcttgaagatgaaaacttagtatccaattctcttccttggagccttcagaaataatacagccctgctcactctttgattttagttcagtgagacttctgactttcagaactgtaagataatacatttgtgttgtatgaagccagtgaggtcatactaatttgttccaacagcaataggatattaatgcaagaggaagagatggcttttatctcctcagtgcatggctgttcttgttctcccaaatatcttcaccttgtaataatttcccgtcaattttgaaaagacagagaacatattattttgagaggaggtagcaccagaattcctctaaggcagaaaatgtcttgggtcagatcccttgattggctctggaacaatctgggtatctgagagcctagagatcagctgtcatagcacgtgagaggaggggagattgttctttggtttgtttttatattaggagggcaaattagacttgcagaacacattctgagagggacagactgagccagggaaattggaagagaaagaggagatgtagaaggggccagagaaaagaaagatgtgtccttcctcacaagtccaaaataaagtcatttgcaactcacaaagacattgacagagttgtgttttctagggaaaactgcagatggggctagtttacgattaaggtcagcatggtgtaagacagagagagcaggaagctgtggagtccacactgtccctacggtgtcttctcccttattatagactgtgggctcaactatgggatgaaagtggctgcatgaaagaaatataataaagccacacagacttgggttcaaattccagcccacatgtgctgatcatgtgattttgcataaaccatccatgagctctgatcattggtttcttcatctgtgaaatggaacactgtgtatatcaaggggtctcctgaggacttaatcagatgatgggccttgaagtatgtgtgtgtgtgtgtgtgtgtgtatgtgtgtgtgtgtgtaaatatatatatatatgtatgatcaattgtcatcttgtttatctttctaatatatatatatccagtcctctttttatgtacccttgaccatgctggaataaaaaggctatgtaagatattactagccagacatcactttcaattcaaattcttcaatatttattctacaacaagcaagtgcatcactaagggcagtggggtttcatgtgcatagcttccactgtaaacaattctacctactctttatgtgtggtattagaaagacaaacaagatgacaattgatcataacacttttagtctgagttgtctctgagctgcatttgtgttagtgtctcattctttggctcctaaggttgtgaccacagttctgagttctaattcttttcttcccacatgcacagcctttctcagaattcactctggcctccccatgctgggaatccagactcaccctcctgctacactccccagaatccagcactaactgcctggaagcttttctttgtaagccctccaaacgcaacctctgatagatacctggttggaggagttagcatcttcccatcaaaaaccactgagaagaaggagaaaactgctagcatgatgtcgctgttgaggagatgtgtacagtccacagattttatgtcttcttcaagtgttcttgtctctttcttgaccactattttaatttcatgatcataaaggagggaggaattagggacaacaaaaagatgttcatccttaagatataaaacatgaaactgagacaggaagagagcagaaattatgaactctttgcagtggtttgggtttccttagctataaatacagcagagccaagatgtcaggaaaggacatcacttattctggttcttgcttttactgcctttgacacccacaaacacacacatacacacgcatgataatgcatttcttctcctaaagggcaggtctatggccaacgaggctctttttcttcagtatcattcaaggataagcgacaataattttagaaacaagtgaaagaataacaatggcttaagcaatgagaagagatctgaagtttggcacattcagggttaatacagcagcttggtgacaggagaaaggccccagattctttctacattactgcttggtaaacttgaccacattggtttttctgtcttgggctcaacatctcatggtctcaagaaggctgcagggactgtaagcttcatgtcctctggtaactgcccaaagaggaaatgaagggcaaagctcttcatcacccctctttttatgacggatcaccattttctccagaagtcctgcccctccttcacacccatgacatctcattgtggagctgatcacatgtccacctaaaccttgctcctttcctgggctgggagcggctcagtgtccttgtcatgcacagcaggacagagacagcgccctatacactaaaagaggagagggtggctgctctgtaggtgacaaaattttaaattccactgtgcttttaaggaaagttgtatgaggaggagaaaagctaggtgcatcttcatactgcaacattcgaagaagccgggccctgaggatgaaaacgaagtcaaattttaaatttctcacatgaccttgttagtttcagcaattgtggaaatgtagcctatgcatttatgtaagtcaaggacatactttcagttaccagaatacttgtagagacatttataataagatccttaaatcagggctaaggtcagacttgcactgtctgaaagctgctgggctctggccctgggctgtggaggaagcagctgctctactgagacaaggggctgaggacctgggaaccaaaggctctgcccacaggtctgcctcacaggggcttcagggaaggaaactgctcacacactcatgggcactgcttcaagcccagagcctgccaccaggaggaaagtctcagagacaagggccttggggctgggcccaagctcctggggtgggctgctctcagctctgttctcactggctctcaatgaccaggactgtgctggagccaaagaggtcagcaaatgtccgcagagtcctgactgagcctgattctgttatagttagaaaaaaaaaggagcacgtgctaaataaacataaaattatgtgtatatgtatatatgcatttgtaacaaactttgtatattaaatatgtataatattatagatgtaaattgcagtgatatctttgtatctactatgcatctatattacgaataaatattgtgaaaggaaaatatcttgggctccccaaatcactaagctaaagggaaaattctagctgggaactgaatagggcaaatctgcctcccattgttttcaaagtcagccctctggtccctgagataaatgcatatctaattacctgttctggaaaggctaatcagaaacttaaaggaaggcaagtttttctctcacctacctgggacttgaaagcccctccctgcttccagttgccctgcttttcgcttggagttgtcctgcctttccagaccaaaccaatgttcattttatatatgttgattgatgtctcatgtctcactgaaatgtttaaaaccaagctacgctctgaccaccttggccacatgcctgcaggacctcttgaggctgtgtcacaggaacgtgtcctaaactttggcaaaataaactttctaaattaccttatacctgtctcaaatgttctgggttcacaatgtgatatgtacatttgtataaataggcatagttgttcctgcagtttgatgtaattctaatcagaaagcaaaaaggctagttacctgatggtgaaggaaacatttgtatttagtgcaaccaaactgaggatgaagcctgagtcctccctcctcaccagagtctgacagcagcagaagaggaggaaagctgtgtctccatgtccacgagggcctcctgaggctgatcctgctcagagagggttgggacggtgggtgaatctgctggcactgccacgccaaaatcccaaagcctggatggcttaagcaatagaaatttatattcacatttctggtggctggaagtctaagatcaaggtccaaccaggtacacattctgttaagaactttcttcctggttcatagacagccatggagaaaaagggatgggggttgggaagagagagggagagacagggaggaaaggaagaggagagctctggttgctattcggataagagcactaattctattgcaagggatctcatgcttaggacctcctttaaccccatctacctcgatcatctctcgcagctacactgggggtcagggcccagcttccagtctcagcgcacagagcacagagcagattttccccaccatttagccttggcagctcttcccaggtgctccaggtcacacatgagaccctgttccagccaaagggctccctgttgacagtgagacaccatcatccttacattcccagtatttcttagttcatggcattctctttttgtactgtggaatttgtttgccatctaggggcaggtgtttgacatagcaatacacacgattttttattttgtaatagggaaaactaattcattaattttgcataaataataaattaaactgaataaattacatgttgaaaaagccaaaggccaattgaagagcttaaaaagagcctgaagagacgaaaaagccagattcctttcagaggaggtgtgttagtcacagatgaaagtctttcatttgcagatgactttttagcaacaattaccaacagtaaatgacaacttctataggctgccacaatatgattatatgttcaaaaattatttccaaatattgtgtaaatatatattcaaattaaaacgaacaaaaatgcaagtttatcaggagattcacacagtaaaaaattgcacaaatgaatccttgaggcaaaagaacatttatccctggtggaaagctggaattttcttaggtctttagaagaaaagagaggctctctaggggtaacagctttctctcctctccgctccaccccatgctgctgaggaatgggaatgggggcagaggctgtgaggaaggaggtaggctgtgctctgagcttttgaggcttctttgtaataaatttgattatcctctggttcttcttgaatcccctttctgtctttgatatcatttttttagcattttgatttgagagtatagcccttgggatatcaaaatcatgtaggctgtatgtttgtttccttgttaaatacatctaaacatcttgagtgagtttagaccttatcccctgtctcacatcaaagcagaatctacagcgactaggtgctgtcaatcacgtgagtactaaagacgatgatggcatttctcagctcctgctcttgctacttacgctttgtttctctgaaatagcattctgtaaaatcatttacactccacgatgtatttattaggatttttaaatagcatatttaaaagtgtctaatgttttttaatttgagggctccagtctgcttgatttctacataaattttgccctatatctatgaaacctaatagaaatggcactttggaattttagttgcagtggccattgaatccattatcacagaatggaaaataatctccaatatacttcaaatcctaaggctgaagcagaagcttcttgttctgttccttcaatcattcttttgtctctatcacaccatgttctgtcatgtaactgacatgactcatcattaagtttgatggaaatttaaaataccattttaagtgaaatcaactgaaaccttacttttttttgcttttatacctaaaatagaggatttagatatattttctaggaacgatgatgtaatatgtaaacaaggaattttggtaatgtttgaaatattttctcatggggacacaccactaaatttgtcacctctaaaacagtacttaggttaaatgctttttaaattcttaaaactggggtaagaagaaaaaatattatgtaattctgcattattcatgtgacatatttagtgagtctatgttgtccatctgtgagttcattctgtttattttcaaagctcacttttgtaactggaagaactttcactgggatgaaggtaattgaggagaattgaagtattttggcattgagatcttttatttgccatgtgtttaccaagtctatgaatagtcaaacctaaacatttttactaattattttttgccacactcccctgaggacagcttgtgtagaataccttctccagcatgacactggagagggcagtttagtgtacgagtgctaaaaaagatacaaggttgggagaatgaaatgaaaaaaatgatttctcaataggaccaagtatcatcttgtataaaataaaccccaagctggtcatttccaacacgtattccacttgtgttgtcactaatctgcatccacggtctggttgttttgacaagtaaatgtccttgaaaaatgtaggcaagatagggagggatgagctttcattcactctcccttcatcatagctggttgttcccaaggctcatggcccccaagaattctcctcctgatgatgtcttccccaggccatggcagctgatgggaccttaacatatgtgactgaggcacagctgaggctctcatgagccagagtcttcagcagcaaaccctttccctgagttccccaacagcctcctcttccgcagactcagagaccctgcagagctgctcccagacagcagctcatgtgggcagttgggacaccccagcaaggaggtttgtgttcaaggcgttaccactgtgcaaggatattatgtagcttgcatgtattaataaagtcgaatatcctcagcctccaccctgctaattttgagtttaaaatatgtgcctgacccactgctattgaacctgtctgggactccagaggccccattggaaaccccatagatcaggagctgtggagactcgcctggcttctatagttaccaatacaaataggtgtttccattgctatgcaggagggtctgactagacctgcaggagatgaagtacaaagttatgtacaaatattatgagcaagtatcacgatttcccttatgatatggatttatcatttatcttttaaaagattttttattcacatcataaaaaatacgtttttaaaaatgagcttaggccggttgtggtggctcacgcctgtaatcccagcacttcttggtccgcggcaggcggatcacccgaggtcgggagttcagactgaccaacatggaaaaaccccatctctactaaaaatacataaaatcacctgggggttgggggcttatgcctgtaatcccagctacttgggaggctgaggcaggagaatcacttgaatctgggaggcggaggttttggtgagccgagatcgcaccattgcgctccatcctgggcaacaagagcgaaactgggcaacaaaataaataaataaataaataaataaataaataaataaataaataagcttagtatttactaggtacaagagaccctttattaaaagatattattcaaggcactggtcattgttctttcaggtggtttctaatgattacacataggctcaaagtaaagggagaaagaaagatctatcaaacaaatggaaggcaaaaaagagcaggggttgctattcttatttcagatacaacagacttaaaactaacaatgatcatggctgggcgcggtggctcacacctgtaatcccaggactttgggaggccaaagcgggtagatcacgaggtcaggaaatcgagaccattctggctaacacgatgaaaccttgtctctattaaaaatacaaaaaaaatagccgagcgtggtggcgggcgcctgtagtcccagctacttgggaggctgaggcaggagaatagcgtgaacccggggggcggagcttgcagtgagccgagatcgcgccactgcactgcaacctgggagacagagagagactctgtctcaaaaaacaaaacaaaacaaaacaaaactaacgataatcagaaaggactgagaagagcattacataataatgaagagttaaatttaacaagaagacttcactatcctaaatatattatataagcacacagcagtggagcaccctgatttgtgaaataagttcttagagacttacaaaaacacctagataaccacacaatcatagagtgagacttcaacccacactgacagtattcgacagatgatttaggcagaatagtaacaaacatattcagaacctaaacatgacactttacaaaatggaacaaactgacatctacagaacaaccactaaaaattacagaatatacattcttcccatctacacgttgcaaaaactctaaaattgactacactctcagccatactgcaagtgtcaacaaatacaaaaaataaaaatgataaaatgaaatggaatcataccaaccacactctcaggctgaagtgcaaaaaaagtaaaaatcaacaccaaaaagatctttcaaaaaccataaaattaagtagaaatttaacaatctgctgcttacagacttttgggtaaacaatgaaattaaggtaagaattaagaaattctttgaaactaatgaaaaaaaaagagacaacataccacaatctctgggacacagcaaaagcagtgttctgaggaaagtttatagcgctaaatgtgcacaacaaaaagttagaaaaatcctgaattaacaacctaacgtcatacctagagaaatctgaaaaacaaatgtgaaccaaccccaaaggtagaagaagaaataatcaaaatcaaacctgacctgaatgaaatagagaggagaaaaaccaaacaaaaggtcagtgaaatcaaaagttaggtctttgaaagaagaaataagattgatagactgcaagctagactaataaagaaaaaagcaatatccaaagaaaaacaaccagaagtgacaaacaggacattatcactcaaccctcagcaataaaacaaacaaacaaacgaaaaacccttggaacctataaccaacacctctatgcacaaaaactagaaaacctagaaaaaagtgcataaattgctggaaacaatctaccaagaatctcgcaggaagaagctgaatgcctaaacagaccaataatgagttctgaaattgaatcagtagtaaaaagcccacctatcagaaaaagtcctggaaaaaatggatttacaaccaaatactaccagacatataaaaaaagctagtaccaatcctagtgaaattattccaaaaaaatcaaggtgggagatctcctctctaactcattctatgaaacccgcatctccctgatagtaaaaactgacagaggcacaataaataaaaacttcagatcgctatctctcatgaacataaacacaaactttctgaaaaaaatactagcaaacattattgtgtagcacatcaaaagctaatccaccataattaagctggctttagtcaagggatgcatggttggttcaaaatgtaaaaatcaatacatgagattcacctcataaacagaactaaatacaaaaactacaggatcatctcattagatgcagaaaagccttttgatagaattcaatgccccttcatgctaaaaaccctcaaaaatctagacaatgaaactacacaacttaaaatattaacagccatttatggcaaaattacagccagcatcccacagaattgacaaatgctggaggcattttcgttgagaaccagaacaagacaaggatacccactctcaccactcctattcaacatagtactggaatttctagccagagcaatcaggcaagagagaaaaataaaaggcatccaaataggaagagaataagtcaaactatctctctttgcaggcgatactataatatactcagaaaaccccacactctctgcccaaaagcttctagatctcataaataatttcagcaatatttcaggaaacaaaatcaatttacgcaaatcagtagcatttctatataccaataccattcacaccaagagccagtcccagagcccaatcccattcacagtaagcataaaaaggataaaatacctagaaatacagcttaccaaagaggtgaaagatctctacaacacgaacgacaaaatactgctgaaagaaatcagaaatgacacaaacaaacggaaaaacattccacctgcgtggatagaatcaatacttttgagctggtcatactgcctaatgctatttatagattcaatgctattcctgtgaaactaccaataacatttttcacagaattagaaaaaaaattctaaaatttacttggaactaaactagagctaaaaaaaaaaaaaaaatcctaagcaaaaagagcaaagctggaggtatcacactacacgacttcaagatatactacaaggctacagtaactaaatcagaagagtactgctacaaaaacaggaaccctagaccaattgaacaggctagaggattcagaagtaaaaccgcacacctacaaccatctgatcttcgacaaagctgactaaaacaagcaatgaagaaaggacccccttattcaataaatgctgctgggataactggtacctatatgcactgaaatggaaacctttcactatatagaaaaaccaactcaagatggattaaaggcttaaatataaaatctaaactctaaaaactctaataaaaatctaggaaatgccattcttgacatttgctcaggcaaagaattcatgacatagactccaaaagcaattgcaataaaaacaaaaattgataagtgctatctaattaaactacacaacttcattacagcaagagacactaacaacagagtaaacagacagcctacaaactgggagaacatattcacaagctatgtatctgacaaaggtctaagatccagaatctacaaaaaattttaaaaaaatcaacaacaagaaacaactccattataaaatgggcaaaggccatgaaacagacacgtatcagggagcagtgaaatgagtgctgggagctgcctgaggtcactcctctgctttttccatctggttttaagtcacctaatccatcaaaataaatacaattttgcctcaccaggcacaatggcttctctcatagtcaactgattcaatgatagaacaagtagaaggaatgaatggattgtttcctgtgcttctcaactctttggtgttctcatctcctaagctcaccgtgtgtttcatctcccctctgctgcactaacatccaagtgcatgtgatgcttcagctgcgttacgcaaagcttcattctgaagtctgttgaagttaagagaaacttttaccagaggaaacgtcagtaaataaaaacaatcctgaaattcttctagcttccacattttctctacttcctctctaaaataggtagaaggaaacctaaaagaagttaatcaaaagaaaacatacaagcagccaacaaacataaaaaaatggtcatcatcactaatcatcatggaaatgcaaatcaaaccacaatgagatactatctcatgccagtcaggatggctattactataaaggcaaaaaatgacagatgctggtgaggttgcagagaaaagggaatgctcatacactgctggtgggaatgtaaattagttcagcagttgtggaaagcagtataacgacttctcaaagaacttaaaacagaagtaccattcgacccagcaatcacattattacatctatacccaaaggaatataaatcgttctactatacagacatgtgcacacatacgttcatggcagcactgttcacaatagaaaagacatgaaatcaacctaaatgactatcaaaggtaggctggattaagaacatgtggtgcatatacaccatgaaatactacacagcaattaaaaatgaaataatggtcctttagagctacgtgaatgcagctggaggccattatcctaagcaaattcacacaggatcaagaaacttgatcagacagcaccgtcctgtgggcacagcctcctgcctcaccatcttcctgtcacaataggaggacttttctttttctttctttctgttttttgagaaggagtcttgctctgtgacccaggctggaatgtagtggtatgatcttggctcactgcaacctctgcctccctggttcaagtgattctcctggctcagcctccggagtagctgggattactggcgtgtgctagcatgcttttctaatttttgtatttttagtagagacggggtttcaccatattggccaggctagtctcgaactcctgacctcaggcaatctgcctgccttggcctcccaaagtgatgggattacaggcgtgagccaccgcgcctggccttggaattttcttgatcatggagacaaggatgagtgatatcttgatcagggaggagtgaaatcagtgctgggagctgcctgcactcactcctctgctttttccatctggttttaagtcacctaatgcatcaaaataaacacaattttgcctcaccaggcacagtggcttctctcatagtcacctgattcaatgatagaacaagtagaaggaatgaatggactgtttcttgtgcttctcaactcaagctgaccaagaggctgcctttgctgttctcatctcctaagctcactgtgtgtttcatctcccctctgctgcactagcatccaagtgcatgtgatgcttcagctgcgtgttactcaaagcttcattctgaagtctgttgaagttaagagaaacttttaccagaggaaatgtcagtaaataaaaacaatcttgaaattcttctagcttccacattttctctacttcctctctaaaatatgtagaaggaaacctatttctccttgattatcaggttgtatgtccccagcccacaccataggaccctttgttcaaagtttgtcctgaaccataataagaactaaatggccacatgttcatcatttttttcaatttaatgcaacaattatcatgctaattctttgaattaagaactatcaactggaaaaccagacaagagtgaatagaaacaacatttcaatcttctctgtacccataataaatagtcatctctcagattctcctattctgttaatgggggtaacaacgtcatacacatcagtgtttcagggcctccagcacatctggtaagacagtgatttgacattacaagggttagtgttttggcttttcctgactactaatggattttctcttttctataaggacagctgcccctggacacatgacaacatcgtgaatatacgttgcttcacttttttttttttttttttgctatagatacttccaagtgatgattctggcagaaacatgactgacaagaaaggcaaatccatatacaggaaaactaccactgtcctctggatgctgggttaggtgcactgtactcatttgacacgcgttgttagtctgatcactgatgtgtggttagatgttagtggtttgggaggggtaatgctacttggcaagttgaatgctcagaagagccataggtatgcaagcctcattaactgaaattcatattgttgagctcctgcatggatttctatggttcatgtcacttcctaaaaaatctgggaaagttgactgactgaaggccaagcattcgatcgtcttaattactaagagctggtcctcagtaatggaatagatatgaatattcacttaggaagcatttatttttgatcttgacgtattttcaaagatccagtcacagctcttccaaaccaactttgtctcgagtccttcagttttgtttcttctgaggcctggtgatctctccaaaccaatagccaatgttatggaattgctaatccctctttgcaaagtgtacggtgacttcacccttcgggtttgcccactcttgtgactgctagtctcccagggtatcctttaccatggcagtggtatgacatcaatacagcacccagttatgagaactccatccagcatggcatcattggcagcatatgcatgattggacttccataggatgaaatgattaatttttaacagtaggcagttatccccattcataccctttacccctccacttgagttagaaaaatattttaaggtgtaaatacccattaggtgagtattttataactaaaggttataaaggaactttctgtagccacagcagatactacaccaggtctcgggcaccagtgttcttatggggggaaactgaaatcaccttcacagatttcatttttatataattgttttgtaaatatgcatgtgttacttctatatggatatataaatatacttaaatagacttatttaaagataaatatgtgtacatatacgtatatgcaaccaataatttttcaaaaatataaatgcaccaatatgtatgttatatacactcaaatatgtattttccccaaatgacatcaatttcatggtttttattggtattaagttttaatgttttaaatattgtcttagtatctctatatatggattaataaatattcatatttatgccatcaattttaataaaatgcatctatctaaataggtagatgtataaatactgtattggtcagtttttgcacaataattattgacaatcaaccacttaaactcttagtgtcttattaacactaagtatttattttcatattcctgaatgttcattttaataatcagttggctgatcccaaggcagggctcagctggttggttcggctgcagggaatcgagcttgtctccagcctatggattgcatttatctgaggccaagcctgaaggacactgactactcagggcagaagattctcatggcaggtcgcaggagtagacaaatcccaaaccaagctgacctgatacaattaagcccgagaatctctaacataggtacacacaactttaattgattctttcacttggtaattattaaagtttctaaaaatgtttactccatttaaacatgaagttatttgataattctatggacatatataattatgattttcaacctttgtaatcttcaaaatgttttcaaatgcaatgttgcatcaatttgaaagtaaagctgggtgtgctttcaacatgtgactctccattgaaattttcttaaatatcctcattgagaaaaaaataaatctctttagctaaaatatcacctaaaacataccttgttaagctttatgtagatcacttgttaccgtgttaaaatgaagattctctttcaggtaatttgaggtgggcctgctatgtatcttgcaaggcaccctctcagtattgctaaggtgctactggattctggatagttttgagtagcagaggactttcatattaagaggaaaaatgctacatccatgtttaggattttctcttgttttcctttttgtcaaggaaaaaggttgtcaaacgattgttataactatctatttatctttttgttttgttttgttttttgtagagacagagtcttcctatgttgcccagtccaatctcaaactcctaggatgaagcaattctcctgccttagcctctcaaagtgctgggaattacaggcatgagctaccacacacagccttataatgtatttcatacagtttcctgatttttctgtttcatctatgacttaatgaagttttcttgctatgaacccagagttgctcgtaagacgtgatagcacattcgagtatattctgggacaatctgtaactggcaaagttttgagccttgtggaaagagcaaccttactgacctgtcagctgtcaattccccatcgctactatcacttctggacgcacattttccaaaactccttttctctctatggtttctttagagttgcttaatgagaggcactcccatgagattgggaagtcagagtggtggattcatgtactctgacatctgaagtaaaacatgtggaattgtttgtggactggagaatcacctggagacgtgctgcaggcagctgagagcatcagcaccccagccctcggcttcccagacaggtctgaggatcatcacacggtactcagcacataccaccaggggcaggtgcactctgacttctgcaggagcacctgagaatcccctgtctctagtggctgcttcacgaataacataccgtaggcttcaaaaagactagtttagactctaatttattcaacttgaacaatttctccttgaaataccgagaatagcttctcttttgctgtgtaaattccaattatcccataacacagactcctcaggtggacttgtatctcttccttattcaatcaggacaggcattgtcacatcttttctcctggggataggggcaaaagaggcttagagttcagaggagcctccctggtcccctctacaaaagtctcccaatgactttcaaaacctgactgagtttgagaaatgctctcagcagatggaggcaccaggaggagcatctggggtggctcgtcctcacacatctgcttccttggaggtttatgttatgacttgtaacactgtgggaggggtactgtaactctgttgacagtagtaagttgcaaaatcttcaggttgcagactgctgatggtgagagtgaaatctgtcccagatccactgccactgaaccttgatgggaccccactttgcaaactggatgcagcatagatcaggagcttaggggctttccctggtttctgctgataccaatttaaatagctgctaatgctctgacttgcccggcaagtgatggtgactctgtctcctacagatgcagacagggaggatggagactgggtcatctggatgtcacatctggcacctgagattggaaacataaaaacaaatattcttactattaatcatgttatcagagaacttccctgaagttccagtcagtactgagcacactggctgagtaaattcctagtgttctccatccttacctcggagccagagtagcaggagccccaggagctgagcggggaccctcatgtccatgctgtgtcctgactgagactgactcctgcacagggtgcgaccagcccataaaaaagtcttcagggcaggaggctgtgctctggaacatgcaaatcaatcagcagggcatggggcaggctgagcacagctgcagggctggctcatcttagtaactcagcacaggggcaatgtccccagggtcccaggtcagaccagcgcagcatagatttgcctggagggaatgtatttctctctagagccgctgttgtgacaagagatattttgaaggaaaaaagtcaaactttaatacaaacctaaggactatatggaataatatattttagagttgtattgggagtatacaggagagtataaccattcgtagggaatgtctaatgaagtcttagagggtgggtctatcaggccttcaagttacttaaagggatgtggagagtaacaatcccttttgctatagtaacaacacctctgtgattgtcacatggttcccattgtttcatgtgagaaaaacagtctttatcagaagcatatttaatacactccaaagtatttgtagtgaccttaaacatttgtaattaccagtatatttacaagcaattccctgcagatgcacgataatgatgctgtgattcctcagcgcctgtgccactcatagatcttccattatcagagctataggtctctgtaatacccagggtctcaatgggcagcagcttcgtcttggtttggggctccccttattctgcccatttttctgcccttgggtattatttcccataggtcatcagtatgaagggttgattagtaatgctagatctgtttacttcaaaaaacatctctgtttcttcctccagctgttgaagcctgaatcaggataaacttgaaactctgggtcaatctagaaccccacatcaattgtctccaaaggaagaaggccaaggtaatgcaacttgcctaatgctctgatctgcttttcccaccataatgtttgtgagtgttcaggtgtggctctcaaaaatcatggctttctggaaagcaatgggagggagaggccctggggaaaggccaggtcagtgaacactttctcttctgtgagggtggcgaccactcagtgcatttccctgccctgcaccatcaaagccacttttctctttagcagtgagtagggacatcatcctgactcagacgcctgcctccttgcctcacatccaggaaagagagtctccatctcctgtcaagccaccgctcatgtacacggagaaatgctttgaagctggataaaacttggaaacagatttgaacccctatacctcacatgtctgcctctgcccaggcatcccagcctggttgtgcagcaagggaagtggaatcaactacatcgacatgagaagactagaacctggggagtccagggagcattactcatgcatcactaagggtgggcagactgctgtggtatagcctgtacacaaccccctgctcctttccaggggcctgaatttcaagggcagttactggtaaactgcttgctaagatttaggttcagagagaagcagttctggattgcaatacacaatttcgtgtgtgtgtgtgtgtgtggggggggggtgaatatagttgtcactcttgctaccctttcccttttccctttgctgtacttctgctgaccccccatggccatatcttttcctcactgctctatctgaagctggagaaggcagccctgcctgtacacatggcctatcacagcacctggaatgagcatcctctcggaaagccctcaatcagtgaggacagggaggtgtatacataccccatctccctcccttcttaggtggaaaaatactgagacattttcccatgtttccacgtgggcttgatctccattcatcctctgtggtagcttctcgctgaggacattttcggtatcgctgctctctttcctctctcactgccttgtttcctcctagtgtttactgtgcattataaatatgctgcctgcatgggcatcattgtccctgaaagatccaacctaaaacagtggacaaaccctcattcttggaaagtatagtctgaatacttgccaattctttttttttcatgcatagggatattcagaaaatttaggaaacagctgaattatctaggaaagacagcgtcatcagaagggtctttataatagggaggagtgggggtaacagtcagagaggaatagggacaatggacagggatgcttcagtgatggagaaaggggccaggcagcccggaacatggggctatctttgaagatgaaaagctgagaatcagattctctcccctggaacttccagaaggaatatagaactacggataccttgattataaatcagtgagacttctcactgccagaactgtatgataataaatttgtgttgtatgaaactagtaagattctgataacttgttacagcaggagtaggaaactaacacaaggggcaggggtgtcttttacctccttaagggcatggttgccctctgttcttccaaatatttttatcttgtcattttttagtgtcaattttagcaagacacacagaaaatttcactgtgaagatggctagcaccagaatccttgttatgtgtaaacactcttgcataaatcccttgattaactctcgtactctctggatatgtgattaactcttgtatcctctggatatgagaaaagtaggggaatatttgttcatttgttttcatattgggggagaaatcagatttacaggacatcatttgagaaggaaggactgggacagaaagatgagaatggtagaaaagatgcaaagtgttcagggcaatgcaagatgtgctcttgccctcgaatctgaaagaaagacatttagtatttgtaaagactttgaggaagttttgctttgtagacaaaactgcatgagagcctgagtttataattggagtaatcacggtaaggtgtagaggtagcagggagcttgtgttgagaatttcacaccactcttctggctttgtctcttctttgaatttaaaggccattcaatcgtatatgaaacaaacgtggccatgtggaagcaacatatttaaggttatgcagacctgggttccaagctcagccctgacaattgctgaccacatatctttgggcaaaccatctctgttgaatagtttcaactacgggctctgataacagtttactcatctgaaatgtatcaccaagggtattaagggctgtcctgagggtttctctagttgatgaaaagactgcttttcatacatatatatgtgcatatatatgtatgaaaagactacttagggtcccttttatgcgtccttgagtatcttagaatgaagattctagataagatactactagtcacatgtcatttttttgtattattacactttaagttctggggtacatgtgcacaacttgcaggttacataggtgtacatgtgccatatgggtttgctgtacccatcaactcgtcatttacataaggcatttgtggtcaattttagaataagtgcgatgtgctgctgagaagaatgtatattttgttgatttgggatggagagttctgtagatgtctattaggtccacttggttcagagctgagttcaaaaagtcctggtttggtgggttttttgtttgtttgtttgtttgtttgttttggaggcagagtcttgctctcttgcccaggcctgagtgcagtggtgtggtctcggctcactgcaacctccacctcccgagtttaagggattctcctgtctcagcctcccgagtagcttggactacaggcacgtgccaccatgtctggctaattttttgtatttttcagaatttctgaaaaattttgtatttttcagatttttcattgtgttagccaggatgatctccatctcctgaccttgtgatccacccgccttggcctcccaaagtgctgggattataggcgtgagccaccaagcccagcctcagatgtcattttcaactaagaactgtcaatatttattctgtaactaacagatgcccctgtatatactgggtggcttcctgtacaatgtttccatcataaaaatcttcttctaaccaattatgtgtaacattagagaaatgaaggtggagagtgcaaatcatcatactacctttaggctggacttatcctaagccccatttttattagaattcttgggctgctataacaaattactaaaactttggtggcttaaagcaacagaaatatattctcctcctatagttctggaggccataagtccagcactagtttcaggggtcaagagcaggctgtcatcaaagcttctgcagggactccagcggggagtctactttttggcttcttccagcttttggtggcttcaactttctttggcttgagtccacatcacttcaatctctgccactgtcttcaaattgccttctcttctgcagactttgttaaaatgtctgtctatgtctatcttataaggacaatcgtgatgtccttataagagagatagacagacatttaataaagacaggcccatttagggcccacctggtcaatacaggataatctgcccaattcataatccttaatttatatatgcaaaggcccttttcctatataaggtatatgtatcggctgcatggaatagaacctgagcatttgagcatcatactcaacaataaaccattaaagaacatactatcagtgttggtactatacacacatcacaggctcttctctctctctcctcctttctctctcttccttgtgactataaatttcctcacttccctaagtgtatccagtgccacctatgtccaggttagagcagcacacataggaaggccttgctgaggttttgcttagagacctgctctatccctcattatcattcagaaagaaggacacagccaaagacagccctcagccatctggggagcagctgtctttacagaggacagtcacaggctatcattctctggacctctgtttatcttcagatgtctgtggccctcagccctcagtgagggtctgtgtggcaactgattcgagtaggatccaacaggacccttatcagaacatctggttcacagaaggcagtgagtataaggtaggagatcatcagggcttgtattctgagcactgatcacaacactggtcatgacaacactgaccagaacaggatctggacaaaacaggatgcactacagaaactggcccaaaccagctagaacaaagatggtgacaaaaacgacctctagagcacagtgtgagtggatcttcccctgggggctcccatcagacagagtggcagccatggctcagtgctgggtggtcatagtatgaaacccccccacggtcttttcatagcccccctctgactgcagtgatgtgggatttctctgtccaactttcatggctccagcagcttccgggactctgttcacagtgggaggtcatgaaggtagttaggctactgatggccagagtgacgtctgtccagactcacccccttgacccaggcaggcatcgtgtccagggagcagtgggagccagcaggagctcagtgtcagcccttatttcacaaggagctaggctagacactgttatttccctgactggctctgctggtgacagtgaccctgtctcctggaacacagggaggggcctggagatgagcaccacacaatatcccaactgtcatataaggggggaacaaatatgaacatccccaaatattaattgtaagtacatacttcattcagtttgattaaattctgagaaagcaaaatgggctaaaaacttcatcttgaaggaaacattcatgtttaatgcacagaaactgatgatgaatcttgagtcctccctcttcaccagagagttggaaaaacaggaggaagaagagcaaagctgggaccccatgtccacgagggcctcctgaagctgatctgctcacagagggtggggaagatggatgagtcagcttccgctgccacaccgtaacacggggctggatggctaaaccacagaatttaattttcacatttctggtgcctggaatatcccagatcgacgttcagcagagtttgttttctgctaaagaccttattcctggtttgtaggtgccaccttctcaccatgtcttcacacagcctttccatggaggggaaggcggttagagagagagaagaaaaaggagaggtctctggatcctacaaaatcatgaatcctactggatcagggacaccccctgccatgacctcaattacatctttagaggttctgatttctacagtcacattgaaaattagggtttcaacatgaatctgagggcacaattcagtccatagcaggtgggacacagccaaggccgtgcttccagtctcagggcatggggcaggttcccacagctcagcacacgggtggctcctcccaggtgcccaggtcacagggaagatttgactctaactctagggctccctgttgataatgggacaccagcactcctacttcccagtgttcctgagaccatggtgctgtcctttgttcattgtggagcatgtgtgccatcttcaggcaggtctttgacatagcaacttatgggacatttgattctgtgattgtgaaaattaattaatagattaattagtcataaataacaaattaaacaatacattgaatcagaaacaaaggagggccaaatgaggagcttaaaaggagtctgagtgtcttaaaaagacgtattcctttcaaacaagaacagttagagtcacagatttttttaacaataactttttagtagcaattatgaaatagtaaatgataacttcaaataggctactacaaatataagtttacagtcaaaaaatattttcaagaatcatgtaaacacattttcagattaaaacaaacaaacaacgaatgtgggtttatctgcagatccactcactggaaaacttctcaaatgtgtgattgagtcaaaagtacatttgtcactgatggaaagctccaggtttgttttttttttttctgtttttgtttttagtctttagaagaaaacagctttctctccactctgtcccacctcatgctgctgaggatggctgggcaggcaatgactgtgaggaaggaggaaggctgtgttctcagggtgttcgtgcctcctgcccaccggagtgacctcacggagcagagccacctacaccaccaaggccacctgcctgcctctgcactgccatggcaacagacaaagaaaccttgttacatttagttcaccatattatgaggcttctttgtaattaaatttgatcatgctctgattctccttgtatctctcccctttcagttttggggatcatatacttttcactattttgacttgagaatatatgcctttgggatatcagcatcatgtaggtggtatctttgtttgctttctccaaaatataactaactaccttgaatgggttttcattttatctcctgtctcgcagaaaagcagaaactcaaggtgactaggtgctgtcaatcccaggagggctaaaggtgacgatggcattgcttacctcgtgctcttgctacttacattttattttcttttactgcattatgtaataaaatatagggtcaatgatgcattaattagtatttttcaataacatattgagtgtctcatatttcttagtttgagagctccggtctaataaatatctatgtacattttgccacgcaacttttaaacctaacagaaatgacacattggaattttaattgcacttcctatggaatctgttatcttgaaataaatcatctcaagtattatttaaacccttagcctgtatcaggatcttgttctgttgattcagtcttttgtgtctctacaccgtgttatcacatgtgacagacatcactcattactcgggttcgtgtaaatttatttggcagaatgatcagatcatggatgcagattagtggtaacacaagtgaaatacatgttagaaatgactggtttggggatagttttttgcatgataacacttggtcatattgcaaaattgctgtcttcccactttccaaactttctcctttaccactcacacgaaactgccctctctagcattatggtagagaaagcactgttgcttttttaacgaaagcatttctgttaggtttaaaagttgcatgacaaaatgtagatagatatttatcagactgtagccctcaaattaaggaagcatataaatttagagcactattgtcaatggaatatattaagagcataatttttctatgcattaacaactaaaatagaggattcagatttattttcaggaatagtatcatataaaaataatgcatttattcattctttgaatcattttcttatgacaacatagcactaaaaattttctctttaaaatgctatgtcagtaaaatatttttaaaattctaagaatttgagaaggaaataaaaatctcatataattctgcattgttcctgtggtacattatgtaaactttatgttctccatctgaattattttgtctattttcaaagcccacttttggaattggaagaactctattttcagtcagcaaaaggcaactgaggcaaatcaaactattttggtattaggatttatatctgtcctggattttaaaaatccataagtagtaaaaataattatccttggccatactcccatgaaaatagctggtgcagaatgctttttccaccataatactagagagggcagtttcatgtgagtaataaaggagagagaaagtttggaaagtgcgaagacttggctccacccaggaagccatgcagcagtgctttcaactctgtggttcttcacaagtaacacatttggcccctttttggatccacatcatcaactgccatcaccaccaccagccacatccccacccaccataatcaagggcagtgtaattgaacaatagctgatctctcttatgttctcttcatgctcccattcctgcagtctgcccaatctcaaattctgaactttggaaaataaaactgtttacctcatcctgtattttctcagtgatccctggaaaatactacatctttagtatactgcatcttccagtgtatgcattttatttttaaaaccaactttcaaaatttcaagaactccctttttctatcagcaagaggtaattgtaatcaaagagttttagtattaggaacttgcgtctgctatgaaattacaaaatctatttgacactcacaaccaagatcttactgattgtcctcagccagctccgccagaggagaattagtgaataatcctgtctctactgtctcatggagtggagaagaatggcaaacaggagaagtaggaatttaaaaagtgggaaaataccaattttacatataaccaaatattttctttgaaaggtacccaaaactgttaaaccctaaaatgtactcaacatgttttgccagaaatgatcagtagtctggcccttttgctcaataaatttaaacaaatgtaggcaaggaaggaggattcagatgagattccattctcctttccctatcatcccagttttttactcacagggccctagaacctcctcattttcctgttggttatgagagtcaaggctgtggcaggtgacaggaacataaacaggggtgctgacctgccgcagtggctcacactgtactgccagcacgttgggaggccaagtcaggtgggtggcttgagcccatgattttgacaacaggctgggcaacatggtgaagcaccgactctacaaaaaaatagaaaaattagccatgtttaatggcatgcacctgtagtcccaggcagagtcctcagaagcaaaccctgccctgtattctccaacagcctcctcttttgcagactcagagacgctgctgacctgctccccagacaagcagtgcatgtgagcagctggggcaccacagcagggaggtttctgttcagggctgtaccactgtggaaggaaactctatacgttgcatgcagtaataaactccaacatcctcagcctccaccctgctgattttcagtgtgaaatcagtgcctgacccactgccactgaacctgtctgggactccagaggcccgataggaaagcgtatagatcaggagctgtggagactgccctggcttctgcaggtaccagtccaaataggtgtttccatcatcactatccaagaggctctgactagacctgcaggagatggaggccggctctccaggggtgacgggcagggagagtggagtctgggtcatcacaatatcctcactggatcctgaaataataacagagaagtgcaagtttatatagatacattatgagcaactttcataatttctcttgtgatataaatttacagttacatttttaaagttttgatttatatcatgaaaagtagactttctaaaatagacccattatttattagccacaagggaactcttttttttcaagttcttaatcagagcactggtcatcgttccctggaggtgaatcctgattattcataagacaaacctgaattccattccctggagcatagaccatgtgcctctatcacattattggaataaacatgtgaagctgtggagcccacagagctcacctcccacccagttgtcctccctcatctctttctgtccttaccagggacccagagcattagcagccccaggagctgagcagggagcctcatggtgagaaggtgaactgaggagtcctgatcagtcaaggcaaggatagagctgagcttttatctcagactcacaagggaaggtccaccctaggggacaatatgcaaatcacctggtgggtgcagtggtgtggaaaaggttgacggggcagggggaatgtctcttctgtgaacaatgtgatataaattgtcctttggaataaaacagaactagattcagccaagtttgcccacaatcaagggaagaaggatctgaaggtgaaagttcggaccttttgtagggacacactgtgtagggcatgactgtaagaaagcaccagaaccctgacaatgtggaaatgtgtgtctaggatacatctctgggaggtgaatgccatctggcttgattccctcccagtcaatctagagtatgaaacaggcccatccccacaagcactgctgaactgagagcctgcaaataaaaagcggcctggagccagttcaagggctgtctggtatctactgtttccaggataactgttcaagaatgttcaactcaaatattagaatctactctgccttggcacctggtgagtgaacagcataagagctctctgtccaagcgcctcacagggagaatgatgtgagcctctacatttagagccaagagcccagtgtaagaaaaaggaaagagagacaaaattttgtgcctccagcagcaaatttaaaattcctggtgaccagttgttcaatctgggatctatctcatcataatcgtctcacacatacaaggttaaccagagggctctttcttttttgttgtttctgtttttgtttttagtagagatggggtttcattcaccaagttgtctgggcttgtcttgaactcctgacctcaggagatctgcctgccttggcccctaaggtagtgggattacaggtgtgagccattgtgcctggcccagaggactctgtcttaagggaagaatcttctagattaatgatacagaacaaataagaaataactttgcatgatgttttttcaagtgatgattagaaaagctcttcccacacagtctccctggtcatgtggaatcaggtcctgtcagggcttccaggttctcgtcaactctgagtgagacgtgagtctcccccagcctggatgtggtgcagccacagccacgagtccacagatccaaaggaaattctctgtgtataaagagcaagaactgcattcacagttttacatctctgggtaacctgtacttgtaactgatattttcttgactttatgtaaaaatgctcacagcttagggatgtgaacctaccatacaactgatcattaaacagaaaaacaaccacactgttctttatttgtcatcgatgtgcttaacattccattgaacagctcctgaataatggtgccaacaataaatagtttcacaaggacagtcacatttctgaaaaaaaaataataatccagtaacaatgaaggactagcttgtagtgtgatgtaagcttgggtaatttaacacaaagccatacttaattgcccaagaacacaaataaatgccattgtaggtaagactgcaaagaaagcttgatctgaatatcttctgggaaatctaccaaaatatcattttttaataagatcggaaaacatacttgattaaaaatgatattgaccttcaaatgttgaactccatgacaataatatgggctgatgatattaaacagtagctacgaggaggtattgaaataaaagtctcatatttcactgttaaaattttatttattcttttctcttattacatgttgcaaattttgggtacccgactttttttctgatgatgtcagcaaattctgatctgcttcttagtgttgaaaaggtcagactcttaaccatggtagtgaaaaaaagtcagaaacatctgaagctgaaggaatggaagaaggagacataaacagcctaactaaaatagaacaaaatggtccattttattgttagttttaaataattattctgaaagggtgttaaatcaataatcagttttatccattatctaatgcaaagatttgaattgcaggaaagtgattaacagtaaaaaaaattgccctgttttcttttactgtaagccaattcttgaaaatgttattttcacaaagtatttagattgcttgaatttaggagagcattgctgttttctatgagaatgaatgaaccattaaaaagactacccctgggatttttaacaaaaatctcatgatttgtcgccttacatatctggaaaatgtaaaaacttggacaaatccttttttagtcagaaaaagcctttgaaattacccgatttaaactgtagacttaaagaacactattactaattctaaccagaatcctccctctcttatctgttgatgcatcctaccagggctttcacagcagcagacaaagctggtcactctacagtggacacagacaagatggaagagcaacctacatttgaaccagggtgggagcaggcctctatgtgtctctcatctgaatcatggtcatctgaatgagggaggatttctacaggcagggtttagtgtggctgtgtctccttttcctgattggttagtttgggatccatgtaattgaaaagaactgtattactcatatgacttgagaagagagtcttggaagtggaattgtttgtgttcattaccgggaatcagtgtttatggggtggacactgtgatcctgtttgtaggggggttgagggatttgttggctgaccaaggaaaaacagatgaccacagacggcagtagcacatgtgacctagtctattgggtgaagctttgacaggtttacagcaagaagtccctcacagcaggtggtagtccagagaatcaggtgccagggttgtttctcaaaatgtgcaggacactgtagaagggatatgcatttaggggatgccacacagcagcacagtggggagtttctgtgtcagagagctacagagaccagtattaagtttaaggttttcataaaccggggcttgtcttacctactgctagcagatgtgggtcaggctttctggatatgtagattaagtattttctaaaaggttaaaactattcttatttttgtggtttttaaaacaattacgttttaaaatttgagtttggcacaggccattgagaaataagcccacagttttgaaataaacaacatagcattttcatttatagatccctgttgcacatcgtgtagactttgttctacagactgtattagtccagacagtgcaaacccacactgttatggatgaggctgagacacacagaggcctgttccctacctgagcatcaatgaaccttctttaaattaaaggtgagagtttgtccttagatgagaattaagaccaagtcacccacaaatggagcttccatctgtgaagctacaggtcctgtgaatggattcctggctcccaggcacctgggaatgaagccgtctgcgttgtctcactaactgaaattgtccctcgctggaacagagattcatggataaatattctggaacacagggagagagcacagggaatgtaggctccttgaatgtgtgtcttctgcttctgagaatctctctctccaaacattgaaagaaacagcattgtttccatatcagacttttctgaatcttcggaccctgttctagatctgtctcatctgaacctgtttccaaatgtttcaattctggtctctactttttcttggaaaaggttttcagaaatcctatgaaactatccacacagctgtgggattaagtggtgggcttctcctctgtgcttgttaatatctctggagaatccaccacacccaccaactgcacaaagtgaagttatgagtctgttttcttcctgagcattctgtgtctcataagttcccctcgaattcacatccttgaagaaaggggtctccgtcctcaaaagtaaaactctataaaaccatagcttgcctgagaagttagtataatttttctactctttgaatgtgaagttagccttgaggccttatagtaaaacctggtttacttgagagatgggaaatgaagatcccaagaagtttttagagactaaattggggattctagccatttaaactgtagtagaagctgcagttgatataagaacttctatgaatataacaagaaaataaagtggaataacttatttcttgtaacttagataagaacttcaatgaatataacaagaaaataaagtgcaataacttatttacttgtaacttagataagatagtttacctgtagaaaaaatgaaaatagaatttgtgagttctcacatcgtttttttcatgttaaacaattttaagaatcaagcaaatgtttatataaattataatttataatgtttaagactctagagaaaaattatggttcaaatcaatcaaactgagttctaaagacagctgaatttttcctttaactgcttcttttcacctcctgttagcaaaaatcaaaagtacagaaaaggaaacagacaagagctgaataaagcatttagtgctcatttcttgtcttataataatactattaataattaataataataatacagcctctgcattgacaactggaaatagtgactctgcccttctggaagcagcagcttcacatcacagcagtgaacttcattataacttggtgattcttgggcaggagctaaggatcacccaagtgtaaatgctctgtgaagagccagttgcccttatgttggaatacttctagatattaacgcttctaaaatatctaccagcaaaaaaaaaaaaaaatgaagcatcagtaataaaatgaaataaattctgacttcccaggagcagtcaagaataaaactatcatgtttaacagaggactagaggcataatttcctgctagctactgatttagctggatcttactcatagtaaatagtcttaccttagtaaattagaaacatcctcaacctagaaaatggtttcttttgtattctggaatcctagcagtcctaggcaaaaattaatactgaaaataagaaggtacacaaatctgttataacaggaaaactattatacaattatttgtataaggcaaaataaaaggaagaaacctattgacttatggaagattaaagcaaatacttactagtcattaatagtcctaataagccataaagcaagagtaatatcttttgtctctggcttgtgatggtattaaatttcaaaataatgattttgttttgggttaaaactaacttcataggttttctcagagtaggtcatcttactcagaagttatagaggaaaatgaaaataaagaaaaacctattatgaaatttgccccaggttaacctttgcagagagactaagagaaggataccatttaaatgatcctattaatagcattaaaatatttaatttgctaggcaaatctaaaatcaaccttttctctagaatttgaaggaagacaattatatatttagagaatttgacttgagtgtccttgtgagtggctgacagacaaacagaccagatgaatgttggtgcagtagaatcaaggacatcacaacattaaattttcctcattagagagcaagtccagatactgcaccacgaccgggtcaatgatcagaaaattacttgggaactctttgtggctgcctagtcatattgtggctgtggttgagaggctgatttcccctggctggtattgccctgcaccttgaatctgggcattcgtctctactgctgccatcaaatgccactaaatggtgtccccattaataaggcctttgtaatgtgtgtaacataaagacggagtgaatcagagttcaggattacaggaatatttattttattccagtgttgttaatatgtgtctttgtctttcaaagaaggaagccacaaataggacttctttggtttctggaggctacatattctaccccttggaatacaggtttggcccagcaggtgacatgaaagtcagccagtcgtgagtgggactcaggatagaaaagggctctgcagcagatccaggttgaagtgcaaacggcccagcctcttgggccactgcggatgcaaacgacttcaacaatgctatcaaccatctggacaaggctgatacttagagaacactccaccaaaccacagcagattccatggtctttcaaaacattggctaatgatacactatattttgggcaacaagatatttcaaaaaaaccaagctgattaaatcaaaaaaataaattattcataactgaggggattgtattagaaatcagaaacagaaagttatcagaatggggttggtgggagaaggaggaggaatgaaaaattacctattgggcacaaggtacactgttcgggtgatgggtagctaaagcccagagttcactactatacaattcatcagtgtaaccaaaaacaactcttaccaataaagccactgaaattctaaatttaattttttaaaaatttgccaaaaagaatctaaatatttggaaaatatgtaaagtaccactatatgtagtttggggcaaagaagcaacaaaaagggaaattaaaaagtacttggatctgaaagtaaacatcacatatccaaatttatgagattcaaaaaaatgcagttaatttatagcattatgaatgtgttttagcaaagaagttttcacatcaatcactggaaatgtaatcctgacaaactaggaaaaaaagaataaatgccactcaaaagaagggtcttttattcttagaaatgtgaggatgtgacaagcacacatctagtattccaccaatacagtcatatcagtctccaaatgaaaacaccattagcagctgcacaagaagaaagtcttagagtggacgagcagagtgagttactgctcagagagaatgaggagtcagggaaagtcaaaataggattcctgtgtgatattattatgagctgcacaaacatgagactgccctgagccctgacttactcataagccgaacatcatggagtgcaggccattttccagcctcctgatggttggtgagagtggggtcacttggcaaaggcatggagactcgctatgaaggtcatcagtggcagcaggtgaggacagaacacactagggttcccttacagtgacatgactgagcatccctacagccatgagaacagcagggaaccttaggggctgctccagggatgatgtggcagcaaaccctggagggttggtggggcttcagcgccctacatgtggaggaaagaggaggctttggaaggtgtcctggaggaccctggccctgttcacacagaagaggagcctgtgcctatgactaaggcctcatggcctcttccttcctcaaaggctttccagtcatctccctgagcccacctgactccaactgctggagacacatcccctggcaccgcacctgctcctgccacactgagaggctgaacttactttgaggtttgtgtttggggccatcacactgttcagggacccggtgagtgtcctgctcacaggaggctgtgcagcatttccaggctccaaagtggtgtttgtgatggtgaaatccctagaattttggttagatgtgttttctcacttgtgaataccttctgtagacctgtcattctgtgctttacaaactcttttctgtaaactatctattctttgtttttggacttttgggttaagaatgtaattttaattgtactatctttagtctccacactgctgattgtggaagtgaaatcaacgtatttttggttggatgtgtgttctcactcatgaatatgtgtagaaaagtcctctgaagacttgtctatctttgtatgtgtgacagattctttctatataccatgccttcattatttatttattttttgatttttctcctggggaatactgttttaacttcacttaccatggtgtggatcatcctagaatagacaatcatttctgatgggtttgattattttaaccagaaacaaaggtattttgtcctatgggtgcaaacacttctatgtgttgattatatcacctcatgaaatggaactgatttgcccatgattcgttcataaatatttctgaagaattattttaagtgacaccatgcaggccgggcgcggtggctcacgccagtaatcccagcactttgggaggtcaagacgggtggatcatgaggtcaggagatcgagaccatggtgaaaccccgtctctactaaaaatacaaaaaattagccgggcacagtggcggacacctgtagtcccagctactcaggaggctgaggaaggagaatggcttgaacccgggaggtggagtttgcagtgagccgagatcacgccactgcactccagcctgggtgacagagcaagactcagtctcaagataagagaaaacaaaacaaaacaaaacaaaacaaaatatatatatatatgcacacacacatatatatacacacatatatatacatatatatacatatatacatttacttatttcaaaaccttttattttttgtgataatttggtacccaaattgtcatttctaaatgaccagtaagtttcaaaaggaatcttcctactttggggcaacgatgtaagggttgaaaggctaaagaaccactgcaagaacctggagagaaaacaatacaaaagtttatattaataacatcagagaacagtagaagaaatgagaactaagtgacctaaaattccaaagtgaaaagcatcccttctagtttagctgatgctggcctgactctttgtcctcctgccatatctgccaagtttgcatgtggacacagtctctctcttggcacaagcagaggaactctcctcagaaaggagaatcagattgaccatcaggagttgcacagagcagcctctatacatggcccgtgtcctccgtagggcatttgctgaggtctgaatcatcaggcaggctgtaggagatgggctagaagaacataaaactcccacggactcagcatgttcttccaaatccccaaagatgcacagagcatcctgaatacatgtctgaatcgtgcacattgacctcgaaccacactgatcccctgcaagtgtagaccctgcctggccttgtgctctgcatgtcagtggttgtgacatctccagaccgaaccagtggtctctgctaaacctcctctaggggcagaatgagtttcagaagctctgctttgctgttgggatttgacttaggactgagtgacattacctcaggtctccttgcacagggacttcactaaatctttggtgattacacacctaaagcactactcacgactttactttcctgtgagacttccagtggcacaggctccacccaggaagccaggcagcagagccttcaactctgtggttcttcacaagtatcatatttggctcctttgtgggtccacatcaactgccatcaccaccaccaaccgcatcccacccaccataacccaaggcagtttagttaaacaataactgacctctcctgtattccccgaatgctcccattcctgcagtctgtccagtgttgaattctgcactatggggaacaaaaaggtttttatcatcctttactttcccagtgattcatggaaaatactacatctttaggatactacatctttcaggatttgctttttacttttaaaaccaacttttagaatttcaattactccctttttctatcagcgagagacaattgtaataaaataattttactattaggatcttgcatctgacatgaaattacaaaatctatttggcattcacaaccaaggtgttactaattgtcctcagccagctctccctgaggataactagaggagaatgccgtctctactgtcttacggagtgagcaataagtgttaaatagaaaaacagggaagttgaaaaagtaggaaagcacttggatttggataaaactgaacacagatttgcacccattatatctcacacctttaacaggggccaaggcatatcagcctggtgcagtagcagaggaagtggattgaactacatcagcatcagtgggcttcagcctggggttctggggagtattactgatgcctgactgggagtggtcaaatcactgtggcggagcccctgcacacaccctcctgttgcctattcaggggcccaaattttgaggaacttactcatttagagagaaaaagggaaacttctcatttgccctctaaaggtttgcagaaaatgaacggacaaaacgcaaattaatggaaggaagaggcaaaaaaaaaaaaaaattctgtaaaatgtaggggaaaaatcacagggtctcactcggttacccaacatgaagtgcagtggtgtgatcatggctcattgaaaacttgaattc

SEQ ID NO: 112 - DNA, 515442 bp, Homo sapiens
caatggaatggaatcaacccgagtggaatggaatggaatagaatggaatggaatgcaacggaatggaatgaaatggaatggaatgcaatagaatggaatggaatggaatggaatcaacacgaatggaatggaatggaatggaatggaatggaatggaatggaatggaatggaatggaatggaatggaatgggatggaatggaatgagggaatgtcattgagcaatgaaggaatgtcatccttacccagatgccagccacctatctcacatccaggacagagtctccatctcccctccagcaaatatgcatgtatgtgggcatggtggcacgcccctgtgatcccagctactccataggctgaggtgggagaatcgcttgtgcttgagaattcaagttttcaatgagccatgatcacaccactgcacttcatgttgggtaaccgagtgagaccctgtgatttttcccctacattttacagaatttttttttttttttgcctcttccttccattaatttgcgttttgtccgttcattttctgcaaacctttagagggcaaatgagaagtttccctttttctctctaaatgagtaagttcctcaaaatttgggcccctgaataggcaacaggagggtgtgtgcaggggctccgccacagtgatttgaccactcccagtcaggcatcagtaatactccccagaaccccaggctgaagcccactgatgctgatgtagttcaatccacttcctctgctactgcaccaggctgatatgccttggcccctgttaaaggtgtgagatataatgggtgcaaatctgtgttcagttttatccaaatccaagtgctttcctactttttcaacttccctgtttttctatttaacacttattgctcactccgtaagacagtagagacggcattctcctctagttatcctcagggagagctggctgaggacaattagtaacaccttggttgtgaatgccaaatagattttgtaatttcatgtcagatgcaagatcctaatagtaaaattattttattacaattgtctctcgctgatagaaaaagggagtaattgaaattccaaaagttggttttaaaagtaaaaagcaaatcctgaaagatgtagtatcctaaagatgtagtattttccatgaatcactgggaaagtaaaggatgataaaaacctttttgttccccatagtgcagaattcaacactggacagactgcaggaatgggagcattcggggaatacaggagaggtcagttattgtttaactaaactgccttgggttatggtgggtgggatgcggttggtggtggtgatggcagttgatgtggacccacaaaggagccaaatatgatacttgtgaagaaccacagagttgaaggctctgctgcctggcttcctgggtggagcctgtgccactggaagtctcacaggaaagtaaagtcgtgagtagtgctttaggtgtgtaatcaccaaagatttagtgaagtccctgtgcaaggagacctgaggtaatgtcactcagtcctaagtcaaatcccaacagcaaagcagagcttctgaaactcattctgcccctagaggaggtttagcagagaccactggttcggtctggagatgtcacaaccactgacatgcagagcacaaggccaggcagggtctacacttgcaggggatcagtgtggttcgaggtcaatgtgcacgattcagacatgtattcaggatgctctgtgcatctttggggatttggaagaacatgctgagtccgtgggagttttatgttcttctagcccatctcctacagcctgcctgatgattcagacctcagcaaatgccctacggaggacacgggccatgtatagaggctgctctgtgcaactcctgatggtcaatctgattctcctttctgaggagagttcctctgcttgtgccaagagagagactgtgtccacatgcaaacttggcagatatggcaggaggacaaagagtcaggccagcatcagctaaactagaagggatgcttttcactttggaattttaggtcacttagttctcatttcttctactgttctctgatgttattaatataaacttttgtattgttttctctccaggttcttgcagtggttctttagcctttcaacccttacatcgttgccccaaagtaggaagattccttttgaaacttactggtcatttagaaatgacaatttgggtaccaaattatcacaaaaaataaaaggttttgaaataagtaaatgtatatatgtatatatatgtatatatatgtgtgtatatatatgtgtgtgtgcatatatatatatattttgttttgttttgttttgttttgttttctcttatcttgagactgagtcttgctctgtcacccaggctggagtgcagtggcgtgatctcggctcactgcaagctccacctcccaggttcaagccattctccttcctcagcctcctgagtagctgggactacaggtgtccgccactgtgcccggctaattttttgtatttttagtagagacggggtttcaccatggtctcgatctcctgacctcatgatccacccgtcttgacctcccaaagtgctgggattactggcgtgagccaccgcgcccggcctgcatggtgtcacttaaaataattcttcaaaaatatttatgaacgaatcatgggcaaatcagttccatttcatgaggtgatataatcaacacatagaagtgtttgcacccataggacaaaatacctttgtttctggttaaaataatcaaacccatcagaaatgattgtctattctaggatgatccacaccatggtaagtgaagttaaaacagtattccccaggagaaaaatcaaaaaataaataaataatgaaggcatggtatatagaaagaatctgtcacacatacaaagatagacaagtcttcagaggacttttctacacatattcatgagtgagaacacacatccaaccaaaaatacgttgatttcacttccacaatcagcagtgtggagactaaagatagtacaattaaaattacattcttaacccaaaagtccaaaaacaaagaatagatagtttacagaaaagagtttgtaaagcacagaatgacaggtctacagaaggtattcacaagtgagaaaacacatctaaccaaaattctagggatttcaccatcacaaacaccactttggagcctggaaatgctgcacagcctcctgtgagcaggacactcaccgggtccctgaacagtgtgatggccccaaacacaaacctcaaagtaagttcagcctctcagtgtggcaggagcaggtgcggtgccaggggatgtgtctccagcagttggagtcaggtgggctcagggagatgactggaaagcctttgaggaaggaagaggccatgaggccttagtcataggcacaggctcctcttctgtgtgaacagggccagggtcctccaggacaccttccaaagcctcctctttcctccacatgtagggcgctgaagccccaccaaccctccagggtttgctgccacatcatccctggagcagcccctaaggttccctgctgttctcatggctgtagggatgctcagtcatgtcactgtaagggaaccctagtgtgtcctgtcctcacctgctgccactgatgaccttcatagcgagtctccatgcctttgccaagtgaccccactctcaccaaccatcaggaggctggaaaatggcctgcactccatgatgttcggcttatgagtaagtcagggctcagggcagtctcatgtttgtgcagctcataataatatcacacaggaatcctattttgactttccctgactcctcattctctctgagcagtaactcactctgctcgtccactctaagactttcttcttgtgcagctgctaatggtgttttcatttggagactgatatgactgtattggtggaatactagatgtgtgcttgtcacatcctcacatttctaagaataaaagacccttcttttgagtggcatttattctttttttcctagtttgtcaggattacatttccagtgattgatgtgaaaacttctttgctaaaacacattcataatgctataaattaactgcatttttttgaatctcataaatttggatatgtgatgtttactttcagatccaagtactttttaatttccctttttgttgcttctttgccccaaactacatatagtggtactttacatattttccaaatatttagattctttttggcaaatttttaaaaaattaaatttagaatttcagtggctttattggtaagagttgtttttggttacactgatgaattgtatagtagtgaactctgggctttagctacccatcacccgaacagtgtaccttgtgcccaataggtaatttttcattcctcctccttctcccaccaaccccattctgataactttctgtttctgatttctaatacaatcccctcagttatgaataatttatttttttgatttaatcagcttggtttttttgaaatatcttgttgcccaaaatatagtgtatcattagccaatgttttgaaagaccatggaatctgctgtggtttggtggagtgttctctaagtatcagccttgtccagatggttgatagcattgttgaagtcgtttgcatccgcagtggcccaagaggctgggccgtttgcacttcaacctggatctgctgcagagcccttttctatcctgagtcccactcacgactggctgactttcatgtcacctgctgggccaaacctgtattccaaggggtagaatatgtagcctccagaaaccaaagaagtcctatttgtggcttccttctttgaaagacaaagacacatattaacaacactggaataaaataaatattcctgtaatcctgaactctgattcactccgtctttatgttacacacattacaaaggccttattaatggggacaccatttagtggcatttgatggcagcagtagagacgaatgcccagattcaaggtgcagggcaataccagccaggggaaatcagcctctcaaccacagccacaatatgactaggcagccacaaagagttcccaagtaattttctgatcattgacccggtcgtggtgcagtatctggacttgctctctaatgaggaaaatttaatgttgtgatgtccttgattctactgcaccaacattcatctggtctgtttgtctgtcagccactcacaaggacactcaagtcaaattctctaaatatataattgtcttccttcaaattctagagaaaaggttgattttagatttgcctagcaaattaaatattttaatgctattaataggatcatttaaatggtatccttctcttagtctctctgcaaaggttaacctggggcaaatttcataataggtttttctttattttcattttcctctataatttctgagtaagatgacctactctgagaaaacctatgaagttagttttaacccaaaacaaaatcattattttgaaatttaataccatcacaagccagagacaaaagatattactcttgctttatggcttattaggactattaatgactagtaagtatttgctttaatcttccataagtcaataggtttcttccttttattttgccttatacaaataattgtataatagttttcctgttataacagatttgtgtaccttcttattttcagtattaatttttgcctaggactgctaggattccagaatacaaaagaaaccattttctaggttgaggatgtttctaatttactaaggtaagactatttactatgagtaagatccagctaaatcagtagctagcaggaaattatgcctctagtcctctgttaaacatgatagttttattcttgactgctcctgggaagtcagaatttatttcattttattactgatgcttcattttttttttttttttgctggtagatattttagaagagttaatatctagaagtattccaacataagggcaactggctcttcacagagcatttacacttgggtgatccttagctcctgcccaagaatcaccaagttataatgaagttcactgctgtgatgtgaagctgctgcttccagaagggcagagtcactatttccagttgtcaatgcagaggctgtattattattattaattattaatagtattattataagacaagaaatgagcactaaatgctttattcagctcttgtctgtttccttttctgtacttttgatttttgctaacaggaggtgaaaagaagcagttaaaggaaaaattcagctgtctttagaactcagtttgattgatttgaaccataatttttctctagagtcttaaacattataaattataatttatataaacatttgcttgattcttaaaattgtttaacatgaaaaaaacgatgtgagaactcacaaattctattttcattttttctacaggtaaactatcttatctaagttacaagtaaataagttattgcactttgttttcttgttatattcattgaagttcttatctaagttacaagaaataagttattccactttattttcttgttatattcatagaagttcttatatcaactgcagcttctactacagtttaaatggctagaatccccaatttagtctctaaaaacttcttgggatcttcatttcccatctctcaagtaaaccaggttttactataaggcctcaaggctaacttcacattcaaagagtagaaaaattatactaacttctcaggcaagctatggttttatagagttttacttttgaggacggagacccctttcttcaaggatgtgaattcgaggggaacttatgagacacagaatgctcaggaagaaaacagactcataacttcactttgtgcagttggtgggtgtggtggattctccagagatattaacaagcacagaggagaagcccaccacttaatcccacagctgtgtggatagtttcataggatttctgaaaaccttttccaagaaaaagtagagaccagaattgaaacatttggaaacaggttcagatgagacagatctagaacagggtccgaagattcagaaaagtctgatatggaaacaatgctgtttctttcaatgtttggagagagagattctcagaagcagaagacacacattcaaggagcctacattccctgtgctctctccctgtgttccagaatatttatccatgaatctctgttccagcgagggacaatttcagttagtgagacaacgcagacggcttcattcccaggtgcctgggagccaggaatccattcacaggacctgtagcttcacagatggaagctccatttgtgggtgacttggtcttaattctcatctaaggacaaactctcacctttaatttaaagaaggttcattgatgctcaggtagggaacaggcctctgtgtgtctcagcctcatccataacagtgtgggtttgcactgtctggactaatacagtctgtagaacaaagtctacacgatgtgcaacagggatctataaatgagaatgctatgttgtttatttcaaaactgtgggcttatttctcaatggcctgtgccaaactcaaattttaaaacgtaattgttttaaaaaccacaaaaataagaatagttttaaccttttagaaaatacttaatctacatatccagaaagcctgacccacatctgctagcagtaggtaagacaagccccggtttatgaaaaccttaaacttaatactggtctctgtagctctctgacacagaaactccccactgtgctgctgtgtggcatcccctaaatgcatatcccttctacagtgtcctgcacattttgagaaacaaccctggcacctgattctctggactaccacctgctgtgagggacttcttgctgtaaacctgtcaaagcttcacccaatagactaggtcacatgtgctactgctgtctgtggtcatctgtttttccttggtcagccaacaaatccctcaacccccctacaaacaggatcacagtgtccaccccataaacactgattcccggtaatgaacacaaacaattccacttccaagactctcttctcaagtcatatgagtaatacagttcttttcaattacatggatcccaaactaaccaatcaggaaaaggagacacagccacactaaaccctgcctgtagaaatcctccctcattcagatgaccatgattcagatgagagacacatagaggcctgctcccaccctggttcaaatgtaggttgctcttccatcttgtctgtgtccactgtagagtgaccagctttgtctgctgctgtgaaagccctggtaggatgcatcaacagataagagagggaggattctggttagaattagtaatagtgttctttaagtctacagtttaaatcgggtaatttcaaaggctttttctgactaaaaaaggatttgtccaagtttttacattttccagatatgtaaggcgacaaatcatgagatttttgttaaaaatcccaggggtagtctttttaatggttcattcattctcatagaaaacagcaatgctctcctaaattcaagcaatctaaatactttgtgaaaataacattttcaagaattggcttacagtaaaagaaaacagggcaattttttttactgttaatcactttcctgcaattcaaatctttgcattagataatggataaaactgattattgatttaacaccctttcagaataattatttaaaactaacaataaaatggaccattttgttctattttagttaggctgtttatgtctccttcttccattccttcagcttcagatgtttctgactttttttcactaccatggttaagagtctgaccttttcaacactaagaagcagatcagaatttgctgacatcatcagaaaaaaagtcgggtacccaaaatttgcaacatgtaataagagaaaagaataaataaaattttaacagtgaaatatgagacttttatttcaatacctcctcgtagctactgtttaatatcatcagcccatattattgtcatggagttcaacatttgaaggtcaatatcatttttaatcaagtatgttttccgatcttattaaaaaatgatattttggtagatttcccagaagatattcagatcaagctttctttgcagtcttacctacaatggcatttatttgtgttcttgggcaattaagtatggctttgtgttaaattacccaagcttacatcacactacaagctagtccttcattgttactggattattatttttttttcagaaatgtgactgtccttgtgaaactatttattgttggcaccattattcaggagctgttcaatggaatgttaagcacatcgatgacaaataaagaacagtgtggttgtttttctgtttaatgatcagttgtatggtaggttcacatccctaagctgtgagcatttttacataaagtcaagaaaatatcagttacaagtacaggttacccagagatgtaaaactgtgaatgcagttcttgctctttatacacagagaatttcctttggatctgtggactcgtggctgtggctgcaccacatccaggctgggggagactcacgtctcactcagagttgacgagaacctggaagccctgacaggacctgattccacatgaccagggagactgtgtgggaagagcttttctaatcatcacttgaaaaaacatcatgcaaagttatttcttatttgttctgtatcattaatctagaagattcttcccttaagacagagtcctctgggccaggcacaatggctcacacctgtaatcccactaccttaggggccaaggcaggcagatctcctgaggtcaggagttcaagacaagcccagacaacttggtgaatgaaaccccatctctactaaaaacaaaaacagaaacaacaaaaaagaaagagccctctggttaaccttgtatgtgtgagacgattatgatgagatagatcccagattgaacaactggtcaccaggaattttaaatttgctgctggaggcacaaaattttgtctctctttcctttttcttacactgggctcttggctctaaatgtagaggctcacatcattctccctgtgaggcgcttggacagagagctcttatgctgttcactcaccaggtgccaaggcagagtagattctaatatttgagttgaacattcttgaacagttatcctggaaacagtagataccagacagcccttgaactggctccaggccgctttttatttgcaggctctcagttcagcagtgcttgtggggatgggcctgtttcatactctagattgactgggagggaatcaagccagatggcattcacctcccagagatgtatcctagacacacatttccacattgtcagggttctggtgctttcttacagtcatgccctacacagtgtgtccctacaaaaggtccgaactttcaccttcagatccttcttcccttgattgtgggcaaacttggctgaatctagttctgttttattccaaaggacaatttatatcacattgttcacagaagagacattccccctgccccgtcaaccttttccacaccactgcacccaccaggtgatttgcatattgtcccctagggtggaccttcccttgtgagtctgagataaaagctcagctctatccttgccttgactgatcaggactcctcagttcaccttctcaccatgaggctccctgctcagctcctggggctgctaatgctctgggtccctggtaaggacagaaagagatgagggaggacaactgggtgggaggtgagctctgtgggctccacagcttcacatgtttattccaataatgtgatagaggcacatggtctatgctccagggaatggaattcaggtttgtcttatgaataatcaggattcacctccagggaacgatgaccagtgctctgattaagaacttgaaaaaaaagagttcccttgtggctaataaataatgggtctattttagaaagtctacttttcatgatataaatcaaaactttaaaaatgtaactgtaaatttatatcacaagagaaattatgaaagttgctcataatgtatctatataaacttgcacttctctgttattatttcaggatccagtgaggatattgtgatgacccagactccactctccctgcccgtcacccctggagagccggcctccatctcctgcaggtctagtcagagcctcttggatagtgatgatggaaacacctatttggactggtacctgcagaagccagggcagtctccacagctcctgatctatacgctttcctatcgggcctctggagtcccagacaggttcagtggcagtgggtcaggcactgatttcacactgaaaatcagcagggtggaggctgaggatgttggagtttattactgcatgcaacgtatagagtttccttccacagtggtacagccctgaacagaaacctccctgctgtggtgccccagctgctcacatgcactgcttgtctggggagcaggtcagcagcgtctctgagtctgcaaaagaggaggctgttggagaatacagggcagggtttgcttctgaggactctgcctgggactacaggtgcatgccactaaacatggctaatttttctatttttttgtagagtcggtgcttcaccatgttgcccagcctgttgtcaaaatcatgggctcaagccacccacctgacttggcctcccaacgtgctggcagtacagtgtgagccactgcggcaggtcagcacccctgtttatgttcctgtcacctgccacagccttgactctcataaccaacaggaaaatgaggaggttctagggccctgtgagtaaaaaactgggatgatagggaaaggagaatggaatctcatctgaatcctccttccttgcctacatttgtttaaatttattgagcaaaagggccagactactgatcatttctggcaaaacatgttgagtacattttagggtttaacagttttgggtacctttcaaagaaaatatttggttatatgtaaaattggtattttcccactttttaaattcctacttctcctgtttgccattcttctccactccatgagacagtagagacaggattattcactaattctcctctggcggagctggctgaggacaatcagtaagatcttggttgtgagtgtcaaatagattttgtaatttcatagcagacgcaagttcctaatactaaaactctttgattacaattacctcttgctgatagaaaaagggagttcttgaaattttgaaagttggttttaaaaataaaatgcatacactggaagatgcagtatactaaagatgtagtattttccagggatcactgagaaaatacaggatgaggtaaacagttttattttccaaagttcagaatttgagattgggcagactgcaggaatgggagcatgaagagaacataagagagatcagctattgttcaattacactgcccttgattatggtgggtggggatgtggctggtggtggtgatggcagttgatgatgtggatccaaaaaggggccaaatgtgttacttgtgaagaaccacagagttgaaagcactgctgcatggcttcctgggtggagccaagtcttcgcactttccaaactttctctctcctttattactcacatgaaactgccctctctagtattatggtggaaaaagcattctgcaccagctattttcatgggagtatggccaaggataattatttttactacttatggatttttaaaatccaggacagatataaatcctaataccaaaatagtttgatttgcctcagttgccttttgctgactgaaaatagagttcttccaattccaaaagtgggctttgaaatagacaaaataattcagatggagaacataaagtttacataatgtaccacaggaacaatgcagaattatatgagatttttatttccttctcaaattcttagaattttaaaaatattttactgacatagcattttaaagagaaaatttttagtgctatgttgtcataagaaaatgattcaaagaatgaataaatgcattatttttatatgatactattcctgaaaataaatctgaatcctctattttagttgttaatgcatagaaaaattatgctcttaatatattccattgacaatagtgctctaaatttatatgcttccttaatttgagggctacagtctgataaatatctatctacattttgtcatgcaacttttaaacctaacagaaatgctttcgttaaaaaagcaacagtgctttctctaccataatgctagagagggcagtttcgtgtgagtggtaaaggagaaagtttggaaagtgggaagacagcaattttgcaatatgaccaagtgttatcatgcaaaaaactatccccaaaccagtcatttctaacatgtatttcacttgtgttaccactaatctgcatccatgatctgatcattctgccaaataaatttacacgaacccgagtaatgagtgatgtctgtcacatgtgataacacggtgtagagacacaaaagactgaatcaacagaacaagatcctgatacaggctaagggtttaaataatacttgagatgatttatttcaagataacagattccataggaagtgcaattaaaattccaatgtgtcatttctgttaggtttaaaagttgcgtggcaaaatgtacatagatatttattagaccggagctctcaaactaagaaatatgagacactcaatatgttattgaaaaatactaattaatgcatcattgaccctatattttattacataatgcagtaaaagaaaataaaatgtaagtagcaagagcacgaggtaagcaatgccatcgtcacctttagccctcctgggattgacagcacctagtcaccttgagtttctgcttttctgcgagacaggagataaaatgaaaacccattcaaggtagttagttatattttggagaaagcaaacaaagataccacctacatgatgctgatatcccaaaggcatatattctcaagtcaaaatagtgaaaagtatatgatccccaaaactgaaaggggagagatacaaggagaatcagagcatgatcaaatttaattacaaagaagcctcataatatggtgaactaaatgtaacaaggtttctttgtctgttgccatggcagtgcagaggcaggcaggtggccttggtggtgtaggtggctctgctccgtgaggtcactccggtgggcaggaggcacgaacaccctgagaacacagccttcctccttcctcacagtcattgcctgcccagccatcctcagcagcatgaggtgggacagagtggagagaaagctgttttcttctaaagactaaaaacaaaaacagaaaaaaaaaaaacaaacctggagctttccatcagtgacaaatgtacttttgactcaatcacacatttgagaagttttccagtgagtggatctgcagataaacccacattcgttgtttgtttgttttaatctgaaaatgtgtttacatgattcttgaaaatattttttgactgtaaacttatatttgtagtagcctatttgaagttatcatttactatttcataattgctactaaaaagttattgttaaaaaaatctgtgactctaactgttcttgtttgaaaggaatacgtctttttaagacactcagactccttttaagctcctcatttggccctcctttgtttctgattcaatgtattgtttaatttgttatttatgactaattaatctattaattaattttcacaatcacagaatcaaatgtcctataagttgctatgtcaaagacctgcctgaagatggcacacatgctccacaatgaacaaaggacagcaccatggtctcaggaacactggggaagtaggagtgctggtgtcccattatcaacagggagccctagagttagagtcaaatcttccctgtgacctgggcacctgggaggagccacccgtgtgctgagctgtgggaacctgccccatgccctgagactggaagcacggccttggctgtgtcccacctgctatggactgaattgtgccctcagattcatgttgaaaccctaattttcaatgtgactgtagaaatcagaacctctaaagatgtaattgaggtcatggcagggggtgtccctgatccagtaggattcatgattttgtaggatccagagacctctcctttttcttctctctctctaaccgccttcccctccatggaaaggctgtgtgaagacatggtgagaaggtggcacctacaaaccaggaataaggtctttagcagaaaacaaactctgctgaacgtcgatctgggatattccaggcaccagaaatgtgaaaattaaattctgtggtttagccatccagccccgtgttacggtgtggcagcggaagctgactcatccatcttccccaccctctgtgagcagatcagcttcaggaggccctcgtggacatggggtcccagctttgctcctcttcctcctgtttttccaactctctggtgaagagggaggactcaagcttcatcatcagtttctgtgcattaaacatgaatgtttccttcaagatgaagtttttagcccattttgctttctcagaatttaatcaaactgaatgaagtatgtacttacaattaatatttggggatgttcatatttgttccccccttatatgacagttgggatattgtgtggtgctcatctccaggcccctccctgtgttccaggagacagggtcactgtcaccagcagagccagtcagggaaataacagtgtctagcctagctccttgtgaaataagggctgacactgagctcctgctggctcccactgctccctggacacgatgcctgcctgggtcaagggggtgagtctggacagacgtcactctggccatcagtagcctaactaccttcatgacctcccactgtgaacagagtcccggaagctgctggagccatgaaagttggacagagaaatcccacatcactgcagtcagaggggggctatgaaaagaccgtgggggggtttcatactatgaccacccagcactgagccatggctgccactctgtctgatgggagcccccaggggaagatccactcacactgtgctctagaggtcgtttttgtcaccatctttgttctagctggtttgggccagtttctgtagtgcatcctgttttgtccagatcctgttctggtcagcgttgtcatgaccagtgttgtgatcagtgctcagaatacaagccctgatgatctcctaccttatactcactgccttctgtgaaccagatgttctgataagggtcctgttggatcctactcgaatcagttgccacacagaccctcactgagggctgagggccacagacatctgaagataaacagaggtccagagaatgatagcctgtgactgtcctctgtaaagacagctgctccccagatggctgagggctgtctttggctgtgtccttctttctgaatgataatgagggatagagcaggtctctaagcaaaacctcagcaaggccttcctatgtgtgctgctctaacctggacataggtggcactggatacacttagggaagtgaggaaatttatagtcacaaggaagagagagaaaggaggagagagagagaagagcctgtgatgtgtgtatagtaccaacactgatagtatgttctttaatggtttattgttgagtatgatgctcaaatgctcaggttctattccatgcagccgatacatataccttatataggaaaagggcctttgcatatataaattaaggattatgaattgggcagattatcctgtattgaccaggtgggccctaaatgggcctgtctttattaaatgtctgtctatctctcttataaggacatcacgattgtccttataagatagacatagacagacattttaacaaagtctgcagaagagaaggcaatttgaagacagtggcagagattgaagtgatgtggactcaagccaaagaaagttgaagccaccaaaagctggaagaagccaaaaagtagactccccgctggagtccctgcagaagctttgatgacagcctgctcttgacccctgaaactagtgctggacttatggcctccagaactataggaggagaatatatttctgttgctttaagccaccaaagttttagtaatttgttatagcagcccaagaattctaataaaaatggggcttaggataagtccagcctaaaggtagtatgatgatttgcactctccaccttcatttctctaatgttacacataattggttagaagaagatttttatgatggaaacattgtacaggaagccacccagtatatacaggggcatctgttagttacagaataaatattgacagttcttagttgaaaatgacatctgaggctgggcttggtggctcacgcctataatcccagcactttgggaggccaaggcgggtggatcacaaggtcaggagatggagatcatcctggctaacacaatgaaaaatctgaaaaatacaaaatttttcagaaattctgaaaaatacaaaaaattagccagacatggtggcacgtgcctgtagtccaagctactcgggaggctgagacaggagaatcccttaaactcgggaggtggaggttgcagtgagccgagaccacaccactgcactcaggcctgggcaagagagcaagactctgcctccaaaacaaacaaacaaacaaacaaacaaaaaacccaccaaaccaggactttttgaactcagctctgaaccaagtggacctaatagacatctacagaactctccatcccaaatcaacaaaatatacattcttctcagcagcacatcgcacttattctaaaattgaccacaaatgccttatgtaaatgacgagttgatgggtacagcaaacccatatggcacatgtacacctatgtaacctgcaagttgtgcacatgtaccccagaacttaaagtgtaataatacaaaaaaatgacatgtgactagtagtatcttatctagaatcttcattctaagatactcaaggacgcataaaagggaccctaagtagtcttttcatacatatatatgcacatatatatgtatgaaaagcagtcttttcatcaactagagaaaccctcaggacagcccttaatacccttggtgatacatttcagatgagtaaactgttatcagagcccgtagttgaaactattcaacagagatggtttgcccaaagatatgtggtcagcaattgtcagggctgagcttggaacccaggtctgcataaccttaaatatgttgcttccacatggccacgtttgtttcatatacgattgaatggcctttaaattcaaagaagagacaaagccagaagagtggtgtgaaattctcaacacaagctccctgctacctctacaccttaccgtgattactccaattataaactcaggccctcatgcagttttgtctacaaagcaaaacttcctcaaagtctttacaaatactaaatgtctttctttcagattcgagggcaagagcacatcttgcattgccctgaacactttgcatcttttctaccattctcatctttctgtcccagtccttccttctcaaatgatgtcctgtaaatctgatttctcccccaatatgaaaacaaatgaacaaatattcccctacttttctcatatccagaggatacaagagttaatcacatatccagagagtacgagagttaatcaagggatttatgcaagagtgtttacacataacaaggattctggtgctagccatcttcacagtgaaattttctgtgtgtcttgctaaaattgacactaaaaaatgacaagataaaaatatttggaagaacagagggcaaccatgcccttaaggaggtaaaagacacccctgccccttgtgttagtttcctactcctgctgtaacaagttatcagaatcttactagtttcatacaacacaaatttattatcatacagttctggcagtgagaagtctcactgatttataatcaaggtatccgtagttctatattccttctggaagttccaggggagagaatctgattctcagcttttcatcttcaaagatagccccatgttccgggctgcctggcccctttctccatcactgaagcatccctgtccattgtccctattcctctctgactgttacccccactcctccctattataaagacccttctgatgacgctgtctttcctagataattcagctgtttcctaaattttctgaatatccctatgcatgaaaaaaaaagaattggcaagtattcagactatactttccaagaatgagggtttgtccactgttttaggttggatctttcagggacaatgatgcccatgcaggcagcatatttataatgcacagtaaacactaggaggaaacaaggcagtgagagaggaaagagagcagcgataccgaaaatgtcctcagcgagaagctaccacagaggatgaatggagatcaagcccacgtggaaacatgggaaaatgtctcagtatttttccacctaagaagggagggagatggggtatgtatacacctccctgtcctcactgattgagggctttccgagaggatgctcattccaggtgctgtgataggccatgtgtacaggcagggctgccttctccagcttcagatagagcagtgaggaaaagatatggccatggggggtcagcagaagtacagcaaagggaaaagggaaagggtagcaagagtgacaactatattcaccccccccacacacacacacacacacacgaaattgtgtattgcaatccagaactgcttctctctgaacctaaatcttagcaagcagtttaccagtaactgcccttgaaattcaggcccctggaaaggagcagggggttgtgtacaggctataccacagcagtctgcccacccttagtgatgcatgagtaatgctccctggactccccaggttctagtcttctcatgtcgatgtagttgattccacttcccttgctgcacaaccaggctgggatgcctgggcagaggcagacatgtgaggtataggggttcaaatctgtttccaagttttatccagcttcaaagcatttctccgtgtacatgagcggtggcttgacaggagatggagactctctttcctggatgtgaggcaaggaggcaggcgtctgagtcaggatgatgtccctactcactgctaaagagaaaagtggctttgatggtgcagggcagggaaatgcactgagtggtcgccaccctcacagaagagaaagtgttcactgacctggcctttccccagggcctctccctcccattgctttccagaaagccatgatttttgagagccacacctgaacactcacaaacattatggtgggaaaagcagatcagagcattaggcaagttgcattaccttggccttcttcctttggagacaattgatgtggggttctagattgacccagagtttcaagtttatcctgattcaggcttcaacagctggaggaagaaacagagatgttttttgaagtaaacagatctagcattactaatcaacccttcatactgatgacctatgggaaataatacccaagggcagaaaaatgggcagaataaggggagccccaaaccaagacgaagctgctgcccattgagaccctgggtattacagagacctatagctctggataatggaagatctatgagtggcacaggcgctgaggaatcacagcatcattatcgtgcatctgcagggaattgcttgtaaatatactggtaattacaaatgtttaaggtcactacaaatactttggagtgtattaaatatgcttctgataaagactgtttttctcacatgaaacaatgggaaccatgtgacaatcacagaggtgttgttactatagcaaaagggattgttactctccacatccctttaagtaacttgaaggcctgatagacccaccctctaagacttcattagacattccctacgaatggttatactctcctgtatactcccaatacaactctaaaatatattattccatatagtccttaggtttgtattaaagtttgacttttttccttcaaaatatctcttgtcacaacagcggctctagagagaaatacattccctccaggcaaatctatgctgcgctggtctgacctgggaccctggggacattgcccctgtgctgagttactaagatgagccagccctgcagctgtgctcagcctgccccatgccctgctgattgatttgcatgttccagagcacagccccctgccctgaagacttttttatgggctggtcgcaccctgtgcaggagtcagtctcagtcaggacacagcatggacatgagggtccccgctcagctcctggggctcctgctactctggctccgaggtaaggatggagaacactaggaatttactcagccagtgtgctcagtactgactggaacttcagggaagttctctgataacatgattaatagtaagaatatttgtttttatgtttccaatctcaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcccacagtgttacaagtcataacataaacctccaaggaagcagatgtgtgaggacgagccaccccagatgctcctcctggtgcctccatctgctgagagcatttctcaaactcagtcaggttttgaaagtcattgggagacttttgtagaggggaccagggaggctcctctgaactctaagcctcttttgcccctatccccaggagaaaagatgtgacaatgcctgtcctgattgaataaggaagagatacaagtccacctgaggagtctgtgttatgggataattggaatttacacagcaaaagagaagctattctcggtatttcaaggagaaattgttcaagttgaataaattagagtctaaactagtctttttgaagcctacggtatgttattcgtgaagcagccactagagacaggggattctcaggtgctcctgcagaagtcagagtgcacctgcccctggtggtatgtgctgagtaccgtgtgatgatcctcagacctgtctgggaagccgagggctggggtgctgatgctctcagctgcctgcagcacgtctccaggtgattctccagtccacaaacaattccacatgttttacttcagatgtcagagtacatgaatccaccactctgacttcccaatctcatgggagtgcctctcattaagcaactctaaagaaaccatagagagaaaaggagttttggaaaatgtgcgtccagaagtgatagtagcgatggggaattgacagctgacaggtcagtaaggttgctctttccacaaggctcaaaactttgccagttacagattgtcccagaatatactcgaatgtgctatcacgtcttacgagcaactctgggttcatagcaagaaaacttcattaagtcatagatgaaacagaaaaatcaggaaactgtatgaaatacattataaggctgtgtgtggtagctcatgcctgtaattcccagcactttgagaggctaaggcaggagaattgcttcatcctaggagtttgagattggactgggcaacataggaagactctgtctctacaaaaaacaaaacaaaacaaaaagataaatagatagttataacaatcgtttgacaacctttttccttgacaaaaaggaaaacaagagaaaatcctaaacatggatgtagcatttttcctcttaatatgaaagtcctctgctactcaaaactatccagaatccagtagcaccttagcaatactgagagggtgccttgcaagatacatagcaggcccacctcaaattacctgaaagagaatcttcattttaacacggtaacaagtgatctacataaagcttaacaaggtatgttttaggtgatattttagctaaagagatttatttttttctcaatgaggatatttaagaaaatttcaatggagagtcacatgttgaaagcacacccagctttactttcaaattgatgcaacattgcatttgaaaacattttgaagattacaaaggttgaaaatcataattatatatgtccatagaattatcaaataacttcatgtttaaatggagtaaacatttttagaaactttaataattaccaagtgaaagaatcaattaaagttgtgtgtacctatgttagagattctcgggcttaattgtatcaggtcagcttggtttgggatttgtctactcctgcgacctgccatgagaatcttctgccctgagtagtcagtgtccttcaggcttggcctcagataaatgcaatccataggctggagacaagctcgattccctgcagccgaaccaaccagctgagccctgccttgggatcagccaactgattattaaaatgaacattcaggaatatgaaaataaatacttagtgttaataagacactaagagtttaagtggttgattgtcaataattattgtgcaaaaactgaccaatacagtatttatacatctacctatttagatagatgcattttattaaaattgatggcataaatatgaatatttattaatccatatatagagatactaagacaacatttaaaacattaaaacttaataccaataaaaaccatgaaattgatgtcatttggggaaaatacatatttgagtgtatataacatacatattggtgcatttatatttttgaaaaattattggctgcatatacgtatatgtacacatatttatctttaaataagtctatttaagtatatttatatatccatatagaagtaacacatgcatatttacaaaacaattatataaaaatgaaatctgtgaaggtgatttcagtttccccccataagaacactggtgcccgagacctggtgtagtatctgctgtggctacagaaagttcctttataacctttagttataaaatactcacctaatgggtatttacaccttaaaatatttttctaactcaagtggaggggtaaagggtatgaatggggataactgcctactgttaaaaattaatcatttcatcctatggaagtccaatcatgcatatgctgccaatgatgccatgctggatggagttctcataactgggtgctgtattgatgtcataccactgccatggtaaaggataccctgggagactagcagtcacaagagtgggcaaacccgaagggtgaagtcaccgtacactttgcaaagagggattagcaattccataacattggctattggtttggagagatcaccaggcctcagaagaaacaaaactgaaggactcgagacaaagttggtttggaagagctatgactggatctttgaaaatacgtcaagatcaaaaataaatgcttcctaagtgaatattcatatctattccattactgaggaccagctcttagtaattaagaggatcgaatgcttggccttcagtcagtcaactttcccagattttttaggaagtgacatgaaccatagaaatccatgcaggagctcaacaatatgaatttcagttaatgaggcttgcatacctatggctcttctgagcattcaacttgccaagtagcattacccctcccaaaccactaacatctaaccacacatcagtgatcagactaacaacgcgtgtcaaatgagtacagtgcacctaacccagcatccagaggacagtggtagttttcctgtatacggatttgcctttcttgtcagtcatgtttctgccagaatcatcacttggaagtatctatagcaaaaaaaaaaaaaaaaaaagtgaagcaacgtatattcacgatgttgtcatgtgtccaggggcagctgtccttatagaaaagagaaaatccattagtagtcaggaaaagccaaaacactaacccttgtaatgtcaaatcactgtcttaccagatgtgctggaggccctgaaacactgatgtgtatgacgttgttacccccattaacagaataggagaatctgagagatgactatttattatgggtacagagaagattgaaatgttgtttctattcactcttgtctggttttccagttgatagttcttaattcaaagaattagcatgataattgttgcattaaattgaaaaaaatgatgaacatgtggccatttagttcttattatggttcaggacaaactttgaacaaagggtcctatggtgtgggctggggacatacaacctgataatcaaggagaaataggtttccttctacatattttagagaggaagtagagaaaatgtggaagctagaagaatttcaagattgtttttatttactgacatttcctctggtaaaagtttctcttaacttcaacagacttcagaatgaagctttgagtaacacgcagctgaagcatcacatgcacttggatgctagtgcagcagaggggagatgaaacacacagtgagcttaggagatgagaacagcaaaggcagcctcttggtcagcttgagttgagaagcacaagaaacagtccattcattccttctacttgttctatcattgaatcaggtgactatgagagaagccactgtgcctggtgaggcaaaattgtgtttattttgatgcattaggtgacttaaaaccagatggaaaaagcagaggagtgagtgcaggcagctcccagcactgatttcactcctccctgatcaagatatcactcatccttgtctccatgatcaagaaaattccaaggccaggcgcggtggctcacgcctgtaatcccatcactttgggaggccaaggcaggcagattgcctgaggtcaggagttcgagaccagcctggccaatatggtgaaaccccgtctctactaaaaatacaaaaattagaaaagcatgctagcacacgccagtaatcccagctactccggaggctgagccaggagaatcacttgaaccagggaggcagaggttgcagtgagccaagatcataccactacattccagcctgggtcacagagcaagactccttctcaaaaaacagaaagaaagaaaaagaaaagtcctcctattgtgacaggaagatggtgaggcaggaggctgtgcccacaggacggtgctgtctgatcaagtttcttgatcctgtgtgaatttgcttaggataatggcctccagctgcattcacgtagctctaaaggaccattatttcatttttaattgctgtgtagtatttcatggtgtatatgcaccacatgttcttaatccagcctacctttgatagtcatttaggttgatttcatgtcttttctattgtgaacagtgctgccatgaacgtatgtgtgcacatgtctgtatagtagaacgatttatattcctttgggtatagatgtaataatgtgattgctgggtcgaatggtacttctgttttaagttctttgagaagtcgttatactgctttccacaactgctgaactaatttacattcccaccagcagtgtatgagcattcccttttctctgcaacctcaccagcatctgtcattttttgcctttatagtaatagccatcctgactggcatgagatagtatctcattgtggtttgatttgcatttccatgatgattagtgatgatgaccatttttttatgtttgttggctgcttgtatgttttcttttgattaacttcttttaggtttccttctacctattttagagaggaagtagagaaaatgtggaagctagaagaatttcaggattgtttttatttactgacgtttcctctggtaaaagtttctcttaacttcaacagacttcagaatgaagctttgcgtaacgcagctgaagcatcacatgcacttggatgttagtgcagcagaggggagatgaaacacacggtgagcttaggagatgagaacaccaaagagttgagaagcacaggaaacaatccattcattccttctacttgttctatcattgaatcagttgactatgagagaagccattgtgcctggtgaggcaaaattgtatttattttgatggattaggtgacttaaaaccagatggaaaaagcagaggagtgacctcaggcagctcccagcactcatttcactgctccctgatacgtgtctgtttcatggcctttgcccattttataatggagttgtttcttgttgttgatttttttaaaattttttgtagattctggatcttagatctttgtcagatacatagcttgtgaatatgttctcccattttgtaggctgtctgtttactctgttgttagtgtctcttgctgtaatgaagttgtgtagtttaattagatagcacttatcaatttttgtttttattgcaattgcttttggagtctatgtcatgaattctttgcctgagcaaatgtcaagaatggcatttcctagatttttattagagtttttagagtttagattttatatttaagcctttaatccatcttgagttggtttttctatatagtgaaaggtttccatttcagtgcatataggtgccagttatcccagcagcatttattgaataagggggtcctttcttcattgcttgttttagtcagctttgtcgaagatcagatggttgtaggtgtgcggttttacttctgaatcctctagcctgttccattggtctagggttcctgtttttgtagcagtactcttctgatttagttactgtagccttgtagtatatcttgaagtcgtgtagtgtgatacctccagctttgctctttttgcttaggatttttttttttttttagctctagtttagttccaagtaaattttagaattttttttctaattctgtgaaaaatgttattggtagtttcacaggaatagcattgaatctataaatagcattaggcagtatgaccagctcaaaagtattgattctatccacgcaggtggaatgtttttccgtttgtttgtgtcatttctgatttctttcagcagtattttgtcgttcatgttgtagagatctttcacctccttggtaagctgtatttctaggtattttatcctttttatgcttactgtgaaggggattgggctctgggactggctcttggtgtgaatggtattggtatatagaaatgctactgatttgcgtaaattgattttgtttcctgaaatattgctgaaattatttatgagatctagaagcttttgggcagagagtgtggggttttctgaatatattatagtatcgccttcaaagagagatagtttgacttattctcttcctatttggatgccttttatttttctctcttgcctgattgctctggctagaaattccagtactatgttgaataggagtggtgagagtgggtatccttgtcttgttctggttctcaacgaaaatgcctccagcatttgtcgattctgtgggatgctggctgtaattttgccataaatggctgttaatattttaagttgtgtagtttcattgtctagattttgagggtgtttagcatgaaggggcattgaattctatcaaaaggcttttctgcatctaatgagatgatcctgtagtttttgtatttagttctgtttatgaggtgaatctcatgtattgatttttacattttgaaccaaccatgcatcccgtgactaaagccagcttaattatggtggattagcttttgatgtgctacacaataatgtttgctagtatttttttcagaaagtttgtgtttatgttcatgagagatagcgatctgaagtttttatttattgtgcctctgtcagtttttactatcagggagatgctggtttcatagaatgagttagagaggagatctcccaccttgatttttttggaataatttcactaggattggtactagctttttttatatgtctggtagtatttggttgtaaatccattttttccaggactttttctgataggtgggctttttactactgattcaatttcagaactcattattggtctgtttaggcattcagcttcttcctgcgagattcttggtagattgtttccagcaatttatgcacttttttctaggttttctagtttttgtgcatagaggtgttggttataggttccaagggtttttcgtttgtttgtttgttttattgctgagggttgagtgataatatcctgtttgtcacttctggttgtttttctttggatattgcttttttctttattagtctagcttgcagtctatcaatcttatttcttctttcaaagacctaacttttgatttcactgaccttttgtttggtttttctcctctctatttcattcaggtcaggtttgattttgattattcttctacctttggggttggttcacatttgtttttcagatttctctaggtatgacgttaggttgttaattcaggatttttctaactttttgatgtgcacatttagcgctataaactttcctcagaacactgcttttgctgtgtcccagagattgtggtatgttgtctcttttttttcattagtttcaaagaatttcttaattcttatcttaatttcattgtttacccaaaagtctgtaagcagcagattgttaaatttctacttaattttatggtttttgaaagatctttttggtgttgatttttactttttttgcacttcagcctgagagtgtggttggtatgattccatttcattttatcatttttattttttgtatttgttgacacttgcagtatggctgagagtgtagtcaattttagagtttttgccacgtgtagatgggaagaatgtatattctgtaatttttagtggttgctctgtagatgtcagtttgttccattttgtcaagtgtcatgtttaggttctgaatatgtttgttactattctgcctaaatcatctgtcgaatactgtcagtgtgggttgaagtctcactctatgattgtgtggttatctaggtgtttttgtaagtctctaagaacttacttcacaaatcagggtgctccactgctgtgtgcttatataatatatttaggatagtgaagtcttcttgttaaatttaactcttcattattatgtaatgctcttctctgtcctttctgattatcgttagttttgttttgttttgttttgttttgttttttgagacagagtctctctctgtctcccaggttgcagtgcagtggcgcgatctcggctcactgcaagctccgccccctgggttcacgctattctcctgcctcagcctcccaagtagctgggactacaggcgcctgccaccacgctcggctattttttttgtatttttaatagagacaaggtttcatcgtgttagccagaatggtctcgatttcctgacctcgtgatctacccgctttggcctcccaaagtcctgggattacaggtgtgagccaccgcgcccagccatgatcattgttagttttaagtctgttgtatctgaaataagaatagcaacccctgctcttttttgctttccatttgtttgatagatctttctttctccctttactttgagcctatgtgtaatcattagaaaccacctgaaagaacaatgaccagtgccttgaataatatcttttaataaagggtcgcttgtacctagtaaatactaagcttatttatttatttatttatttatttatttatttatttattttgttgcccagtttcgctcttgttgcccaggatggagcgcaatggtgcgatctcggctcaccaaaacctccgcctcccggattcaagtgattctcctgcctcagcctcccaagtagctgggattacaggcataagcccccaacccccaggtgattttatgtatttttagtagagatggggtttttccatgttggtcaggctgaactcccgacctcgggtgatccgcctgccgcggaccaagaagtgctgggattacaggcgtgagccaccacaaccggcctaagctcatttttaaaaacgtattttttatgatgtgaataaaaaatcttttaaaagataaatgataaatccatatcataagggaaatcgtgatacttgctcataatatttgtacataactttgtacttcatctcctgcaggtctagtcagaccctcctgcatagcaatggaaacacctatttgtattggtaactatagaagccaggcgagtctccacagctcctgatctatggggtttccaatggggcctctggagtcccagacaggttcaatagcagtgggtcaggcacatattttaaactcaaaattagcagggtggaggctgaggatattcgactttattaatacatgcaagctacataatatccttgcacagtggtaacgccttgaacacaaacctccttgctggggtgtcccaactgcccacatgagctgctgtctgggagcagctctgcagggtctctgagtctgcggaagaggaggctgttggggaactcagggaaagggtttgctgctgaagactctggctcatgagagcctcagctgtgcctcagtcacatatgttaaggtcccatcagctgccatggcctggggaagacatcatcaggaggagaattcttgggggccatgagccctgggaacaaccagctatgatgaagggagagtgaatgaaagctcatccctccctatcttgcctacatttttcaaggacatttacttgtcaaaacaaccagaccgtggatgcagattagtgacaacacaagtggaatacgtgttggaaatgaccagcttggggtttattttatacaagatgatacttggtcctattgagaaatcatttttttcatttcattctcccaaccttgtatcttttttagcactcgtacactaaactgccctctccagtgtcatgctggagaaggtattctacacaagctgtcctcaggggagtgtggcaaaaaataattattaaaaatgtttaggtttgactattcatagacttggtaaacacatggcaaataaaagatctcaatgccaaaatacttcaattctcctcaattaccttcatcccagtgaaagttcttccagttacaaaagtgagctttgaaaataaacagaatgaactcacagatggacaacatagactcactaaatatgtcacatgaataatgcagaattacataatattttttcttcttaccccagttttaagaatttaaaaagcatttaacctaagtactgttttagaggtgacaaatttagtggtgtgtccccatgagaaaatatttcaaacaataccaaaattccttgtttacatattacatcatcgttcctagaaaatatatctaaatcctctattttaggtataaaagcaaaaaaaagtaaggtttcagttgatttcacttaaaatggtattttaaatttccatcaaacttaatgatgagtcatgtcagttacatgacagaacatggtgtgatagagacaaaagaatgattgaaggaacagaacaagaagcttctgcttcagccttaggatttgaagtatattggagattattttccattctgtgataatggattcaatggccactgcaactaaaattccaaagtgccatttctattaggtttcatagatatagggcaaaatttatgtagaaatcaagcagactggagccctcaaattaaaaaacattagacacttttaaatatgctatttaaaaatcctaataaatacatcgtggagtgtaaatgattttacagaatgctatttcagagaaacaaagcgtaagtagcaagagcaggagctgagaaatgccatcatcgtctttagtactcacgtgattgacagcacctagtcgctgtagattctgctttgatgtgagacagggataaggtctaaactcactcaagatgtttagatgtatttaacaaggaaacaaacatacagcctacatgattttgatatcccaagggctatactctcaaatcaaaatgctaaaaaaatgatatcaaagacagaaaggggataaggtctaaactcactcaagatgtttagatgtatttaacaaggaaacaaacatacagcctacatgattttgatatcccaagggctatactctcaaatcaaaatgctaaaaaaatgatatcaaagacagaaaggggattcaagaagaaccagaggataatcaaatttattacaaagaagcctcaaaagctcagagcacagcctacctccttcctcacagtctctgcccccattcccattcctcagcagcatggggtggagcggagaggagagaaagctgttacccctagagagcctctcttttcttctaaagacctaagaaaattccagctttccaccagggataaatgttcttttgcctcaaggactcatttgtgcaattttttactgtgtgaatctcctgataaacttgcatttttgttcgttttaatttgaaaatatatttacacaatatttggaaataatttttgaatatataatcatattgtggcagcctatagaagttgtcatttactgttggtaattgttgctaaaaagtcatctgcaaatgaaagactttcatctgtgactaacacacctcctctgaaaggaatctggctttttcgtctcttcaggctctttttaagctcttcaattggcctttggctttttcaacatgtaatttattcagtttaatttattatttatgcaaaattaatgaattagttttccctattacaaaataaaaaatcgtgtgtattgctatgtcaaacacctgcccctagatggcaaacaaattccacagtataaaaagagaatgccatgaactaagaaatactgggaatgtaaggatgatggtgtctcactgtcaacagggagccctttggctggaacagggtctcatgtgtgacctggagcacctgggaggagctgccagggtgctaaatggtggggaaaatctgctctgtgctctgtgcgctgagactggaagctgggccctgacccccagtgtagctgcgagagatgatcgaggtagatggggttaaaggaggtcctaagcatgagatcccttgcaatagaattagtgctcttatccgaatagcaaccagagctctcctcttcctttcctccctgtctctccctctctcttcccaacccccatccctttttctccatggctgtctatgaaccaggaagaaagttcttaacagaatgtgtacctggttggaccttgatcttagacttccagccaccagaaatgtgaatataaatttctattgcttaagccatccaggctttgggattttggcgtggcagtgccagcagattcacccaccgtcccaaccctctctgagcaggatcagcctcaggaggccctcgtggacatggagacacagctttcctcctcttctgctgctgtcagactctggtgaggagggaggactcaggcttcatcctcagtttggttgcactaaatacaaatgtttccttcaccatcaggtaactagcctttttgctttctgattagaattacatcaaactgcaggaacaactatgcctatttatacaaatgtacatatcacattgtgaacccagaacatttgagacaggtataaggtaatttagaaagtttattttgccaaagtttaggacacgttcctgtgacacagcctcaagaggtcctgcaggcatgtggccaaggtggtcagagcgtagcttggttttaaacatttcagtgagacatgagacatcaatcaacatatataaaatgaacattggtttggtctggaaaggcaggacaactccaagcgaaaagcagggcaactggaagcagggaggggctttcaagtcccaggtaggtgagagaaaaacttgccttcctttaagtttctgattagcctttccagaacaggtaattagatatgcatttatctcagggaccagagggctgactttgaaaacaatgggaggcagatttgccctattcagttcccagctagaattttccctttagcttagtgatttggggagcccaagatattttcctttcacaatatttattcgtaatatagatgcatagtagatacaaagatatcactgcaatttacatctataatattatacatatttaatatacaaagtttgttacaaacgcatatatacatatacacataattttatgtttatttagcacgtgctcctttttttttctaactataacagaatcaggctcagtcaggactctgcggacatttgctgacctctttggctccagcacagtcctggtcattgagagccagtgagaacagagctgagagcagcccaccccaggagcttgggcccagccccaaggcccttgtctctgagactttcctcctggtggcaggctctgggcttgaagcagtgcccatgagtgtgtgagcaatttccttccctgaagcccctgtgaggcagacctgtgggcagcgcctttggttcccaggtcctcagccccttgtctcagtagagcagctgcttcctccacagcccagggccagagcccagcagctttcagacagtgcaagtctgaccttagccctgatttaaggatcttattataaatgtctctacaagtattctggtaactgaaagtatgtccttgacttacataaatgcataggctacatttccacaattgctgaaactaacaaggtcatgtgagaaatttaaaatttgacttcgttttcatcctcagggcccggcttcttcgaatgttgcagtatgaagatgcgcctagcttttctcctcctcatacaactttccttaaaagcacagtggaatttaaaattttgtcacctacagagcagccaccctctcctctttcagtgtatagggcactgtctctgtcctgctgtgcatgacaacgacactgagccgctcccagcccaggaaaggagcaaggtttaggtggacatgtgatcagctccacaatgagatgtcatgggtgtgaaggaggggcaggacttctggagaaaatggtgatctctcataaaaagaggggtgatgaagagctttgcccttcatttcctctttgggcagttaccagaggacatgaagcttacagtctctgcagccttcttgagaccatgagatgttgagcccaagacagaaaaaccaatgtggtcaagtttaccaagcagtaatgtagaaagaatctggggcctttctcctgtcaccaagctgctgtattaaccctgaatgtgccaaacttcagatctcttctcattgcttaagccattgttattctttcacttgtttctaaaattattgtcgcttatccttaaatgatactgaagaaaaagagcctcgttggccatagacctgccccttaggagaagaaatgcattatcatgcgtgtgtatgtgtgtgtttgtgggtgtcaaaggcagtaaaagcaagaaccagaataagtgatgtcctttcctgacatcttggctctgctgtatttatagctaaggaaacccaaaccactgcaaagagttcataatttctgctctcttcctgtctcagtttcatgttttatatcttaaggatgaacatctttttgttgtccctaattcctccctcctttatgatcatgaaattaaaatagtggtcaagaaagagacaagaacacttgaagaagacataaaatctgtggactgtacacatctcctcaacagcaacatcatgctagcagttttctccttcttctcagtggtttttgatgggaagatgctaactcctccaaccaggtatctatcagaggttgcgtttggagggcttacaaagaaaagcttccaggcagttagtgctggattctggggagtgtagcaggagggtgagtctggattcccagcatggggaggccagagtgaattctgagaaaggctgtgcatgtgggaagaaaagaattagaactcagaactgtggtcacaaccttaggagccaaagaatgagacactaacacaaatgcagctcagagacaactcagactaaaagtgttatgatcaattgtcatcttgtttgtctttctaataccacacataaagagtaggtagaattgtttacagtggaagctatgcacatgaaaccccactgcccttagtgatgcacttgcttgttgtagaataaatattgaagaatttgaattgaaagtgatgtctggctagtaatatcttacatagcctttttattccagcatggtcaagggtacataaaaagaggactggatatatatatattagaaagataaacaggatgacaattgatcatatatatatatatatatatatatatatatttacacacacacacacacatacttcaaggcccatcatctgattaagtcctcaggagaccccttgatatacacagtgttccatttcacagatgaagaaaccaatgatcagagctcatggatggtttatgcaaaatcacatgatcagcacatgtgggctggaatttgaacccaagtctgtgtggctttattatatttctttcatgcagccactttcatcccatagttgagcccacagtctataataagggagaagacaccgtagggacagtgtggactccacagcttcctgctctctctgtcttacaccatgctgaccttaatcgtaaactagccccatctgcagttttccctagaaaacacaactctgtcaatgtctttgtgagttgcaaatgactttattttggacttgtgaggaaggacacatctttcttttctctggccccttctacatctcctctttctcttcgaatttccctggctcagtctgtccctctcagaatgtgttctgcaagtctaatttgccctcctaatataaaaacaaaccaaaaaacaatctcccctcctctcacgtgctatgacagctgatctctaggctctcagatacccagattgttccagagccaatcaagggatctgacccaagacattttctgccttagaggaattctggtgctacctcctctcaaaataatatgttctctgtcttttcaaaattgacgggaaattattacaaggtgaagatatttgggagaacaagaacagccatgcactgaggagataaaagccatctcttcctcttgcattaatatcctattgctgttggaacaaattagtatgacctcactggcttcatacaacacaaatgtattatcttacagttctgaaagtcagaagtctcactgaactaaaatcaaagagtgagcagggctgtattatttctggaggctccaaggaagagaattggatactaagttttcatcttcaagatctctcagattccttgcttcttggccccattctgccacaacagcattcccctccattgtccgggctcctctctgattgtgaccctcctgtattttctattataaggaccttgtgattacactggtttgagacaggcaatctaggatactctcctcatgtcaaatttcttaactgaatcacatctgccgagttcctcttgacatataaggtaacattcatagattccaaatattaggacataaatataattagggtggggggtccttatttatccccaaaacaactcccattattcccacaactgcccacccctaaagtcaaatgaaaattcacaaggctgttttatgaagcaaggaagcaggaaataatttgtgatttggagactctctgacctgtgggttttaagagtaggggttagttattccactgcctctaatgtggacctcatggtgtgctgctatttttttttttttactgagacaaagtctctctctctgtttcccaggctggagtgcagtggtgcgatcttggctcactgaaacctccgcctcccgggtccaagcaattctcgtgcctcagcctcccgagtagctaggattacaggtgcctgccaccattccccgctaatctttgttttttagtagagacggggtttcaccatgtttgcctggctggtctcaaactcccgacctcaggtgatccacccacctcggcctcacaaagtgctgggattacaggcgtgagctacctcactcggcctgtgtgctgctattttaagaagcttcttttattttgtgagtcagaagaaagggattactgcataaatcaaatttaagatagatgggcaaaaagcaatttagtgttttctgatttttgtatgcatcaaaaaaggagaaataataagaattaagacaagaggccaggtgcagtgggtcacgcctgtgatcctagcactttgggaagctgagacaggcagttcacctaaggtcaggggttcgagaccagcctggccaacatggtgaaaccccatcactactaaaaatacaaaaattagccgggcgtgatagcaggcacctgtgatcccagctacttgggaggctgaggcaggagaaccacttgaacctgggagccaaaggttgcaatgagccaagattgtgccattgcactccagcctgggcaacaaaacaagactcagtctcaaaaaaaaaggagagacaagagatgtagccctcccaagaactgggatttgtccactgtgttgggttgtgtccacctacaagaagtatttctatgcatgcagcatatttacaatgggagggaaggaggaaagtgaggcagagaacagaggttgaaggttaaagtcacctcaacaagccacctaactcttaggataactgaagctcaaccccatttggaaacacggggaaaatgtccctgggctattctagctgagaggggagggagctggggtatgtatacatgtccttctgtcatcaccaattgagggctgtctgtctaagtctgttttgtgctgctataacagaatacctgagactgggtaatcagtaaagaacattctgtcacatttctggaggatgggaagtcaaagattgagtaactagcagcttgggatccaatttctgtgctttcaagatggaatttgaatgctgagtccttcagagagaaggaaggccatgccctggcctgacaatagcagaagtgagagactgggagctcgctctcataattgagatagttcagggatctgaccccttcttaggggtctttgaagcttccccagacatggaaataaaggaaaatcttgggtcttttcaagggaaatgttaggtgtccagctaagccttgagaagtaaacaagcaacatgagaagcaaggagacgataatagactaaaacaatagtcaaagaagctaaaaatcacagtatgttttattcctctacagaaactaaagagaacatctcagcatatgtctctgagttgtttttcagaaacccagatctccaacaaatggatctgccagcacatagacttcacataaggggaaacaggggactgaaatttgaccatggttctttgttctgaatttccacctgaggggcctggagaaagtcacacccacaggccagagccaacattcctttgtgctgaccccaatttttaaacaaagcttttcttccttaatcaattgcacatcagaaaatttttcaatctactcatgacctgtaagatattctgctgcttcatgatatcctgccctcttaggccaaagccaatgtgtaacctccatgtattgatttacaattttgcctgtaacttttgattccctgaaacttacctgggcttttaaaagccattatttgtaagccattagagagatcaagatttaagcattagctgtctggtcctctttgcttgacgtcctgcaaataaatgacttttttctcctactgcaaactcagtttggataactggttttactgcactgagcaagctgaatccagtttggttccataataaaagccctttttatagtagcattaatctattcataagggcagaaccttcagtatttaaacacttctcattaggccccacctctcaattctgttgcattatggattaaattaacagtggatgaaattgaggggatacagtgaaaccatagcactgtctgaggaaagactcattccaagccctgtggtctgccatgcgtgtaggcggagctgcctttctcagagagggcagagatggccatggggaatcagcagaagtacggtgaaagggaaagtcctcagtgcagacagggactgctccaaccgtttagaaaaaagcacctgtactttccacctggagctgcaaccttctggaatggtgtttcctggcaggtcagttgcaaatgaaggaatctgggaagtaacatctcaagatatgctacattggtattgtgattgcttcaaactgaaggtgtttagaaaacaacaaatatataaaggggcttttcctaaatctcccttacctgtctaagggcagtttctccagaaggaagccaattgtcatgaaaaccctccctgggaatgtttatctaccagggaatattaacatgcactagaagttaaatccagaaaagattggatgttgactttatccagacaggctactacctatccttttcaggacccttttcttttattttaggttatttactctcccttagttgcctatactctctacttccctctcccctataaaggatgtagaagcacctggacctcactgggttatttgggtaatccctctcgtgtgttatccccacacccccaccccgcatgttaaatacatttgtctgcctttttttcctattaatttgtcttttgtttattcattttcagcaaacctttagaaggtttgcttttctctttccccttttccctctacaaaagcaagttcccttaacattcaggtccctgaatagacagaaggagggtgtgtgcagagcttacaccacagtgatttgaccactcctagtcaggcatgagtaatactttccagaacccaggctacagcccacagacactgatgtagttgaatgctgctgctgaagcaggctgagatgtcttgggccctgttagagatgtgagatatgattgggtgcaaatccattaccagttttattaggatccaattaatttctccatatgtatggaaatttgcttgataagaggtggagactctgttctggatgtgagacaggaggctggtatgtggatcagaatgatgttcccactcactgctaaaaagtaaaagaggaaagtggcattcatagtgcaaggcagggacatgcactgagcagcagctgccctcactggtagggaggacttactgtcctgatcttttccaaagtctctccatcacctgctctccagaaatccaggattcagaggagctgtacctgagcacccaggaacatgctggtggggagttcagcattactcaggggatgcaatcttggtcttcctacttgtggagacaactgaaccctggataatttcaagtttatcctaatccagactctgataaatgcaggaagaaactagttatttaagtcaatcagatctggcatcactagtcagctcttcatgctgagaaccccggggaaataatactcaatggcagaagagagggtaaaatatagagatcaccaaaccaaaaataagatgcagcttatataatctctgggtattaaggtggcttacaggtttaaataatggtgaatctgtgagtgataccggccttgaggacttgtggtttcatttttatgcatctgtagtgaattgcgtgaccatacagtcatgtaagaatggcttaaggtcattacaaaatactttcaaatatatttagcattatcttgtaaaattgtctcttttttttaagaaggaaccatttcactctcacagaaatgttataagtatagaacaaagtaccctctcctttgcagagtatattcaagacttgatgttcccaccctctaaaactttactgagtttcctacaaataaaaatattcccctggctggacgtggtggctcatgcctgtaatcccagcactttgggaggctgaggcgagggggtcacctgaggttaggagtttgagaccagcttggccaacatggtgaaaccccatttctactactaaaaatacaaaattagcctggcatggtggtgcgtacctgtagtcccacctaccctggaggctgaggcaggagaaatcgatggtacctggcaggtggaggttgcagtgaggtgagatcgtgccactgcactccagcctaggtgacagaacgagactctgtctcaaaaaaaaaaaaccttaattaatccccatatacaaatagaaaacattacttcatcgagtactcaagagtatttcaaatattaacaattattaaaaaaaaaagttctttgttacaaaacggccccaagaggaaacatgttcttacagacaaatctgtgctaccctcctctgacttgggacactggggacacgagggactggctcagagatgagccagccccgcagctgtgcccagcctgccccaacccctgctgatttgcatgttcccagagcacagccccctgccctgaagtcttcttaacaggctggtcacaccccgtgcagcagtcagtcccagtcaggacacagcatggacatgagggtccccgctcagctcctggggctcctactgctctgggtcccaggtaaggaaggagaacactaggaatttactcagctggtgcgctcagtatagcctggctcttcagggaggtcttcttataacatgatggattgaatggatgtttgtttttatatttccaatctcaggtgccagatgtgacatccagttgacccagtctccatcctccctgtctgcatctgtaggagacagagtcaccatcacttgccgggtgagtcagggcattagcagttatttaaattggtatcggcagaaaccagggaaagttcctaagctcctgatctatagtgcatccaatttgcaatctggagtcccatctcggttcagtggcagtggatctgggacagatttcactctcactatcagcagcctgcagcctgaagatgttgcaacttattacggtcaacggacttacaatgcccctcccacagtgttacaaggcataacataaaccccccaaggaagcagatgtatggggctggcctgccccagatactcctcctactgcctccagctgctcagagggtttctcatattccagtcaagctttgaaagtcactgaaaagttttgatggaaggggccatgaagactctgaaactgcctttgcaaaaatcataactgagaaaattatgacggtggaagatattacacagccagctctgtgtgaattactctttcactactgctattgccgtgtcttgataaatcgactctgtctaagcagcaggcaaggtgaaccccttgggcgattacaactcctctataccttaactgtttttccttctcatcccctgcagcacaaacatggcaatactgttcctgatttcattaagaaaagagatgattacacctgagtcttggctatggtgtgagttggaatcaataccacaaaggaaaacctactcttggaattccaagtctatttttttttttctaaatacacgcaatgagagtctaaactacagcctctgggaggcttgggagcatggtactcaaagatgcaaataattagaaaacgattctctggatctccccaagaatccagagagcatctggtgcagaagctataattgccaatcatgtggtcctcagacatgtctgggaagcccatgttcggggctgttgatgctctgcctggaggaccttcctgattttctatggcatctgcttacaattgaccagccccctattcaaagcttgccgtgttgcatctcaactcttgtccgtgggaccccaagtctctagccacatccagttcttcacagaagctggatgtatgtgccagggcaaggagaactgggtgggaggtgagtctgtgggctccacagcttcacgtgtttatgaggtaggagttattaagaaattattttaggcagatagagaggaaaaaagggatccttgggagacttttcacagctgttgtctagcataaaagccctgggtcttagccccgggcaggcaaccttttatatgcaaatgcaagccgttagaaactgggtccatccaacatgcacccaacatggtgatttccaccgttgtcctcttgcccttgccccaacatgcgcctggcagcatggttgcccctacatatccccacgtgtgtggaacatcatggcgccctgtatttgcatattaaaaggctagggtgggagggccagttctttcgagggctaccgtgaatgacatgtctggtcaaaccaataccctgagccctgtgcaaatcagacaccgcctcctccagacatcaaatatagctggctgatattacctgaaagagtggttcgtccctcggctttggagcccccctccctctgtctttgtacaggggagcttcatccttctgtcttcccccttctttcttgcctattaaactccctgctccttaaaactattctaagtgtgtcagtgtcattttttctaatttgactcgagacaaagaacctggtgtcctctactcatcagagcagtatcatttattccaacatgatagagtcacatggtctatgcccagggaaaagaattcatatttttgtcttatgaataatcaaggttcacctccagggaacaataaacagtactctgattaagatcttgaaaaaaaaaaagagttcccttctggctggtaaataatgggtttattttagaaagtctactttcatgacatgaatcaaaacttgaaaaatgtaactataaatcaatatcataaaagaaatcatgaaagttgttcataatggaaagccagcctttgtctcctgcaggtctagttagagcctcctgtataataatggaaacacctatttgtattggtacctgcagaagccaggccagtctccacagctcctgatttatgaggtttccaaccaagcctccgaattctcagacaggttcaggggtaatgggtcaggtactgagtttacactgaaagtcagtaggacggagactaaggatgttggagtttattagaaaacttgaacttccatcaatgataaatattccttttgcctcaagcacatatttgaggaattttccattgagtagatctaccgataaggtcacatttttctgtctgttttaatctgaatatgtatttatatgattctcagaaatgttttttgactatgaaattatatttgtgagaccttttttcaagttgttgtttaccatttgataattactgctgaaacgtcatctattaaaaaaaatcggtcatccgttctctaactctcattgaaaggaatttgcctttttaaacccctcagactctttttaagcttttcaattggccttatcttttttttacagattcaatgtattaagtcaatttattatttatgataaatttatttatttatttatttttactatcacaaaatttaaaaatcctgtaagttgctatgtcaaacctgcctctagattgcaaacaaaccccacaaaaaagagagtaccattatcttagaaatactagaaaagcaagagtgatagtgtcccattgttaacagggaccccataaggctagaataatgtcccacatgttacctggggcacctgggaggagctgccactgtgctgaatggtgggaaaaagccatctgtgctctgagactggaagcctggccctattcccctatgtggatgtaggagataattggggttataaaggggtaattacggttaaatgaagtcataagggtggggctctgatccaataggattagtgtccttataaggacagaaaccagagaactcttctcttttcctttatttctctaactcactgcttccctatggaaaggccatgagaagacatggtgagaaggtgactacctgtaaactaggaagaaggttctaaccagaaagtgaaccttgctggaacttgatcttggactttccaggcttgtgaactatgagaataaatttctctggtttaatctacccagcccagggtattttggtgtagcagtgcaagaaggcccatccactgtccccaccctctctgagcaggatcagcctcaggaggccctcatggacatgggtgcccagctttgcccctcttcctcctgcttttctgactctctgatgaggaagaagaactcagacttcggcttcagatagtttgtattaaacatgaacatttccttgataatgaagttatagtttgtttatctttctgtcacctgcagggccaggtgatacaatttcaacaaaagtatatcaatttctatacaattgtacatattattttaatgtgaaatgtagaaacatagcgtatacatctatctcaatatataattaatattcaaaatattatatgtatttaataaagtttacataatatgtatgcatatattatttgttgagcatgtgctctatttctttgtcatcagaacagaatctggctcagcaagagccctggggacatttgctcaccctctccctttgcttccaagaaggtcctgactgcttatatacaatgagaacagagctgagagcagcctactccaggagcccaggcccagctctaaggtcctggtttctgaggctttcaccatggccccaggctcgggcttggtgccgcgcccatgagtgtgtgagcagctttctttcttgaatcctttgccaggcagccccatggacagggcctgtggttcctcccaggtcctcagcctcatagttcaagaaagcagctgtttctttcacagcccagggccagagcccagcagctctcggtcagtgcaggcctgaccttagccctggtttgaggactttatttctaatctcttctcttttattccagtacctgaaagtctgtcctgatcttaattgcataagccacatttccaaaactgctgaagctaacattgccatctagaatattaaaaatttgacttcactgtcatcctcagggcctggcttgttccaactccaccagaccaagaggctcttgagatctctcctccccacacaacttaatttagaagcatagtgaggtttaaatgttgccaagctcttgacactctctgagcagccatcccccttctcctttggtgtagagggcaccagctcctttctgccatgcctggtgaggacagtgaacctctctcaatttagggctggagtgaggattaagagcatgtgtggtcacctccaccatgagatggtaggggagtaggtgggcagggcttctggggagaatttgattcctcataaatagaaggaaggtgaagaattttgccccacattttttcctggaagagtttttagtggatatgacactaatgtccttagcttagagctgttgcagtcctctggagatcatgaggacttgagtccaagactgaaaatccaatgtggtgaaggtgaacctggtttcctcatgctgcccccaagctgctgcaccaaccctaatactccaaccttcagacttctgatctttgcttaagcttttgctattgtttctttccattgcttctaaagttactttcatttattttatttcatttatgagaaaaggtactcaagggaagaaacagagccttaaatttgctctttaggagaagacaggcatttttatgtgtgtgtgtgttcatgggagtctgaggcgtgaagggcaggaattgtaagtgcagtgctcccctgagatcttggtcattctatgcccatggctagaaaaactcaaatcactttgaagaacttataaattctgctgtctttccctctccattcctctttttatatcctaagcatgaaataaatgcctgttcttaattcctccctgctccaagatcatacatatataattgtggttaagaaacaaaaatagttggagaagacatagaaacaggggattttatgcatttcattaacaacaaagtgtgtttgcaggtttctctttcttcttagcactttttgctgggaatgttactggttaaagatattctagttgctagtggcaaatccgtatgagtctgcagcaacctcaatccttggcctgcggcaacctcaattcttgcttcctcagaagaaagaatgcgactgaggggcataagggagaaaaagagaccaaggtaaatttcagagcagaagtgaaagtttattgaaaagctttagaacaggggagaaaggaaagtacacttgaaagagaccaaagtgggcgacttgaagaagaagtccggtgtttaaccttgattctagtactttataggcaggtctctttcccatgattcttctcttagggtgggctgcccgcatgcgcagtgcccttcttacccttgggaggtgagcatgctcagtgtgttcagaaagttgtacacatgcctatctgaggcttccttcccttttctggtggtgtgcccctggaaggtcatacttcactgttttgtatttatatttatgtataaatataaatttatgtatatataaattatatttatacataaatataaatatgaatacatacatataaatatacaaatatataaatatacataaagtataaatgtgaatacaaaatataaatttatttataaatataaacattttatttttatttttgtatttatatttattgtattatttattttaacatgcctgggaagttgcatttccctggtgcttgcattcaattaacaccttagtgcaaaaggtgtggaccatcaggaaatggcctccctctagtgccagctgccaacttatcacttttagagaggcaatgtgatcattgctgaaccatcaccccacattcctagtgggtggggaaagagacctctcctgcccatctcatgcctgtctaactgcccgtaacaggaagatgctgactgctccagccaggttcctgttagaggttgcatttggagggtttacaaagaaaagctactggcaattagtgcctgattccagggagggtggcaggacattgggtctggattctcaaaatggaggaggccagagtgagaaaggctgtgggtgtgagaagaaagaccttagaactcagacctgtggccacagccttaggaccctgagagtggggaccacttatcaaggaacaaggagcaaagaagaagttgggtaatatttgagggattatcttgcaggtggaagataatggaggtttgcattggggtggagtggtggggtagaagtcgggggagtggtcaggtttgggacacatttggggtctatgattattgtctgcacttcgttcattacaaggcacttggtgcaatgagcagtgcatgcagcgcttataactattctcgattttttcattattatttatttatttttcattatgatttatttttattgagaatttctctgattgctggtgctcaggaagaaggtgtctcctttcttctgaggctttgtctgagtaagcaagatttttgcctctactgcacgctttctttcctgattgtccctctcttctgaaaggcgatggcccaggtgctccactactgagagtctcaagctcttacccaaagccctcagtctagagtttttgttttttgccgtcatgttatcttcttctttatcagcttagcaatttaaaaaattactttttttcttctgatttgtaactattaaaaattctgtcttagttaatcctacctattaccttcagagcaagtaatggactagcaaaatggtattaggagatccaaatatgtgtgttcaggaagaaatatgaggaggcaggctgttccagagtgctctgtgcagccggccctgcagagtccctctgtgtggccctatcactgactgccttctgtgaatcagatattctgatgaaagtcctggtgaatcctgtagccaggggccacctacaccctccatgaagaccaaatcctgtagtcaggggccacccacaccctccatgagggccaaaagcctctgaagacaataagaggtcgagagagtcatagctcatgactgtcctctgtagagacagcttcttcccagatggctgagggctgtctgtggctatgtcctttcttgtacatgatagcggggactgggcagatctctatgcaaacccgagcaagaccttcctgtgtgttcctctctgaactctgaacctaggtggcagtggatacacttagggaagtggaatgatttgtgatcataagaaagggagggaagaagggggagagagtgagcgaaagacatagagagagaatgtaacgtgtgtacagtaccgacactgaaactgggtcctgtaatggtttagcactgagtatcacccccacattatcaggttcttttccatggagccaattaatgtaactggtatgggaaaaagacctttgcaggtataaattaagaatctagaaacagggagattatcctggattgaccaagtggaccctaaatgcaatcacaagtatcctcctaagagtgagatagattgagatttaacacagacagaagagaaggcaatgtggccacagagacaaagactggaggggtatggccacagtcaaggaaagatgcagccattaggagctgggggagacaagaatagactccctcctggagcctctgaaggagcctggccgccaaggccatgatcttggcccagagatactgattctagatttctggcctacaaaagtatgagagagtaaactgttttaagccatcagatttttggaactgtgttacagcagcccaaggacactaataagaatgaagtgcagggaaagtgcagatgaaacgtgctctggtggttttcagtcttcttgttcaactttctactgctacacataaatagattgatgggaaaggatatggtgggaaaacatttacgtgaaacttcactgtatagagagagagagatctattagttagaataaatattgataatttttagttgaaagtgacatctgactagtaatatcttacataacgtcttcattctaagacagtcaaggatgcatgaaatggacaccaggtactctctctctctctctttctctcttcatgggtcatgatctggtgaagccctcaagacactgcttgatatccacagtacttcattttacaggtaagaaaactgcccatcagagtgcaggggtgatttcccaaagtcacatggtcagcagaagtagggactgagattggaacccaggtctgtcagaacttatatatgttccttccacatggccacatgtatgtatacacctcccctgtccttaccgattgagggctgtcctaggggatgctattccagacactgtggtctggcatgcatgcaggcagagctgccttcccctgctcagaaagagcagcagcatgaccatggagtctgcccatctcagagagagcagcagcatgaccatggagtctgcccagctcagagacagcagcatgaccatggagtcagcagaagtacagtgaaggggaaaggccaagggtagcaagagagacggctacattcagaaaaaaaagatgtgtatttcaatctagagccctatgtcttgaacctggatattagtaggctgtttactggccagttctcttgaaatccaagcccccggaaaagcagcagaaggtttgtgcacagactgcaccactgtggtgggaccatgcgtgatcatgaatgagtaatactgcctggagtacccgggctccagcccactgatgctgatgtagttggttccaattcccctgctgctgaatcaggttgggatgccctcagcataggcagaggtatgaggtacagaggttcaaatttgtttccaagttttatccattttcagatatatctctgtatacatcagcaatgacttggccagggatggagaccctgtgtcctggctgtgagacagtgaggctgacatctgggtcagggtgatgtccccactcactgcaaaagagtaaaagaagcaaatgacattgatggttcaaggcaaggacatgtaccgagcagcagccacccccaccagaagagagagttcactgactttgtctttccccaggtcctccccttcacctgcccttcagaaagccaggcttcgggggagctgcacctgagacactaggaacatgctggtagggagcacagcttggagcattacccaggggatatgatctttgtcttcctactttggacacatttgattataagagtctggattgatacagggtttcaagtttatcctaatcaaggctcctatagttcaatgaagaaacagagaatcttgttgaactaatcagatctggcatcactagccagccctttatgcgatgatctgtaagaaatattacacagtgacagaaaaggtggtagaatattctccccaaggcaagaataaggtgctatccatttaatccttgggtattaaagtgaccgatagctctggaaaatggagggtctgtgcgtggtacatgcatgagaaatcatggtattatctttgtgaaactgcagtcaattccttgtccttataccagtaacaacaatggcttaaagttatgacaaactatttttgaatattgttaaaaatgcttctgataaagtcttattttcattttaaaaaagacaattcctcactgacagaaatattgttaacacaacacaaaatatttttacactcaccaaatacatttgccagtaacttgaagacccaagagctctactttctaagattttattatgcattccctgcaaacaaggatagtctcctacatactgccaatacaactataaaatgcattactcaatgtagtccttaggttcgtttaaaattttggaaattgtcccaaaaatacgttttgtaatagtatggccaccaaagagaaatgtattatctgcaggtaagttgatgctaccctgctctgatctgggaccctggggacactgcccctgtgctgagttactgagatgagccagccttgcagctgtgcccagccttccccatcctctgctgatttgcatgtcccagagcacagctcccttcctgaagacttattaattggctggtcacaccccgtgcaggagtcagtttttgtctggacacagcatggacatgaagaccctcattcagctcccgggacttctgccatcctggtttccagttaagaaaagaaattactagcctcttactcagccagtgtgctaggtactgcctggccattcagggaagtcttcttataacatgattaattgtgtggatatttgtttttctgtttgcaatttcagggaccagaagtgacatccagtcacccagtctccatccacactgtctgcatctgtaaggagacagtgtcaccatcacttgccgggcgagtcagagcattggtagtaatttagactggtatcagcagaaaccagggaaggcccctaagggcctgatctatgctgcatccagtttgcaatctggggctccttcgcggttcggtggcagtggatctgggacagattttactctcaccatcagaatcctgcagcctaaagatgttgcaacttattactgtcaacagtataaaaattaccctatcacagtgttacaaaccataacaaaccccccccaggaaagcagacatgtgacgctgggctgccccacctgctcttctttgtgcagccatctggtgacaacacttctcagactcagcctgagttttgagggttattgggagattacggaagagggggccatgaaggtgtctctccaccctaagtctctttcctctcatggcaatgtctcttcgaatttagtaaagaaaggagattagtctacctgaggagtctgtgttatggggtaattgaaattcttacagtaaaatggaagccacacattccaagcaggaattgttttaactgagtgaattagaatctaaactatagcctttgaaagcctggcatatgttattcatgaagcagatactagagatggggttctctgatgcaaaaatataaatatttattgatctgtttttaaagatactaagataaaacttaaaaatgttgtcactgtatcaaatatattgcatcatatatctataaaaacagtaaaatttgtgtcatttatgaaaaatgcacatatttgagtgtatataacatacatattaatccatatatatttatttgataacttgttagctataaatactaagtacacatattcatgtgtagataagattatttaaatatgtttatatatatatatataagcaacacatgcatacgtatgaaattattgtataaattaaatctgttaagataattccagttactcccatgaaaaaaactgatgtccaggactatatatgttacctgctctggctacagggatttcctttgtaatctttatttctaacactcaccaaatgggtatgtgcacctgaaaatatcttttagtggaggggtaaaggatatgaagaaaggtaattttgcctaatgttaaaattaggcaaaatgttaaaatttcacagtgatgcctgctgggcagagttctaaattgggtgctggaccaaagccacacccctgccatcgtcaaggatgccctggaagactagaaatcacaatagtgggttaactacaagggtatatcattggctactttgcaaagagaggctggtaatgcaatgacattgattattaatttgcacaggtcattaggtctcagaagaaacaaaacttaaggacaaaattggtttagaagagctgtgactggatctttcaaaatgggccaagatcaaaaataaatgctacccaagtgaatactcatctaaatgccattgcctagcagggaactcttaataattaaggtgatccaacacatggacttcagtcagtcacctttcccagggagtctcatgaacctaagccatggagatttatgcatctgaatttcatttgatgaggctcacaaggctaatggcacgtctgagtatctgacttgccaaaaaccatgacccttcctgaaaccctaacattgtactacacatctgagatcagactaacagctggtatcaggtgagtacattggacctaacccaacacattggggcgggggtggttattttcctatatgtacatttgcctttcttatcagccatgtttctgctagaataattacttgaaagtttttcaagtgctttcaagtcaagaaacccttacataatttatcattggaaaaagtaactttattatagcaaaaaaaagtaaggcaaagtaggttcatgatgctgtcatgtgtacagaggcagctatccctacagacaggagaaaccccattactaggcaggtgaagtgagcacacaaacccttgtaatgtcaaatcactgtcttgccagatgtggcggaggccccaaaacaccaaggtgtatggtattgttactcccatcaagagaatagtggtatctgagacatggggggtgagcccatcactatttattatgcctacagagcagattgaaaagttctctttctgttcactcaggtccggggttttctggttgacagttcttgatccaatgggttagcatgataaatcattaataaattggaagaaacaatgaacatgcggccatttagttctcattatgatgtaagataaactgtcaataaagggtctcatggtgtgggctggagtcataggtataggtttccttctacatattttagagaggaagtagagaatatgtggaacccagaggaaattcaggattttttttttttttttttttagacagagtttcacatttgttgtccagactggagtgcaatggcacgatctcagctcactgaaacctccacctcccgggttcaagcaattctcctgcctcagcctcctgagtagctgggattagggttacaggcacctgccaccacgtctggctaattttttttttttgtatttttagtagagacagggttttaccatgttgcccgggctggcctcaaactcctgacctcaggtgatccacctggcttggcttcccaaagtgctgggattacaggcatgagccattgtgcccagctgggaatgtttccatttaccaccatttccactggtaaaagtgaagagaaacttctacagactccagagtgaagctttaagtaacacagctgaagcatcacatgtacttagacactagtgcagcagaggggagatgaaacgcacagtgaacttaggagatgtgaacaccagctacagcctctaggtcagcttcatagtagagaagtacaggagccagtccactcattccttcttccttcttctgtcatcgaagcagtcagatacaagagaagccattatggctggtgaagcaaactcgcgtttattgtcatggattaggtgaactaagccagatggaaagagcagaggagtgggctcaggcattcatttcacttccctgtttcttcctgcgtttctatgcagaaaaatcctctgattgtgacaggaaacttgtgaggcaggatgctgtgcccacaggacagtgctgcctggccaggacccagaccaggagaatgagcccctctggaaggcatctccccttcccttattaacttctgaaaaccactctgcaggggcatatctcatgtgcagagccttaatcacatctgggaccctgaatgccagagacatgaaggttagcctcaccagaaacgaccataaagatcgtgctggaggccaggggataaaaagaatacagagaaaaccaactcatgaaatctgaatgagtcacgcacacatttacatatgttaaatatttttttctcaactgtccctttattaaaattcttttaatacaaagtgctgttttggtcacctatataatttataccacagattaaatgatatccagattgacttgtgactcatgagggaaggtcagtttttcctagatggtgttggactgaacagatttgagttttttcaccttttgggtagaggtgagcatgctgctatatgcaaagggaatgtctgcattctgttaggtgttatcacattgctgttgatatcatgaataccagagggttcaagtgtaagaagatatgtactcatgacagaaagccacagggtggatgggagcagaaatagcacctggagtcatgtaaacagaggggtctgcatgagactgaaatggggatgcaaccagcacagggagggctgcactcaggtgggcaggtggcaccaccaaccttagcacacagctttcctccttcttccatagccactgctcccccatgtccctattgcagatctctccctcatttattccagtacttggaagtatgtcccggccttaaattcccaggctacatttcctcaactgctgaagctaacattgtcatgtggaaaattagaaatttgacttcattgtcatcctcaaggcctggcttgttccaaccccaccagattcagagaatgttgggatctttctgcttcatccaggttggcttagacacaaggtgaaatttaaatgtgtcgaggctttggcctcctgcctagcagccatcttcctcctttggtttcttgggcaccaactctgtcctgctgtgcatggggaggacagaaagtttctctcagcccaggacaggaacagaaattagggggacatgagtttggttccacaataagatgtcagggagtgagggatgagcagagattctgggaagaattttcatcccttataaaaagaagaaggtggggccgggcgcggtgacttatgcttgtaatcccagcactttgggaggctgaggcgggtggatcacgaggtcaggagatcgagaccatcctggctaacacggtgaaaccccgtctctacttaaaatacaaaaaattagccgggcgaggtggcgggcgcctgtagtcccagctactcaggaggctgaggcaggagaatggcgtgaactcgggaggcggagcttgcagtgagccgagattgtgccactgcactccagcctgggcgacagagtgagactccatctcaaaaaaaaaaaaaaagaagaaggtggtgaagaattttggcctgcattctttccagtaatcatgatgagaggaactgattcttagagccgctgcagccatcttaagaccatgaggcagtgagcctacgtctgcaaagccaatgtggtggggtgcaaagtagaaatagagaaagaacctggggcctttctgctgttgccaagatgcttcaccaactcgaaaagctccaacctttggacctctttgcttaagccattgctatcatttgtttccactacttccaaaattattttcatttagacagaaaagatactcagtgaaagaccacggctgggccttagacctgctctttagaagaagacaggcattatcatatgtgtgcatttgtgggagtctgaagcatgaaaggcaggaaccaaaataagtgatatcctctcctggcatcttggtcctgctgtgtccctggctagagaaacccaaaccgcttcgaagagtttataaattccattctcctgctgtcgtcatttctattttcatattctaaatataaaagaacccttcttatcttcaattcttccctctgcaagattgtgaaaatagaaccatggttaagaaacagacaaaaaagtttgaaaacacataaaatctaaggattacatgcatctcctccacaccaccgtggtgtttgcaggtttcccctccttctcagtgttttttgatgggaggatgctgactgctccagccatgttgccggcagaggttgcatttggagggtttacaaataaaagcttccagacagttactgttggatgctggggaaggtagcaggagggttgggtctagattcccagcatggaggaggccagggtgattcctgggaaaggctgttggtgtggaaagaaaagacttagaactcagacctgtggcctccaccttaagatccaagcatgggaaccatttatcaaagagccaagaaacctgagttgattcttagataggaagccccatctcatcagtggccaccaccatctgtcattcaagttgagattcaccttcagtgatggctccacataaccctcaaagcaatggctgtcaggccctgaaccagtctacatgaagcaagcttcatcacaagaagtatgagggtagcctcaaaagtgagacaccagagtccatggcctgaaggaaaaaacagtaattactgaagtttataccaattttactaacatccttcctaatgtcaaggattccccaacttcctgacagtcagtctcctctgcatgttgaactaatgccttgtctgattctaggctgaccatgaacttaagtatcacaagagatgtgcttcttcttgcctttccctccaggtagaggcatcattttccttctggtcattgtcaaaagaggaaagttttccactaaatattgctcatttccatacaagcgtactggccccagtcttaggtcaaaacccagcaactgcataggtctagtgagtccttccctcggtgcctctttttagtgtgcacctgccttatgcctttccctgaacctaagtctctataaagtctgatgcctcaagcgctacccaggctctgagcactcctcaccagcatgttcctggtggctcagaagcagctcccctggggcctggctttttggagagcagttgagggggagtacctggggaaaggctaagtgagtgaaccctctctcctcagtgagggcagctaaaactgggtgcatattcctgctgttcaccatcaatgccactttcttcttttactctttgcagtgagtggggaaatcatcccaacacaggagactgcttgcttgtcagtacattcaggaaagagagtttttgtctcctgctaagccagcaacaatgtacatggagaaatatcttgaatcagtaaaaaacttggacaaagacttgaaccccttacatctcatgtcactaccttggtcctaggcatcccagcccagtatagtggcagcagaactggaaccagctatgccttcactatcaatgccctggagcctggggactacggggagtataactgcatgcttgactatgggtagccaagcaatggtggtgcagtgtgggcacagaatccctgctgcctgtcatgcagcctgaatttctagggcacattcttgcattccagagagatgtggcccacatggaccctccagatttcacatacacatcttttttgagtggatgtagcagtagttgtcctaattcttttctgcatttctgctgacttctcatggtgatatctgcccctcgctgctctccctgaaactacagaaggcacctctgacttcatgcatggtagacctcagagcctggaatgagcatcccctaggacagccctcaatctgtggtgactaaaggaggtgtatacataccacagctccctcatctctcaggtagaatagcccagaggttcttgtgtttttacattggcatgagctttagtggtcctcatggtcctcatgagcagctgcttattgatgagcttttcactggccatgtcttccctgcctcactttcccccttctctcccagggttttctgtgctttgtaaatatgttgtcagcatgggaattcttgtcattgtaagacccaccttaagacaataggcaaattctcatgtgtagaggtatctttatctaaattctagggatttctttttttatgggtagaaaaattcagaaagttagggaaacatttaattttcctttaccaatctctcttagattgcaattaagtagcaattcttttcttctgggtcccaaaatcagaatagtctctaacaaatagctacacatgtgaggtccacattggagcagcagcagcagcagcagcagaatcctccagcccagggaaaccccagaccagaggaccctgactcagatctctccagctctcttgctttataaagatgttggttgcccacattctatccttcttccagctatgtgattttggattcttgtttagagaaggacagtttggggccaataagaatgattggtagtgtgagtaaagcactccccatctcttctcaaaaaaaaaaaaaaaaaaaaaaaaaaaaagatgtttgtgcctaatctgtggaacctatgaatgttgccttatatggcaaaagaaacttggcagatgtgattaagctaaagatcttgagatgagaagattatctagatgggtcacatgtaatcaccagtgtccttacaaaactgaggcaggaggatcagatttggggaggagatttggcaaggaagaaagacgctgagtgatgtaagagaaaggccaggggcctggaaagacagcagcttctaaaagctggaaaaggccagagaaaaagttctttcccccagcatccatagggaagcttacttttagcccagtgagagcttcatttatcccagtgagacctgtgtgagatttctcccttccagaactgtaaaagaataaactgatgctgtttgaagccagcaaggatgtggagatttgatagaggagctacaggaaacacacacagggagagaatggcatttgcctctctgttcttgcctctttcagcttctggtggctgcagctttccttggctgcggtcacatcactcccgtctctttctctgtggtcacactgccttctcttctgtctgtgttaaacttctcacatcctctcttacaaggacatttgtgattgcatttagagccattatggttaatccagatagtctccccatcttaatattattaattgacatctgtgaagtctttttgctcaatttaggtaacactcacaggtatcaaggaactaacttattaaagtatccaatctttctgtgcatacatacacaatttatctctctctttctccccattctctctcctttcctcatgatcaaaaatcacttccttaagtaaatccagttccacctatggccaggtcagagcagcacacaggggaaggccttgctcagggtttgcttagagacctgctctgcccccattatcatgcggaaggaaggacacagccacagacagccctcaaccatctgggagaatctgtctctacagaggaaagtcatgggctaagaccctccagacctgtgattgtcttcaggggcctgtggtcctcagccctccctctggatgtctgattgtcctcggggatctgtggtcctcagccctcatggagggtttgtctggcccccggtggtccaccttggcctctcattttactctttgcactcaccaaggaagtatatttgctgtgggctgagtgaggtgacaaaataggccaaagtatacaaatagctgtattttataattttgtttgtatttttctcaattaaatttatgggatattttgaaatgttttgcaaggtgtcatatgaaaatcattttttagtcatatcttgactcagtaggtgggataaaccctaattcagggttaatctctaactgtcttcacaatttgggacaaaaaaatcaagtgttggctcatctgcccctcccctggcctcagctcccacccacttcttccatctgtcttttttttttttttaattatactttaagttctagggtacatgtgcacaacgggcaggtttgttacatttgtatacatgcgccatgttgtgtgctgcacccgttaactcgtcatttacattaggtatatctcctaatgctatccctcctccctcccccgcccccacgacagaccccagtgtgtgatgttccccaccctgtgtccaagtgttctcattgttctattcccacctatgaatgagaacatgtggtctttagttttctgtccttgtgatagtttgctcagaatggtggtttccagcttcatccatgtcgctacaaaggacataaactcatccttttttatgactgcatagtattccatggtgtatatgtgccacattttcttaatccagtctatcattgatggacatttgggttgggtccaagtctttgctattgtgaatagtgccacaataaacatatgtgtgcatgtgtctttatagcagcatgatttataatcctttgggtatatgcccagtaatgggatggctgggtcaaatggtatttctagttctagatccttgaggaattgccacactgtcttccacaatggttgaactaagtagtggattaagcagcttgttttattgacaacgttctcttttcttttattcctgtttcatcctcagccttcagaaaataaaataaaaatcataattctcagagctttgtttttgtactttgtctcgagttataatttggtagtatttcccaagagcatataataattattgtattctaatttatcaaattttgtatagaatatgatatataataacacatattaatcacaactatagtaaatttattgactctttagttaaaagacagtattatcagattatctcaggagtcagataataaatatttaggtttggtgaggcaagatgcaaaattgaatatattatgtgagtacttagagaagagagaaaacaaatttctgcaatgtctattaatgaactcagatggaatgtaacccaaagagcttctcagcctgtccagtgaactgtcacttaccaccaaatgctcacaattttaaggaacacaaggaaaccccaaattgaattattgtttagatcagaaacatgagcagaggtttccaaaattattaaagtgagaaaggcctgagtctgattgaatggatgtgttgtgcaggatggggtggcatagaaagtagggcatcacccaaggaattgttcctggcctgctggacagcattgtcgtctgtttgcagggaatggaattacacacactgaagggtctgagcccggggcctgctcatctgtgcagccgtgatgatcatcacacccacagtgctgggcctaattgcgtgttgccctttaatagtttttacaaagaatgaggaggcttcagggctcataggaaagatggctaagctgcaaaggaaaagtgtgtgtggaagatgaacttctgatgaactagttttcagccaggtacattcatgcaccaatggagatgactcggttctttggagaaataaggagaggaaaagaaccacaggcttctattttattcccaacaggtttgtactaaataccatctggctgggtctaggtgactagtgagacgggaagaaacaggggctatagtctgtgaccacagggaagaagttctaccatcaggctgagccaatggacttttctggcctgaccacctgggcaggggctgctgagtgcagagaggaggaggcagggggtctctgcagctggaagcccagcacccactccaactactttgcatatccttccagccactctgctgtccagagcccatatcaatgcctgggtcagagctctcgggaagagctgctcggttaggacccagagggaaccatggaagttccagctcagctcctctcctttctggtactctggctcccaggtgaggggaacacgggatgattctgcatgccaatgaaactctgtcaatgttattgggtcctgtgacctgctcagcaagaacaataattaatattcaatgtacatcaatgatcccagctgtactgggaagacagtggatttgatctagattgcacaattgactttcctgttttattccaatctcagataccactggagaagttgtgctgacatggtccccaatcaccctgtgtttgtccccaggggaaggagccaccctcacctgaaaggccagtcagatcattgacaactattcagcctgggaccagtagaaacctgttctggttcccaggctccttatttatagggcatctaccaaggctaccagcatcccagcccggttcagtggtggtgggcctgaggcagactttaccccaaccatcaacagcctagaccctgaagatgtcacaattttattaccctcatcagtacagcagtgggtgtcccacagtaattcaacatgaaacaaaaactttcacaaaaccattgattttttttttctaaaaccagcagctttatgggctgcagctatgatggctgctcagttttagcaactgtgcctctatttggaaattttgaaattctgaaaagtaactcgttgtcaagatggtgactccaatgtctgtatttttctcagacttatttacagagttaggttttgaatcaattttactgcaaggccttcagacagactcacctgcatggatgcctttaaagacacaggtgccgctgggcacagtggctcactctttttttttccaatagagtagaacaaacatagcttttcatttaataaattttcacttaatggcagcattttcaggaacaagtaaaggccaccgagtgaaggttaggtgcacgtgagtaaataagacaattttgggtcccaattcagtaggggaaagagccatgaaggaagaataaccacacaataaaagtgcgtagaataatttctgtagttgacaaattgtgtaaaaagcaggaatggtctgtggtatctggaggctgaggccatatatttgtgctgatcagggaaggccccagggtcatactgaagattcatctgagtggtgaggaggcagccaggtgaccacaaaaacagcaaagaccacgggatcattatgggaagggcagggaccagtgtgtactgaaaaagtcagcaagtgctaaactaatcagatgccttctctgatttttattcccgtaaagataaaacttactgtaatatcttacatcatacaccttggtctgggtcactcccatggcatagaatgttccctggttcagaagttggaagcccaggtctttcctttgttgacagtttgcaggctccccagagcccttccctgccactcaagcccttatcactgggtcagtctctgtctttgagttgggatcaccataggcaggggcagcactagacactggacatggggctctggccctctgggttctagttccctggtttcagctaagggggctccacatgacagagttcatatgtcccataggacaatggctcagattgaggccattgttcagggagcccagcattcacctcccacttgatcagccagcaggactctgctgggaagcctatggagagggacatcattaactggggaagatctgtgttttgtttccacctcagattctacaggcaactatgtgggccccagtctccagcttcccaatcagtgtctccaagagggacagtttccatcaccagcctggaagcatccagggaaggttcctgagatccacccatgtgctctgtctaccttggccatggtccaccccagcttggtacagtggtcctgggacacacctttgcttaacagttagaagcttgggtgtcccagtgacattactggttattactgtctacaactgtgctgttccacgtgggaaacactagcagtgatagccacagatgtgtcaattagaaatacttaaaattagaaaagtagcttcacagttacatcaggtacatttcatgtactcagcagccacatatgactgatgactagcctattgcacttcatacatacagacattttcatcatcttagaaaatgactttgcttagcacagatgtaaatgataacatctgattactcgcagtgctatagctgagaacacaaacctcagcagttgttcttttagaagatcaggtgtccccggatgcttcctcagctcggaaagctactgtggttctcagagctgctctggaagtgtttctgggatgggaggaatgaggctgggttgacagatccaaaccaggggccgtcagcttctcaccccagtccctgccattatgccctacagggtcctttacagccctctcttttttccaaaaccacatctttggcatgtcacatggatcccagaatctagccaccctaattgttttgtgacaaatatttttcctgcataccgtttgtcctcaactagatgactggtttattgaggggaggggccatttcgtgttttctacaaaatctgtcctagtgatggatgtcataagatcaactccatgaatacccatgaaaagatttcatccatagtcaacgatcattggaccctagtatctaaaatcctgtaagatgctatgttagaaactggccaatagatggcagacaaacaccgtaataaacaaaagatagaagtctgatcttagaagtaatgaggaagtaaaagtgatcatgtccccttatggagagggaggccctaaggcgggactggggtctcctgtctgacatggttcgcctgggaggagctgccagtgtgcttagtgatgggaaaatcccctgtgctctgagaccggaagcctcatcttgcccctccctactgccttggctgtgtccccaaagccctcttcttacggaaggaactatgtttcacaaattcctatttggaatctcttacctccaatatggctgcagatggagagagagcctgctaggaggtaactagggttaaagaggtgatcagggcaggatcctgacaccacgggattactgtccttataaagagagacactatagagctttctccctcccccaccctccctgcgtgccctgagggatggtcatgtggggacatggccaaaaggtaacatctgcaaattaaaaagagagtcctcaccagcaagaaaacctttctggactttgagctttgcctttccaggctcctaaactgttagaaataacatttctgtggtttaagccatccagtcacatccattttggtgtcacaatccctgcaaacactccaccctacctaccctctctgagtaggatcagtatcaggaagccctcgtggacatggggcccgcctttgctcctcttcctgctgctgttctgactctgatgaggagggaggactgcggcttcatcctcagttcgtttgcattaagcagaaagatttacttgttttcagcctgttttgctttctgattgaaacttaatcaaactgaatgaactacttctttggtattaatatttgggaatgttcatgtttgtttcccacttagatgccagtggcaacatcgtgtggaccctgtatccagcccctatcccggcgtcccaagtgagagggtcactttcaccagcagggctgaccagagtatgaacagcatcctagctcagttccaacggaacccaggcctggctctgagctcctgctatcccctggacaccatgcctgccctggttaagggccatgggcttggacagatgtcattctgactatcagcatccaagctgccttcaggggcacatgcccccacctcccgtcattactggtgcacaaacctcgccccagttcctgctctgcctggagtgctgctgaagatctggggccttctcagtggagcagaatgggaggcagctctgaaatcttaaacccccttctcctcccactagcttcccaccttccgtatgggcacctcctgagcatctgatgagcatcacagagtagagaatgtcaatgtgttttctcccacatcctgctctgaatttatgaggccaatttatcctcacctcacacatgagctgcccttgtcttcagggatgtgatccttgtttctctcacatcctgtcacagtgttgacaacctagttttgacttcactccatgaatccttttggaaatattatggtcaacaagttgtcgtccttgaataacacacaataaaaataacaaatattcagaaggttttgcaagggggagaaatgtttcattgtgaacagagttccagcagctgtgtgtgccatagaagctgggcagagagatcccatatggctccagttagaggggaggctgccaacgagccatggagggcttttgtcttgtgaccacacctgtaagcctttcttataagccacatgtagcctaattctatgagccacatgtgctgctctgtcctacagggacccccaggggacaaaatgcccatgctgagctctgggcacaaaacatccttctaccaggagccgaggcccactccctgcctcctcggcacctgctgctttgtgttccccagacccttagcaatcttagcaatcctcagcaatcctcagcatccttagcaatctatgagtcagggcttgacccagaaaggaaatgaagtgagtcctgagcctctgacccttgggctctgtagtgggaaagtggccatggggtggggcactattgctggattttcttgttcatgctcaatttaccaaagtttaaaaccatgccttataacaacaattcatattatatttatttacatgaaaagtgcatattatatgtgttatatatgtataagatatacacatatattaatacaaattacatctgaaatagcatagaaatatatttaatttgtaaagtgtgttacaattacatatatgcatatacaaataacttatgtttatttatttagcatgtgcttctttttcttctaactataacagagtctggctgagtaaagactctggagacatttgatgaccctccctctttggcactagtagggtcctggccactcaggaccagtgaggacagaactgaggaaagtcgacctaggatcccaggccctgcgctacggctttggtctctcagacttttaccctggctgaagggttcctgaaggatttgttccacattgaactgggctgaccagcaagaaggaactatgtgcatgcagcctatttacactgggaaggaagaaggaaagtgtagcaggaaatagaagatgggtggcaaaagtctcccctaaaagccacctaactcttaggatgactgaagcttcatcccatgtggaaacatggggacaatgcctctgggctattccatctgaggggagagagctggggtatgttatcatactcctgttatcatctactgatagtgtctctcttagtctgttgtgtcttggtataacagaatgcctgaaattgtaattgataaagagcagacaattattctctcacacttctggaggatgggaagtctaagatcaaggaactgtcagattaggaatcagtttatctactttcaagatgacactatgactcccgagtcctccagaaggaaggaagtccatgtcctagcatgactgaagagcagaaaagagagagagagaaaccctactcccacaaatgggaaagagcaaggactcactctcaggagcctgcaacccccacaccccaagcatggaaagaatagaaaatcttgactctcttcaaaggaaattccaagcacctacctagccttaagacgtaagtaagtaacatgataagcaaggaagtaaaaacagcctaaaatggccaaataagctagactcagaagatggtgggttcccctatagaaactgaaggtgacattttagtatatgtctctgaggtgtttttgaggaaacaagaccccctccaaatgaatctgccagcacacagatctcacaaaagggagaactggggactgagctctgaccatggtactttgttctaaatatcttacagaggggtctggtaaaagtcatatccataaacctgagctaattcgtctcttctgctgaacccaaatgtttaaacaaagcttttcttccttagccaattgtaaattagaaatcttgtaatccacccttgatctgtaagcccctgtttcaagatatcctgcccttttaggccaaaaccaatatgtgacctccatgtattaattttcaatttgacctgtaacttctgctttcctgaaatttactcctgccttaaaaaacccttacctgcaagccatcagtgaggccaggatttgaatcttagctgcctgattctctttacctgatgccctacaaaaaaacaaacaaacaaacaaacaaacctttactttctcctgctgcaaactcagtgtgaatatctgatctgactgagctgagtgagtggactccagttcggttccacagcacaagctctttttatagtggcatttatccactcatgagggcagagctctcatgacttcaacacttcccattaggccccacctcccaattctgttgctttgagataaatttaaaaacagatgggttttgaaggacacagtgaaaccataacactgcccaaagagagggccattcgagcccctgtggtctgctatgcatgcaggcagagctgccttctccaggttcagaaagagcaatgaggggcatagatggccattggaagtcagcagcagtacagcgaaagggaaaggcatagcctgtagacagggattgcaatcttgatatattttctatttagtttcctttctaaaaacagaataatttcatgctaacagaagtgttgtaagtacagcacaaagtgctttcttccaattaagtgcatattgtattttttaaaaaataatctccatctccatacacgaataaaatacattactccatctagtcctcaggaatatttcgaattttgacaattaactcaaaaaagttctttgtaaccaaacagcctccaggaagaaacacttatttacggacaaatctgtgatgccctggtccgacctgggacactggggacattgctcctatgctgagttactgagaagagccagccctgcagctgtgcccagcctgccctatcccctgctgatttgcatgttcgcagagcacagccccctgccctgaagacttattaataggctggtcgcaccctgtgcaggagtcagtcccaaccaggacacagcatggacatgagggtccctgctcagctcctggggctcctgctgctctggctctcaggtaaggaaggataacactaggaattttctcagccagtgggctcagtacagcctggctcttgatggaagccttcctataatatgactaatagtatgaatatttgtgtttatgtttctaatcgcaggtgccagatgtgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctcccacagtgtaacaagtcataacataaatcacccaggggagcagatgcgtgaggctcagctgtcccagatgccccttctggtgccttcgcctgctgagaatgtttctcaaattgcagtcacactttgaagttcactggagagtttttgtaaaagggccatgaaggcccacttcatcgtagctgtctttccttgtcctaatccccagtatcatagacagggcaatgcctctcctgatttcattgagaagaaatggttacacctgaggggtctgagttgtagcatcagttggaattcatgtagcaatagtgagccactctaggtattccaagtaggattttttttaaatataagatgtgagaatctaaactacagccttttaaaggtttgcaagtatagtagtcaaagacgcaaatactagagaagaggaattctcttccggaatccagaatgcatctgatagagaaggtacaactgccaatcatgtggtcctcagacctttctgagaagcccatgggtgggggtgcagatgctctcagctgcctagaggacttcatcaggtgcttctgcagtcctcacctcggtccatatgtcttgctgcaggtgttgatggatagtattgaatcctcctcttcttacttctcaatctcagggcaggccccacactgggcaactccaccaaaaaccagagaaggcatagggtttctggcaaatgtgcttccagaatgatagtgatgatggggaagtgacagctgacatcgtagtgtggtcatgtatctcgactctcaggattttttcagtgaagtgatggcctcagaatacacttggatgtacttccatatactatgagtaagtttgaaatcatagcatgaaaatgatatttagtcatatgataaatagaactacatggctacattaatcaaaatagcatagtgctggtacaaaaagatacacagacaaatggaacagaatagggaactcagaaataatgctggagacctacaaccatctgatcttcaacaaccctgacaaaaacaagcaatggggaaagtactccctatttaatagataatgctgggagaactggctagccatatgccaaaaattgaaactggaccccttccttataccttacacaaaaatgaactcaagatggattgaagacttaagtgtaaaaccccaaactataaaaaccctagaagaaaatctaggcaataccatttaggacatagacacgggcagagatttcatgacaagaatgcccaaagcattgcaacaaaagcaaaaattgacaaatgtgatctaattaaactaaaaagcctctgcacagctgaagaaactatcatcagagtgaacagacaacattaagaatgggagaaaaattttgcaatttattcatctgacaaaggtctaatatccggagtctataaggaacttaaacaaatttacaagaaaaaaaaacaaccccattaaaaggttggcaaaggacatgaacagacacttaaaagaggacatacatgaggccaataatcatatgaaaaaaagatcaacattactaatcattgaagaaatgcaaatcagaaacacaatgagatactatctcacaccagtgagaatggcgattattaaaaagtcaaaaaacaataagttaggcaacgtgactcacacctgtaatcctagccctttgggaagccgaggtaagtggatcacttgaggtcaggagttcaagactagcctggccaatatggcgaaatctcatctctactaaaaatgcaaaaattagctggaggtggtggtggatgcctgaaatccctgttccttgaggggctgaggcacaagaatcgcttgaacctggaagacagaggttgcagtgagctgagatcatgccactgcactcaagcctgggtgacagaatgatattccttctcagattaaaaaaaaaatcaaaaaacgacagatgctgcggaggttgtggagaaataggaaaacttctacactgttaatgagaatgtaaattacttcaaccattctggaagacagtgtggtgattcttcaaagatttagaactggaaataccatttgattcagcagtcccattactggatatatacccaaaggaatataaatcattctactataaagatacatgcatgagtatgttcattgcagcactatttacaatagcaaagacatggaatcaactcaaatgcccatcaatgatagaacagataaagaaaatatggtacatatgcaccacggaatactatgcagccataaaaaggaatgagatcatgcccttttcagggacatggatggagctggaagccattatcctcagtaaactaaggcaggaacagaaaaccaaacactgcatgttctcacatataagtgggagcctaacaatgagagtacatggacacgggaggaaacgacacactgaggtctgtggtggagggagaaggaggaagagagggagcgtattaggaagaatagctaatggatgctgggcttaatactgaagtgatgggatgatctgtgcagtgaaccaccacagcacacgtctacctatgtaacaaacctgcacatgtgccctggaccttaaagtaaaagttgaggaagaaaaaccattacatatatatataaacattatatatatacacattatatatataaacattatatatatacacattatatatataaacattatatatatacacattatatatataaacattatatatatacacattatatatataaacattatatatacacattatatatataaacattatatatacacattatatatataaacattatatatacacattatatataaacattatatatacacattatatatataaacattatatatacacattatatatataaacattatatatatacattatatatataaacattatatatatacattatatatataaacattatatatatacattatatataaacattatatatatacattatatatataaacattatatatatatatgtgtatggttgactcatatatatatatatatatatgtatatggttgactcatatatatatatatatgtatatgtatatgacttagccataaaaataaatttaataatatctttcccggcaacttgcatggaggtggaggccgttattcaaagtgaagtaactcaggaatggaaaaccaaataccttatgtccacacttataagtgagagctaagctacaagtacacagaggcatacagagtgatctaatgaacattggagacagaagtggagagggtggggggggtgaggaataaaaagctgcatattaaaaaaaaaaatagaaattgcactaaataatatagcaatcattggaccaaaaaaaacctttgttgaatacctgtatgtgtatgtgtgtgtgtatatatacatacacatatatatataatctgattacctatatatatgcatacaaacacagacacacacctatatatacacaaacacccacacataaatattttatatataatatataatatatatactatattatatgttatatatactattataatatatataatatatatattatatattatatatactattattatatataatagtattatatatattatataatagtatatattatatataatagtattatatatataatatatataatactattatatataatatatataatagtattatatatatataatatataatactattatatatattatatataatactattatatatattatatatattatatatatataatattaatataatataatatataataatatataatattaatattatatatataatataatataatataatatataatataatataatataatataatatataatataatataatatatatattaataaaattatatacatatataatatataatagtatattatatacatatataatatatacaatatataatatcataatatataatatgtattatatatataaaatatgtgtgtgtgtgtctgtgtgtgtatgcatatatataggtaatcagaacaggattttatagtataatatagatttattgaaaatcattaagttcacattccataaataacatgtgttcatacatatatatgtgtacatttgcttatatgtttgtatatatatatgtgtgtgtgtgtgtatacacacagatgtaacattcttattctttttttaatataaaaaccttgctactcaaaatttgtccagaacccagtagcaacactaagagcatgttaccaattcaaaacagcaaaaccaccttagatcaattgaatgggaatctgtattttcataagataacagatgatccattgaaggtttaagaagctatgttttagggaatgtttacttcagctaagaaatttttgttgtttttatccaacatgtcaatttaagaaaatctgattaaagtcacatgttgaaaacacatccaattttttttactcaatttgatttaactttaattaatttaagaataaatttgcttttttaatgctgaaggttgaaatacttaattatttgtcagtgacatgatcacataacttgaaacttaattggagaaaaggttttagaaccttgagtaattgctaaagcaaaagaagaaacccacatattgtatacgtgtgttgcagctgatgggacttaaatttgcttgtgtagcttgacctcaggatgttgttaactgccctggctgatcactgctccttcagtcttgaccccaattaaaaaaaaatccatatattagagataagctcagcaacctacagcacaaccacgcagctgagccctgtctagatcagctaaattattgttaatatgaacatccgtaaacatgaaaataaatactagtattgtaagcctctgcattttgagtggtttgttacaaactattattgttgaaaagctaatacattattaaacatccacatatatagatgcatttaatgaaaattgactgcataaatatgaatacttagaaaatcataaagaaacaaaaacatagaagaaataatacttaaatcagaagaaataaaatacaacttagctcatttatggaaacatctaacaggaatagttagtattgaggatacacatatgtagcaatactcaacagaataatcaaaatggaactttacatatacactacagattgttgaaaatcattaggttgacattccaggaataaaacatatgtttatacatatatgtgtgcatatgtgcatttatctttttatatatgatatatgcatttgcatatatatttagacattgctttctgcataaacttatataaacagttatgttttaacaaagttgtatgaccacatatgtgtgtatatactcacatacacacaagctacaagcacatatacaaaattatcacagtgccaaggaaatgtattttggcccttctagaccctaggttacagacagtactcagaggatggaagaattttaataaaacagatatcaaaacatcatgtgaggcatgcatacattttgttgaaaaattttctttttacagtcaccattttctttaaagttttataaagtgttgttgtctggtctcctttgtaatttagaccttaggttaaatttgtgacccatgaggaatgctggattctggactgaaggtttttggattttgccattcattttattttatgttccaggatacatgtgcaggatgtgcaggtttgttacattggtaaacaggtgctatggtgatttgctgcacctatcaacccatcacctaggtattaagcccagcatccattagctatttttcctggtgctcttctcctacccaccctcccctgaaaggccccagtgtgtgtcgttcccctccttgtgtccatgtgtgctcactgttcagctccacctctaagtgagaacatctggtgtctggtttcctgttcctgtgttagttttctgaggatagtggtttctagtttcaaccacgtccctgcaaaggacatgatctcattcctttttatggctgcatagtattccatggtgtatatataaaacattttatttatccattctatcattgatgggcatttgggttgattccatgtctttgctattgtgaatcgtgctgcaatgaacatacacatgcatgtatctttatagtagaatgatttatattcctttgggtatatacccagtaatgtgactgctgagtcaaatggtatttccagttctaaatctttgagtaatcgccacactgtcttccagaatggttgaactaatttacattcccaccaacagtttagaagtgtttctatttccctgcaacctcgacagcatctgttgtttcttgattttttaataatcaccattctgactggagtgatatggtgtctcattgtgattttggtttgcatttcactgatgatcattgatgttgagcttttttcatgtttcttggccgcatgtatgtcttcttttgagaagcgcctgttcatgtcctttgtccaccttttaattttttttatttttatttttgtaaatttgtttaaatttcttgtaaattctggatattataactttgtcagatgaataaattgcaaaaattttctcccattctgtaggttgtctgttcactatgatgatagtttcttttgctgttcagaggctctttagtttaattagatctcatttgccaatttttgctttgttgcaaatgctgtaggcatttttgtcataaaatctcttcctgtgtctatgtcctaaatagtattgcctagatttttgtagtttggtgtttttttttttttaattatactttaagtagtttgggttttaatagtttggggttttatattaagtctttaatccatcttgccttcatttttgtataaggcataaggaaggggtccagtttcaattttctgcatatggctagccaattctccctgcaccatttattaaatagggagtacttccctcattgcttgtgtttttgtttttgtttttgtttttgttctttttatcaggtttgttgaagatcagatggctgtagatgtgtggttttatttctgaattctctattctgttccgttggtctatgtgtctgtttttgtactggtagcatgttgttttgcttagtgtatccttgtagcatagtttgaagttgagtagtatgatgcctccagttttgttctttttgcttaggcttgtcctggctacacaacctttgttggttctatatgaattttaatttttttttttttttttgacggagtctcgccttgtcacccaggctggagtgcagtggtgccatctcggcccactgcaagctccgcctcctgggttcacgccattctcctgtctcagcctcccgggtagctggaaatataggtgcctgccaccactcctggctcattttttgtatttttagtagagatgggctttcaccgtgttagccaggatggtctcgatctcctgatctcgtgatccgcccgccttggcctcccaaagtgctgggactacagacgtgagccaccacgcccggccaaattgtttcttctaattctgtgatgaatgtcatggtagtttattgggaataggattgaatctataaattgctttggggagtgtggccatttttgcgatattgattcttcctatccaccagcatggaatgtttttctatctgtttgtgtcctctctgattttcttgaacagtggtttgtaattctccttgaagaggtcttccactttcctcgttagctgttatcctaggtattttattctctttgttgcaattgtgaataggagttcattcttaatttggctatttgtctgttgttggtgtgtagatgcttgtcaattgtgcacattgattttgtattcagaggctttgctgaagttacttatcagcttaagaagcttttgggctgagtcaatggcattttctagatacagaatcatgtcatctgcaaacaaagataatttgaatttctctcttcctattcgaataccctttatttctttctcttccctgattgccctggtcagaacttccaatactatgttgaataagagtggtgacagaggggtatccttgtcttgtaatggttttcaaggggaatgcttccagcttttgtccattcagtatgatattgactgtgggtttgtcataaatggctcttattattttgaagtatatttcttcaatacgtagtttattgaaatgaagtgatgttgaattttatcgaagaccttttctccatctactgagataatcatgtgggttttgtctctagttccctttatgtgatgaattatgtgtatattgaaccagccttgcatccggggatgaagccaacttcatcgtggtggataaactttttgatgtgtggctggatatggtttgccagtattttattgaggatttttgcatcaatgttcattagggatattggcctgaaggttttctccttttttttttttttttaatctctgccaggttttggtatcaagatgattctggcctcttaaaataagttagacaggagtctctccttttcaagtgtttggaattgtttcagaaggagtggtaccagctcctctttgtacctctggtagaattgaactgtaaatccatctggtcctgggctttttttagttgataggctttttattactgcctcgatttcagaacttgttattggtctattcagggattcaacttcttcctggttcagtcttgggtgtccccattctttaggtagaagtgatcctgatgttacttgtaaagacaacgtttgcaatatgttaggtgttaatacattgcttttaatgtgtgaaaaaggaattcaagtgtgggaaagtgtgtattggtgatgtcaagccacaagggtggatggagatagaaaaagatatgtagtcatgaaaaacgatgaatgtgaacgggactgaatttagggatattatcaacacagggagagctgcaggataggagtcagatctctggtagctgctggcagggatgctgtccttctgtgggccgtagtgagaggaacagctgtcttctctgcaggaggcagtctgaatatggggtctcaggcagtaaggactcctccgcagcctgaatcggcagtacagtttgtgagattgttccagaggttttgcctggagcctgttcttaaggctttccaacaatttttgagctatttaatatcccataatgaatccctttatgcttagtgcagttcacatttgtaaccaatactaatgaccactccacattgagggcatggttgcccccttttttcctgctaaatttaatgctttccaggtgaatctactagagaaggccaacatgaataaccttcatgtcatcaaaagtgcatgacaaataagctcaggggagccaccgggttctcagtcatctgcagtgtctcatgacatgaaaagaggagactgaggaatcttcctgtaatccttcagccagtctttctgcagccttaggtagggtctccacgtgcatgtactcatcagtgctctgtggaatactgagggaggcatctggggatagcctgggctctctctgaactccctcctctgtttctctgtctttctggacctccaattctttttcctctcttcagggacactcccaggcacctcatggatttcctttcactacacaatgctctggcaactctcctcagggtctcagatggatcgttccaaatttcatctcctttggtttaaaatcttctgggctcaatatccttaatttctaatgtccaatttcttgaaaacatttgcctcatgtattgtgtcctgtgttttagttaatccagagaggagtgtaaacctagtccattctaatctcttttggctacaggttgaatatctggaagcctacgtctgaatttaaatatttttcgctcctcaaggttcttcaccagcacctggtagtgtgaggatagcaggtcgtgctttagggttgcaattgggactttactgccattaccccatctcttgctttttccacaccacacaagttctcctgaacacatatacagacacttcacacacattcacatgccatcccgcctcccagcagcagaaacctggcctcactttgtgtctgagcggggaacgcctactgcgtagctactctcagaggaacgagcccagagaaggggccaagtccctggaagttagggttagaacatttgaattggtagtttcaggaccccaagtatcagggtgtgatgtagaagaaaattggctctatattagcacagtctcagtctctctctgtgaaagactggaggggaggagagcctggtgagggcccttcacttctggggcccagagcaagaggtccctcatgttgagtgtgcatgtagctttgattgatgcattattactgagacactcaatagctccattgaaatacaagattggagacctccaaccaagatgctctgtcagtgttgacagggctcctttatgatccagcaggctgttgagggctccctggccttgatgagttcgcagcagagctagctttgtctccagcctcatcctcccttcctctgtgtcttccgtgaaactcggagcaattccccaggtgatgtgatcttgtcttcatcctactttgaagagaattgatcctgagtggttctggggtatttaaggttgtacatttatcctaattcaggcttcagtttcacagctatcctatttggttgatgaaagaaactgtatttgatttgatttttgtttttttgataatcaggtttggcatcctcagtcagaactttcatgctgatgagctgagagaaataaagttacatgggtctaggcacagtggctcacacctataatgccagcatttgaaaggctgagactggaggattacttgagcccaggaatttgagactaacctaggcaacatagtgagaccccatctccacaagaaatgaaaaaattagccagatgccgtggcacacgcctgtggttctagctactggggaggctgagacaagaggattgtttaagcccaaggggttgaggttggagtaagctgtgatcttgccactgcactccagtgtaggggacagagcaggacccagtctcaaacaaaacaaaacaaacaagttacatttgtcgtgaggggtagactatgtaggtccccaaaccaagaataggatgcccatttagttgatggatactaaagagacctgtgtcttcagataataatttgtctgtgaactacacacctttgagaaagcacagtgttatctttgtgcgtctacagtaaatttccatgtcttatggttgtaacaggtgtggctcagtgccatcacaaaataccttagaatagcttgggtatgctcttaagagctgccatttttatttttaaaatattgaaacaatttcacatttacagaaagtttgtaagtagagtacaaagtaacacatttccccctaaaccattgagagtaacttgatgacctcatagttccaccctttaagactttgctatgtatttccttcagacaagacattttcctacataacccaatacatctgtggaaccagggaatcatcactggtgcatcactccatctaatcctcaagtgtatttcaacttttgttaattgttccaataatgtcttttgtaacaaaatgattcacgggttgcctttgctggcctgtacctccgtagttttcttccatctagaacagttccagtgtccttgtttggactttatgaatttgtttgaattttcttcaggattgaactctgttagtgtaactgttgcgggaatatccagaagcgatactgtgctctcactgaatcctattgggatgtgtgtgatttccatctgccacatgactgacgaggttcaatctgactcctgctgaagggggtgtctgccaggcttctccctgcaccttcactgttgttctgtttgaaagagataagaatttgtggagatgttcttgatacttcatgaatatccctctcctaatcgaaatatagacatggatccatattttcttcaatgggttatactctgctaccatcatcatttattttcatagtcaaccctcctctgatttgtccaatgggagcctcattcacactgcctctgaatacctgctgtttttatcccatcattctctgagcacttttttagtttctggcactagatggtacaagctcatcttccatctcccctattttagacctgacatcagccatttctccaaagattactgattccttttagtagaaatcggcattcagaaaaataagatctacacactaaatgtgttcagtgggactgatgtgtcatcgcttctagagaaaatgagctatctattatctatcatttgtctatctatcatcatcatctattcatctatctttttacctatatctacataaaccatgaattggcactgatatagctataatccagagtcatagagtttattctagtacgcgcttttaaaatatttctaacatttctccctgggtaccttggctctaattatccttactacactgacttatgggatcaacatctctttgtgacactagtctcctgctgtcattgccacctacacgctccttgtagacaacttccctcttctgcctcacaacctgcattagccctgatatgctttgccagctcactgttaactttgactcctgcatgggtgaccttctcaatctacatgggccgttatgctagtaccactggctttaccccttttgaagggccctgctcatcctgcttcagctgtgacatatgtgctagtgggaggatgtcgccccacatcctgcgcctatgtggggataccctcctccctccactatagcttcaacacctctggtggtcttccctctctactgcacatcaactgccctttccatgccatgtgggtttcacactctgtgcaatattttggtttccccttcattttggtgcatggttttctttctgaacctactttggtcaaatgccctaaacccagtcattaagaactgctttctcttaaaaactggaagagattggtaatatagagatatacagtttatggaacagagtagattcaagagtagatgtgagcactgggtctagataacatctcagtttccggaagatattagcttaagaatgacgtaaggcacacatattaatccaaggagctcaggaaacatctagcataggaatgcatgatggcacacagaggtagagagtagctgacacttttcagaagtggagggagaagatttctgatgttggcctagatgaaagaagtaggaaagaaaatgtagaaatacaggaagatgatcacatgtctgagataagagatttgccatgtcgtttacccagtgtacaaggattacccaatccttgcaaagcattacactactttcacatattttgtgttaacattttcctttttcttatttttaataaataaatctgtccttctatccatccatctatgtatccatccatctttcttatacctcatcattgcatctctggctgatagtgctgatgatttacaacatcaagggctctagaggatcagagcaaagaagaagtctctctggcctcaataatattcatcagtaccaaacgcgggacacttctaaaatttattgcagattctggagatgtgcttctccaacaagccaggtcttagacgggaagctagcaagaaaagtaggtcatgacctacttctgcagagcagaaaagcaatctccttgcaggacagtagacagattctgttctgtggcccccagagagaaacttgttctctgctaacaagtgtatgcaggcctgatcaatcttaggacccctgggggacactaggcctgtgcaatattatgcaggtaaagtcattcttgcatctgttgaaattttcattttcaaaaaaacacagccaacttcctgaagacttgtacacaggctggtcataccacttgcaagagtcagtcccagtcaagacacagcatggacatgagggtccctgctcagctcctggggctcctgctgctctggctctcaggcaaggaaggagaacactaggaatttactgagccagtgtggtcagtactacctggctattcaggaaagtcctctcataacatggttaatagtgttaatagttttgtttcccatctcaggtgccagatatgacatgcagatgacccagtctccatcctcgctgtcttcctgtctaggtgagagtcaccatcacatgccaggaaagtcaggcagggcattagccatgttttagcctgatacaaagagaagccagggaaagcttctgagctcctgatctacgatgcatccaatttgcaaacctgggtcccattgcagttatgtggcattggatccaggacagatttgattctcaccattagcatcctccagtctgaagttgctgcaacttcttattattggtcaacagtataaaagtgaccctctcacagtgttacaaacccaataagctccccaaggaagcagatatgtgagggtgggctgccccagctgcttctcctgtttcctccatctgctgagagtgtttctcagactcagccacactctgaaggtcactgagcagttttcatagaaggggtaagggaagtgtctctacacccttagtttcttttatcctcctcagccccagcagcagacatggcaatgcctctcctaatttcatagaagagtcattacctatgaggactctgggttacagcactggtccaggttcatacaacaaaagagaagctattgtaggtaacccaaatagaaagtttttcctaatatgggaaatccatgtctaaattacaacttttcaaagaccagaggatataatggttaggaaaccagaaaggcaaaaggagtgctgggaaatctacttcaagaagcaatggtggccgcgcacagtggttcaggcctgtaatcccagcactttgggaggccgaggcaggcggatcacctgagatcaggagttcaagaccagcctggccaacatggcgaaaccccgtctctactaaaaatacaaaaattagccgggcatagtggtgggtgcctgtaatcctagctactcagaaggctgaggcaggagaatcatttgaaccaggcaggtggtctctgcagtttcgaagcccagcgccatctgtggctgttatgcatgtctctcccagccaccctgctgtccagagcccatatcaatccgtgggggtaggtctgtgaaagagcagctcagttaggacccagagggaaccatggaagctgcagctcagctgctttgattcttgttactctggctcccaggtgcaggaaacaccggatggttctgcatgtcagtgaaactttctcaaccttgttgagtcctgttacctggcacacctgctgggaaggcacaatgattaaagctcaatgtagatcaatggtcctggatgcactgggaagacaataggtatgatgtagtgtacgtgtgtgacatttctgtttttattccaatttcagataccaccagagaacttgtgatgacagtctccagcctccctgtctttatctctaggggaaaaagccaccctcacctacagagccaagtagactattagcagctccttagcagggtatcagtggaaacctggacaggctctcaggctcctcatccatggtgcatccaccaggaccaccaatgtcccagcctggtggagtggcagtgggttcggggaaaacttcagtctcattatcagcaggctggagcatgaagattttgcactttaacactgttatcagcatagtggtgggtattccacagtgattccacaggaaaccaaacctccacaagacagctggtgttttttcctcaagccttctgtttacttatgggaagctactatggtggctgcttagttattgagagaaaacaatggagacttcaataaatagaagtttataccacattcatgcattataaaacttaatattgtgagtaacataattctcccttaattaattcaatacagtgacaattaaaatcccagaggacttttgtgaaattgaaatgatgtttcatatatatatagtatatatatatatatatatatatatgtactcacataccacgcactatatatatatatatatacacacacactatatatggtgtatgtatatatatagtgatatgtatgtgtataatatatatatagagagtgtgtgtgtatatatatagatacatacatatcacacatgcatttaaaaaggacaaaaatagccattggaatcttgcataagaataacaggtcgggctgggcgtggtggatcactcctgtaatcccagcaatttgggaggctgaggtgggcaggtcacctgaggtcaggaggttgagactagcctgaccaatatggagaaaccccatctctactaaaaatacaaaattagtcaggtgtggtggcacatgcctgtaatcccagctactcaggaggctgaggcaggagaatcatttgaacccgggtggtggaggttgcagtgagctgagatcgcaccattgcactccagcctggggaacagagccagaatctatctcaaaaaaacaaaaacaaaaaacaacaacaaaacaaaacaaaaaaagaataacagggcaggcatggtgtctcacgcctataatcccagtactttgagaggctgaggcaagtgtatcgcttgaggtcaggagttagaccaccctggccaacatggtgaaaccttgactctactaaaaaaatacaaaaaattagccaggcatggttgcacattcctgtagtcccagctgcttaggaggctgagacaggagaatcgcttgaacccagggggcagaggttgcaaatgagccaagatcatagcactgaactccagtctgggtgacagagcaagactgtctcaaaaaaaaaaaaaaaaaaaagaacaaaattgaaggaataacaccaggcaatatcaaaccctgttacaaataacactaattaataatgtaactacagatccgcacatatgtaatcacccaatttatgataaaagtgttaccacgggccaggcacagtgactcatgcctgtaatcccagcactttgggaggctgaggtgggcagataacgaggtcaggagttcgagaccagtctgaccagcgtggtgaaaccccatctctactaaaagcacaaaaattagccaggcatggtggcacatgcctgtaatcccagctactcaggaggctgaggcagaagaatcacttgaacctgggaggcagagattgcagtgagccaagatcgcaccactgcactctagcctgggtgacagagactccgtctcaaaaaaaaaaaaaaaaaaaagaaaaaaacactgttaccatagatgatgcatactgaaagagaaaaatatcttggtcaggtaatttaaaacaagagacatgtactttctcacagttctgaaggctgggaagtccaaggtcaaggcactggcaatctttttgtaccatgagggctgctccagcttccaagatggtggcttgtggctgtgtcctcacgttgtggaggtggaagggcaaaagagacaaattctgtgtgaagccacttttattgggcgttcatcccattcaccggggtggaatcctcatgaataatcagctcccaaaggccccactttgtaatcctgttgcatggggtaaacaggaatcttggatgagatgcagacattcagaccagagcagtgatcagtagaaaaatatataataagtgaactgtattggatcaataagatatctatattacatcaaaatgaatcctgacctctatatttcacctctatattatataaatatcaactctaaatgaatcataaaatgaaatatgaaggcaaaataataaagcttttagtaaagagcataaaaacatatatcataaacaggtgcagaaataaatttcttaaagagaacacacaaagcactaggcacaaagacaaagattcatgaattaggttttatttgtatgaattccttcttatagggttttaaacaaataaattaaaaatattatttgatgaatacatatagaagaaattaacagagaggaaagtcaaattataaagaatatgagattcagaattctgattaactgtggggggagataggcatatggcatcgtggaaaccccacccagagatcacacttttagaggaacctgtagaatggtaggccttgtgacagccatcttgaaggatataactggcatcagtcaaccctgtggcccaaacaattcatatccctcttacatgttaaatgctctaattctcaccccatcaagtctaagtattattccataatagtgtcagggcaaaattcaaaatatcatcaccaaaatgatgtcctggggactgatgttagcaagatagcagagtaagagataccaggcttcagccctcacaaaacccagcaattagtcagttatccaagaaggccaataccctgggagggctgaagagttcaattacaaacatgcagcaacatgatagagtaaaaagccaagaataagcacacgcaaaggatggctggaagctgatggcacacctgagagccctgatacctctaggaacaaagaaaggggaagcaattgttatcagccaacggtggtgccactgtgggccccatagcctgctctgtggcaggaccctgcagcctttgctgctgataacctcagcagccacccaggcaatcccccaccattcagctttcccagtggaggccctttaatatttcttgtcgaggatcacagcagcctgctccacaggggccactggtgcttttgcctggacagttacctgcagccatagtcgcacactccccagagagggagatgctgctatacgcactccgcagtgaggagccattgttttctctcctgtgacagggctacctcccagccccttggcatcaaccttaccctctgcactgccccagacccaggcctccgggtctcaccctgccctggcaactcagacagtaagccacctttatgtggactagcccatgcccagccccagacccaccatcactgcaagtgcaccctcgctccagacctcgtcactgtggctgctctggaaattgccaaagacatcaaagaaattgagacatgtttataggcatacctcagagatattgctggtctagtttccaatcactgcaataaaatgactattatcataaagggagtcacactcattttttggttttccagtgcatataaaagttatgttgacactatcttgtattcggttaaatgtacaatagtgttatgcctaaaaaatgtacataccttaattttttaaaactattgctgagcaatactgacatagagacaggaagtaagaacctaccactggaaaaacggcaccaaaagagttacctgaggcagagttgccacaaaccttcaattggtaaaaatctcagtatctataaagcacagtaaagcaaaacacaataaaaggagatatggctgtatcttgaaaaggatgagagctttgggtaaggacagtgttaggttttgaagggaagggaagggttaaagaaagacagagagagagttggcggctctacagcaaagcaggttttatgtccagcacaagactgtggaggtgggggactagcttaataccagaacccgctgccgcttacaggctggggtacttataggtatgggcgggaggggtctagacggtattacttgctgcccggcaggacgttgataacatgttcctgtggtcaggcggttttgccaaggatgttccttgggccttttgcccagcggggcgtgataagaatgtttcttgggcccactgtccagcagaagacgatagggatgttcctgtattcacgtggttaggcaggatgtttctcacagttccaaccccccgtgtaatgtttcactttaaccaaggtctacaaaatggcaggggggcttacaaaatggtgcacctcggactaacagataggaaaagtctatggccttttgcctggaactgctttttttcacccaagcttcgtcaacaagaattttagaactgtagttttaccagctgaaatggcagcaacaactggaagcttgttgccaaacgggattgacttgagctgggttggagagtagaacaagatccttcagtgttttcagctaatggtgctgaactctgcaggaaatgcccagaaaaggcccagagttttgcaagtccaaggtgatgaccctgggagactggtacaccagctaaaacttgataatggattactggaaaccatggagtcatagaattatagagatcatccctgcacacattcttagaatgagcagatgtgacttagaaattgcatatttgagtgacagagacccaagtgggcccagtgaataaaagtgaaggaggtgtcttttatgggcacgcttcaagccacacacatatacattggcagaaagtagattattgaggtcaaggagtttgagcaacacaaatgcctaagttactggtgattaccaaactgtgcagacacaggtagggcttctggctaaaacttaaaatgaaaaaaatcagaaatatcaatcgccaaacagctagtaagggatagattctgcagcataagaccagtcaattaagaggaaattcaacaatcttagaaaaataaaacagaatgcagaattatatattatttgtgagacataaaaaatatattatcaaccggcatttttccattaaaattcctgaaaagaaagagaaaatcataaaccatattgagataaatcagtcagtggaagctgactcttgactgttcctaaatactggattttgctaagagttttaagtggttgtcacataaatgcttcaaagaatattcaaaactatgagcaaggactgaaaaaggaaaatataaagacaattactcaaagaatgagaactctcaacagagaaagggaaactatgggaaaggaacaaataggaattctagatgaaaactataaaaacagtatggaaaattcactagatagggcaacaggagtttaagttggcagaagcatcaatgagcctgaagacaatttagtagaaatgatctaatctgaaaaagaaagaaaatgactaaagaaaaataatcatgaccttagaggtttacaagtcaatgtgaagaagaccagaaatatgcaatgagtcagaaaggagaagacagagaaagtggccaaaaaaattttggagggatgacaaaagctttcaagaagcaatgaaactcattcgtctatagataaaagaaattgaaagaacttattcaggacaaacacaatgatacacataactatacatattataattaaaatgctgaaccagcgacaaggaggaaatcgcaaatgcacaaaaataaaatgactctctatatacagaaatacagtgataaagccatcagctaacttttcatcgtgcccaaaggaggctagaaaacagcggaatgacatatgtaaatgcagggaaacaaaacaaaacaaaacctaggattcaatatccagtgaaagtatgcattcaaaataaaagtaaagtaaaaacatttcttgataaacaaaaatgaagagaaataattacttaaagacatgctgtataacaatttatctaggaaattcttcagattcacaaaaaatgacagcagacagtaacttgaatctgtaaggaggaaggaaggcctcaaaagtactaagggaacaaaaaaagagctagaccaaaccaacatgtttacttccgtttatatgaggtttcgtatagggaaagccaatctatttggacagatgtcagaatgccagtttccttgattgggatggggaaacagctgtttcctgaaaggtaggtacatgagggaagaatctggagattctgcagtattctacagtttaatctcggtggagaatatatgtaaaactttattcggttgcactttttaacatttctgtcttttactttgtgtgtgttttatttaaatttttaaaaaattgaaagggccaaatctgaactcttttaaacaaaaatgaacaaaaacataagaattagtaaatatttgtggaaacatggccttattaacaagaagtataaaatgtgcctgggagagtactatgaaacaagaaatctgttagggaagacagaaggaaatacttaaatttctccaacatagacagcatagattttatgcctattcgtttccctccaaacagagaagatatttaagtcattttgctcacaagagaggctcctaccctccccttggctctttccaccccactgcacccaccaggtgatttgcatattatcccttagtgaagactttccttgtgagtctgagataaaagctcagctctacccttgccttgactgatcaggactcctcagttcaccttctcacaatgaggctccctgctcagctcctggggctgctaatgctctgggtcccaggtaagggtagaagggagatgagggaggagaatggcatggaacggtgagttctggggccccactgcctctaacaacagtgatctctgggggtctcactacactcctatgtgtgttcctttcctgtattggacatgcacatgttgtcctccagagtggggcatgtgatgatcagatctgtgagagtgaggaagattcaagcagaaacaaggatctgtgctctggggaagactgacacagaaaggggatggtgtggggtcttctggagacccctttgagccttggatcccttgagttccattttgaaactgtgtatttttgaaatatgaacaaatacatatatagcctgaaataaacaacaaatcaaaatttatgaaaattacacataaactttatacataaccttgctcttctttctatttatttcaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctcccacagtggtacagccctgaacaaaaacctccctgtggagtggcccagctgcccacatgtggtgcttgtctggggagcagctcagcagggtctcagaatctgtgtaagaggaagatgctggagaaccagggaacaattcacatctgaggactctggactttgagagcccagccacacctcaggcaccactcctttatgccctgccagttgccaccaccttgactgtcataagcagcaggagaatgaggggtccaagtgccctgtgagtaaacaagcaagatggaagggggaggagaatgaaagctcaccctaactctccctaccttgtgtccatttgttaattaaatgtaattagcagagcagccaggccattgacacagattgtgactatccatgttggatacatctttgggtttagcagtttttggcatattgttcagaggacatttgataatatttaatgttggtattttgccagttttctaacttcctgcttccccttttctcccactcccaaaatagagtagagacagcattctataccagttatcctaagcggaagctggctgaggacagtcagtaaaaatcttgattttggagtatcaaatagatttttgtaaattcatagaagatacaagatcctaatgctaaaactgtttagttagccttagttacctcttaatgatagaaaaaaggagtacctgaaattccagaagttgttttcaaaaataaaaagcatatactggaaaatgtagagtatataatttttcccatagaaaactggaaaagtacagaatgatgtgaacgtttttatttccaaatgttaagaatttaagattgggcagacattagggatgaaagcatgaaggaaacccaggagaggtcagcttcaattaaactacccttggcctttggtaggtagggatgtggatggtggtggagttggcagttcatgatgtggacccaggaggcctgatgtgtttcttgtgaagaatcacagagttgaaggcaccactacctggcttcctgggtggagcctgcatcactgcgaattttctgggaaaataatgctttgggaagggttttagatctgtaatcaccaaaggcttagtgaaatccctgtgcaaggagacctgaggtcatgtcactcatatcttgtcaaccccacacagccaaacagagcatctgaaactcattctgtccctagagactgctggttgggtctggagatgtcacaagcactgacatgctgagcagaaggcccagcagggtctacaccagcagggggcgcagtggggatggagaccagtgtccatgattcagacatgtattcgggatacatgtatctgtgtagccttggggattgggggagcatgctgaatctgtggaagttttatgtccttgtagcccagcacctccatccctgcctgctgactcagacctcaacatgtgtcccatggaaagcacgggccacttatagaggctgccctgtgcaacccccaaggctcagctggattctcctttcccaggagagctcctctgcctgtaccaagtcagagcttgtttccacaggcaaacttggcggctatggcagaaggacaaaaagtcaggtgagcatcagctcaacaatgaaaggttctttttactatggaattttagatcattcattccttattccttccactactttctaaagtcatttaattctaactttggtattctattgttttaaatggtttgtaccttttgcagtggttgttttggcctttccacttctatctacattgctgtacctgggaatgaagattcccttcatttttttttaaacacaaataaagttttagaagtgactatgttggtactatttagtcaaaaaaagtaaaacatttttaaacaataaattaatgtattattttcactgtaccttgtcagtacttggacataaacctgattcccacattctaacaatagtgatataaaaaatgtatgctttccatagagtcaatttaaaatagttctctatgaatatttgtgaattagtaatgagcctgtgatttacgtcctatagtgtggtatgactaaagtaaaacaatgttgcaatcaacaggataaagtaatccagatttagattaaagaaatatgttacattcgagataattttctattaaagataatgtattccatgacaagcataattaaatctgtagttttaaccagacagacaacatatacagtaaaaatttggtttatagcaagtggtgtataagacaaaattaataacaagtctccagagtatatttttacacataccaaaaagtaaggacacacatacaatcaaaattttattcatttcttcatcacaggcaccagtttggagcctggagatgctgcacgttctcctgtgagcagaaaactcaccaggaccctgcacagcccgagggcctcaaacgcagcctccctaggaggctcagcctctcagtgcagcaccagcaactgcagcgcccagagatggagtccacagcagatgggctcaggtgaagatggctggagagcctttgaagaggaggtcatgagtcctcacttacaggcatgggctctacttctgtgcgaacagggccagggcccccaggaagcctcccagagcctcttccttcctcccaacttagggtgttcaggccccacagactctccagggagtggctgccatgtcctctctggagcaaccatgaagttccctgctgccctcatggcttcagggatgctcgttcacgtcactgggacgggatcctggtgggtcgtgacctcacctgctgcctctgatgaccttcggggcactttgtcctccctttgccaaatgacctcactctcaccaacactctgaggattgaaagttgtctgcactgcatgatttttgcttttgagcaagtcaaagctcacaggagtctcacacatgcatagcctgtattaatattacacacaattcctattttcacttttcctatcttcttccaattttctctgcacacttacttactctgcccatccactttctcctgtgaagctgctaatgtgggtttttatttccaggctgatgtgatttccttgctgcaatactagacatgtgctcatcacatgcccacatttttaagaataaagtattttgagcacaatttgctcttcttgtacttgtatgtcagggtggcagctcaggggatcggtttgaaaatttatttgctaaaatgcatgaatatttctagaaattcggtgttataaattaaatgtcttcttgcatcccacaacttttgatatgtgttttctttcacttcagattgctttgaaatgtccatctcttggtttcatctttgtcccaggctttatttagtagtatgttacatagttttaaaatattgagatttttttctgatagctttctgtcattgattcctaataaatttcccttggcttctgaaactttattttatatgatttaaatccatttaatttctttgaaataacttgtggcccaaagcatgatctctcttagctaatgttttaaaatggctatggagtctgctgttgtggcagagtgttctctcagtgtcaatcctacccacatggttgatggctttggcaagtcatctgtatctgcatgggcccaagagacactgttgcctacagtgcaggctggagctgctgcagagcccttttctgccctgggtctccactaaaggctgggaagacttccatgtcacctggatggtgacatgaccagtattccacggtgtagaatctgttgcctctagattccaaaaaggccgctgtgagcttccttcatttttttaaataaagactctcatgaaacagaatggaatggaatacatatacctatcatcaggaactctgattctctccaagtttatgaagcacatactatcgtaaccttattgatttgggtaaaccatttaatgccatttgatggcagctatagagctgagtacccagaaatatgagctgcagtgcaataccagctgggagaggtcagcctcccaaccatagccagagtatgaccaggcagtcacaaagagttctccaggaattttctgataattttccttgtgtcagggcagtttctggcctggctttctaatgaggaaggggtaaaagttgacactgtgatgtcctgacttctactgcaccaactcttacccagtccttctgtcaataactcagtaggctacacaagtcaaattctcgataagtatattaaacctggtctaaagtttttatttcttttatggatttgcctattccattaaacattttaatatcttgaatacggttgtgcaaatcatgcctctcagtctctctgcaaatattaatattggggcaaatttaataacagttttctcatgatgtcatattttcttaccagttctgaataagctgaactgtatgtaatgacaaatattataagctagtttgagctcaagacaaattacttttactgaaatttaataccttagcatcaacctggaaacaaaagatgttgctcaagtttaaaggtctattcatgagtatcataaacttgcacatatttgctacagtattccacaggatcaataggttttctgttttaatgtgctaaatatagacactttttgtgcaatcagattttctgggataagcggataacagagattctcatattaggctttaaattctacctaggactgctaggatttcacaatacaaaaagtcattttctaggttgacgatattcttcattttctagggtaagaacattaaataggagtaagagctggtaaagtaagtctctaagacacagtcatatctatagtcctttgttacactttataatttcatgccctgactgcttctaggagattaaaatttattttatttaactttattttattactgatcttgcattcttttcttgctaggatatattttagaaaaacaaatttggagaagtactgaaatttgagcacagttaatgcttcatagcgcatgtgaactttgggtgatcgttgactcctggccaagaaaggaccagtaaaagtgaaatttaccactatgacatgaagctgctgcttccataaggcagagtcaccatttccaggtgtccatgtagaggctgtgcagttattgttattattaccattattgttgttataacaaggaatgaacaccaggtaatttgttcagcccctgcctctttcttattctgaactttagatttttatgaacaggagttgacaggaagaggctaaaagagaatttctgttgattttataaattaagtgatttgattttgtctctgattttttcctgaaggtcttaacatttctgcattcaaaatgtatatgagtattttgttgatcttaaaattaatataaaatgagtaataaatgtcaaaattctcaaattataattttaatttttctgtaggtgaaccatgctctctaaattaaaaagtaagaaacaaatttatttgtcttcttggtatattcatacaaatttttacatcacaggcagtttccactgcagtttaaaaggctcaaattcccgattccgtccccagaatcttcttggggtctccaccctccacctctcaattaaaccaagctttaatataaggtcaaaaagacaactttcatgttcacatggtggaaaaaattaataaccttccaggcaagttgtgattttctagaaacctacttttgaggagtggttttatagagacctactttctataagggtgagaatttcgagggaacttataagatgcagaaggcccagggaggcaatggaattattgtttcgctttttgtattgatgtttggtgaggtgggctctgcagaaagattaacatgcatgaaggaaaactccagcactgaatctcacagctcagtctgttgttttataggacttttttccatttttttttaagcaaaaggaaagacaaataatccaaacgtttagaaacagtttcagatttggcaggttagaacagggtctgaagactcagaaacatgttacatgttgccttccaggtcaaacatgtaaacaactctgttttctccagtttttagagagagaaattctcagaagcacaagatatagacgtacaagaagccttcattccctgagctctctgtgtaccagaatatttatccatgaatctatgccccagtggtgacaattttcagttagtgagataatgcagacagcttcaatctcaggtgtctggagccaggaatctagtcacaggacctgcagcgtcagagactgaagctccctttgtaggtgacttggtctttttttttttttttttttttttttttgagacggagtctcgctctgtcacccagtctggagtatggtggcgccatctccgctcactgtaatctccgcctcccaggttcaagccattctcttgcctcagcctccagagtagctgggactacaggcgcccgccaccacgcctggctaatcttttgtatttgtagtagagacagggtttcaccgtgttagccaggatggtctccatctcctgacctcgtgatccgcccgcctcttacacaggggcaaactctcacttttagtcaggaaaaacctccattgaggtccaggtggagaacaggcctctgtatgtctcaatctcctccagaacagtgtgagtttccctgtttggacaagtacagtcggcagaaaaaagtttacagaatgtgtgacagtgttgtagaaatgagctaaagatggccagtgcaaactgcccctatgtggtgtgtttctaaactgcaggctatttctaaatggcctgtgccacactcaagttttccaatccaatcatttcaaaaacagcccaaagattattttttttttttttttgagaccgagtcttgctctgttgcccaggctagagtgcagttgcacgatctctgctcactgccacctctgcctcccgggttcaagcgattaccctgcctcagcctcctgagtatctgggactacaggcgcctgccaccacacctggctaatttttttgtatatttagtagatatggggtttcaccatgttagccaggatggtctccatctcctgacctcatgatctgcccaccttggcctcccaaagtgctgggattacaggcgtgagccactgcgcccagcccgaaagaagatttttagccattcagagaatgcttgcttttcatatcacaggaaacctcacccacatctgttagcagtaggtaagataagccccaggagatgaaaattgcaaatcactcctgccctctggatatctcagacccagattaagctgttgtctggctacccctagacagagaatgcctttctccaatgttcctttgccttaggatttcccttgttctccaccttttctgagtagcagccccaacatctttcattctagacagtctcctgctgtgagggactcctttgggcaaatctgtcaaagcttcacccaacaacagtcatgtgtgctactgccaccctatggacatctctttctgtttgatcagaacctcaatttttcaaactctctataaacaggaccacactatccaccccacaaacactgactccagcataatggacacaattccacctccgaggctgtcttctcaagtcatacaaataatacacttgccttcaattttatggactgcaaactaacagcatctggcaagtgagatgcaataaaccccacccggatgagtccttcctcattcgactgatcatggtccagattcgagaaatacagaggccgctccacaattgaatcaaatagaggctgttcttctacctttttaactgtgtccagcatggagcgaccagctttgtctgctgttgtgaagcctctgtgtactctatttaaaccttcaggagagaggggttcctctttagaattaagaatattattctctaagtttaataatgtagggtaatttcaaggcctttagtatagggtaatttcagagcctttttatgattgaaacaattttttacaaggttttacattttcagatatgtaatgacaagagattatgagataaaacaaccaatcccaatcgtaaactttttaaagctctgtcattaattttcaaaggaaacagcagtactctctgaaattcagcaccttaaagaatactttgtaaaactaagattttgaagaattgactaatagtaaaagcaagcctgacagatttattactgttattcgttttcccacaatgcaagtttctatataggatagtgggtggaactgattattcagttaacaccttttcagactaatccgtttataccagtgataagatgtaccttaatgttctcttttagattgtgtctttacttttatttttcttttcagcatctgatgtttctgactcttttaactattatgatgaattaggagtttgacatttccaaggctaagaaccatatttgacctgctcagcatcacaagaaaaaagaagtcaatgccaggcaccgtggctcactcctgtaatcccagcactttcagaggccaaggcaggtggatcgcttgaggccaggagttcgagacaagcctggccgacatgtggaaacctcgtctctactaaaaatacagaaattagttgggcatggtggagaatgcctgtagtcccatctactccaaagacatgagaactgcttgaacccaggaggcagaggttgctgtgagcagagattgcaccactacactccagcctgagtaacagacagagactgtctcaagaaaaaaaaaaagtgaaacacataagatttacaaaaagtgatgaaagaatagaataaataaaaatttaaatagtgaaatatgatacatttattctaatcctacttccacactacaatttgatattctcaatttaggttactgccatgacgttcaacgttttaaggtcaatatcatttttactcaatttttttcaccaactttgttaaaacatcatatgccagtgcatttcccggaagataatcaggacaagctttgtgtgcaaaacacctagagctctgttttgcttttctgggtgtgtgttctttaccaagtaaatcagatgttgtattaaatcactgaagattacatagcactagaaactattcttttaattgctcccaggatttttgttgtttttttcaggacagtggcagtctctgtgaagtgatttgatgtacgcaccgttattcaggagcagctaaattcaatattaagcacatcactgacaaatgaagaatactcaagttgttttcctattgtaacgatgagttgtgtggtagattcatatgcctgacctgtgatcatctttcaataaaaacctaggaaaatgtcgtccatagtactgctgaccctgagacttaaaaccagggatccagttcttgctcttcctacatagagaatctcattttgaactgtggtgtcatggctgtggctgtgccacatacaggccagggggagacaagggttcaccctcagagttgacaagaatttggaagccctgacatcctataaaacgttacttgcccaagattgaaactttcaaattcaggtccttcttcctcctctatgatgaattaggttttattagtttcctccaagggacactttatatcacattgctcacagagaagacatatctacccccttcaccccccacccaatggctctttccacaccactgcacccaccaggtgatttgcatattgtcccctagggaggaccttcccttgtgagcctgagataaaagctcagctctaaccttgccttgactgatcaggacttctcagttcatcttctcaccatgaggctccctgctcagctcctggggctgctaatgctctggatccctggtaaggatggaaggagatgagggaggaggagggggtgggaggctgagctctggcggccccactgattcccgtgtttattctaaccatgtgttaaaggaatatgccctatgctccagggagaggaattcatattttgccctgatgatgatttgaaaactcctaaaagcagtgctctgaataatatcttgagaaatgaaagaactcttgtgcctatttaataaagggttcatttaaaattttgtttttatgatatgaatacaaatttgtaaaaataaaagattagccataaatcaatatcataaggcaaatctcaaaagttgttcattatgctttcacataaccttgcacttctctctcataatttcaggatccagtgcggatattgtgatgacccagactccactctctctgtccgtcacccctggacagccggcctccatctcctgcaagtctagtcagagcctcctgcatagtgatggaaagacctatttgtattggtacctgcagaagccaggccagtctccacagctcctgatctatgaagtttccagccggttctctggagtgccagataggttcagtggcagcgggtcagggacagatttcacactgaaaatcagccgggtggaggctgaggatgttggggtttattactgaatgcaaggtatacaccttcctcccacagtggtacagaccaatacagaaacctccctgctggggtgtcccagctgctcacttgcactgcttgtctggggagtagctcagcagggactctgagtctgcagaagaggagactgttggagaactcaggggcagggcttgctgttgaggactctggcccatgagagtctcagcagcacctcagtcccacatggtcaaagctttatcagttgccaggctcatcctcaccctgcctgtcttgcccacgtttgccgagtacactcaatcagcataacagccagaacatagatgcagtttagtgacaacacaggtggaatacatgtggcaaatgaccagcttggggtttattttacacaaattaatacttggtgataatatttggaattattgcgaatttggtattttcccactttccttactttctatttcactttactactcacactaaactgcactttccagtgtcatgtgggagaacgtgttctatacaagctgtcctcagggggagtatggataagaataattagaaaaaaaatgtttgatttctgactattcttagactttgtaaatccatggcagatataaatcttaatgccaaaagattttgatttgcctcaattacgtttttcccagtgaagagggagttcttgcaactccaaaagtgagcttcagaaataagcagcactggccgggtacagtggctcacgcctgtcattccagcactttgggaggccgaggtggatggatcacctgaggtcaggagttcgagaccagcctgaccaacatggtgaaacccggtctctactgaaaatacaaaattagccagggcgtggtggcacacacctgtaatcccggctagttgggaggccgatgcaggaaaatcacttgaacctgggaggtggaggttgcagtgagctggagatagtgccactgcactccagcctgggctacaaggcgaaattctgtcaaaaaaaaaaaaaaaaaaagcagcataaactgaaagatgaaaaacacagagtttactaaatatgccacaggaaaaatgcagaattatatgagaggtttttttttttcctcaaccaaattctaattgtaaaagtatttattctaagtactattttagggatgataaatttagtactatgtcatcataataaaaggtttcaaatgttacaaaaatgtattatttacttatgataacatcattaccagaaaatgaatctggatcatatgttttagttgtaaaaacatagaaaatttattatttcaatagattccatgtaaaatagtgttctagtgttataatattctatcaagctcaatgatgagctatgtcagttacatattacaatattgtgtgatagacacaaaatgattgaagcaacagaacaagaagctcctgcttcagatttaaggtttaaagtatatttgagatgattttctactctaagataatggatttcatggcaagtgcaattaaaattccgaagcgccatttctgttgggtttagtagacattgcaatatttatatagaaatcaagcagactgaaactgtgaaaataagaaacataagacacttaatacactgtttaaaatgctaattaattcatcatggagcttaaaagttattacagaatgcagggagagaagacaagcgtaagtagcaagggcaggaactaaccactgtcatcaccatctttggccatcaagtgattgacagcacctagtgacctaagattctgctttgatgtgagacaggggaaaaggcccaaaccactcaaggtggttggacacctttaaaaaccaaacaaacatacagcctacatggtgctgatacctcaaggggcgatactctcaagtcaaaatggtgaaaaataaatgattccaaatacggaaagggatacaaagagaatcagagcataatcaaatgtattacaaagaagcttcaaaatatggtggactgaatgtgacaaggtttctctgtctgtgccatggcagtgtagaggcaggcaggtggccttggtggtgtcggtggctctgctccatgaggtcactcaggtgggcaggaaccacgaccaccctcagcgcacagccctcctccttcctcacagtctctgcccccacggccatcctcagcagcatgaggtggagcagagtgaagggaaagctgttttcttctaaaggccaaagaaaactccagttttccaccagggataaatgttcttttgtgtaaagcacaggtttgtgaaatttttcaccaagtgaatcttgtgagaaactcacactttttgttgtttttaatctgaaaatgtatttacatgattcctggaaataatttttttgaatatgtgattatattgtggcagtctacctgaagttgtcatttaccattgagaattactgctaaaaagtcatttgataaaaaaagactcatctgtgacagacagtcctcctttggaaggactctgtctttttatccctttatacccattttaagccctttgatggcctttgggtttttcttaaacaatcaatgtattaagtttaattcattatttatgtttaataattaattttcaatgtgcacatgtaccctaaaacttaaagtataataataaaaaaaagaaaaaaaattaattttcactagcacaaagtcaaaaatcctgaacgttgctatgtcaaagacctgcctctagatggcaaacaaaccccacaataaaccaaagagattgccatgatctaaaaatattacttgcattgtaagggtgatgatgtctgcttatcaacatggagcccctaaggctgaaatggggtctcatgtgtgacctggagcacccaggaggagcttccagcgtgctgtcttgtggggaaacccctctttgctctgtgatctgagaatgcaagcctggccctattccccttatgcagctgtaggagatgattgaggtaattgaggctaaatgaggtcaaaaggatgggaccatgatccaatagaattaatgttcttataagaatagaaaccagagagctctccttttctctctctctctctcctccctcttgcccctaactcaactttctacccacggtggctatctccaaaccaggaagaaggtccttaccagaaagtgaaccttgttggactttgatcttgcaatttccagccaccagaaatataaaaattaatttctgcagtttaagttgtccagccatatccattttggtgttggagtcccagtggactactacaccatccttgccagctccaagcagaataggcctccagaggctccccatggacatgggcacccagctttgttcctgttcctcctgctgttctgattctctagtgaggaaggcagatgcaggcttcatcctatttgtctgcattttctactagaatgtctccttgaagatgaagtggttagcctgttttgctttctgatcagaacttcatcaaactgaatgaactacttgtttggtattaatacttggggatgttcatgtttgtttccgacatagatgccagtgggtatgttgtgtgcactccatctcttaccccttttcctatgtccccagagagaaggccactgtcatctgtagggccggccagagtgttaagagcgttctatttttgcttggctcccgcagaaaacaggcccagctctgagctcctgttggctcctggttctctgtggatgcaacacctgcccgggtcagggttcaactgcctggacagatatcactctggccatcagcagtgaagctgatcaaggaaccccattgtgaacagggttccagcagctgtgtgagtcgtgaaagctgggccgataggtcccacatggctccagtcagaggggaggctgccaataggctgtggagggctttcatcctgtgaccacacagccactgacctcatgtgctgctctgtctgacaggatcccctatgggaaggacctgcccacaggaagctctgggcaccaaatgttcctccaccgcctagctccaccgcctgtctccctggcacctgctgctctgtgttcctcagacccgctctggtcactcaaagttctcagcaatgagcaggtcagtgctcagccctgcagggacatggaggtaaagcctgagtttcctcactctcgggctctgcagtggggaaggagccatggagtggtgcacccattgctggttttaaatgttcctgctcaatttatcacaatttaaagtcatgcattataacaacaaagttatatttatttctgtataaatacatatattacattgatttataatatagatgcaaaatttaagaagatacttactttcagaataaaaaagtgaataaaatgtcacacatcaggattgatatgcccaccaaggctttgacttgtcttggtgcatgattgaattaggatctaatagaaggaggcagagaagaaggttagaaatggactgttattccttaggttctcttaagggggtggaggccaaataattcacgggttgtcagaaaataccccagggctctttctcagttgcctggtaacaaactggctgaagtttggtgcttcttttccctggaaagaggtgctatgattttccatagcttccaggttgccaggagctgaatgcctggcatatccaggccttcctcaaaaagctggttcctgagctcagagtgcttggggcctgcacataatattccttccctgtgctgatggatagctctaggctaggagaagccaggggagaaggagaggctggtgtggggctagagaagtgaacatttctctctgcttattgttttgtatttttagtatattttccattcaatgtgttatacatatcgtatgtgcacaattatgtttattttatgtaaatatcatcctgtgaaatatgtcattatgctcactgtttttctactgagatgtatgagttaaaatatttcagtgttgttaagggtgaaacttgtctattacttctcattgctgcctgatgatccagtcaagatgtcaactacatttaacctatgttcctggtaatagatacccagattgtctctaactcctcatctttagaaataatgatacaaaagcctcgtggatatctccttagttgtcttctaagaggtgtgtgtgttttggattgcggggattatttggaaaattacatggagcaaaactgatggttcataagaaaatatttagttgacttgagcagtgccagaattttctttggaaggcttacattgacagatgttaaagctggaaacttttaaatcaaattatacctcttttactctcagaaagagacaggtttaataacaaaattgcacaaagatcaaaagattagcatcctgctttagaaatctttaatctccttcttcaagtgaatgaagctttcctgcagagcaaaacaaattatctcacatttaacaatggaagaatatgtgacacatttaaagtccccttcagctgcaagagcctcggcagggcagaacaacagcagaaaggaggatgcagtgggctctgagccacatcttgccagaggaaaggctcaatgaaagctcatcttgattctttctgccggtgtgcagatgcctaacaaatacaggtagcagaacagccagaaaactcaggccgctttgtagcaaaacaagttgaatacacatgcacacatttaaccaaaattggattgatttcacttgcataattgtcagtgtggagcctagagacagtgcacagactcctgtgagcaggacactcactggggccctgcacagtgtgaaggccccaaacacaaaccttccaaaaaggctcagcctctcagtgtggcaggagcagctgtggtgcccagaggatgcatccacaccaaactcaggtggaggtggctggagagcctttgagttaaggaggccatgaggcctcagtaaggggcacgggctcttcttctgtatgaatgggggccagggcttttacagattttgaataaggctattttaagatcccaaggaagaataaaagaccaaactaaataacttctgttgatttccaaaattaacaaaagtattttttcaaccatttaattccataccaagttaccacaaatccaaaatacagaacatgaaagagccacgggctgaatgaattattcagtggccattcttagtcttaaataataacacaagctctgcactagcaggtggaaatggtgaattgcctctaatgtggtagcagtagcatagtaataaacttcacttttggaatcagggaaatgtgagactgggtaatttataaaggaaaggtgttcaattggcttacagttctgcaggctgtgcacacatggtgtgggcatctgcttggcttctggggaggcctgagggaggttttacttatgacagaaggtgaagcaggagcaggcatatcccatggcttaagtgggaacaaggcaggtggggagtggcgtgaggtaccacatgtgtttaaacaaccagatctcacaaagtactcatcatcatgacagtactaaaccatgagggatgcacccccatgacccccaaacctcccaccaggccccatcttcaacattgggaattatatttcaacatgagatttgagtgggataaatatccaaaccatgtcaacatctatcttggcttttcttggccgagagagaataatccaaagtttaagtgctccttgaaggacaattggcctcaccttttagtaattttagaaatgtacatgttagctcttctaaaattacccttatgccaaccaaaaaatgaaatattagtagtaaatgacaattaaatagaatagaataaaataaataattttgttttccctagaacagtcgtctgatgaaatcacaaagtttacaaatagctggaggctaggatgacttgttagttacttatttaggcagctcttacacatgtttcctattcttgctttggaaactagtgaactccaaaactcaaagattatttgattcttgcgtaggatggaatatagcagccctagaagaaatttaaacccaattatgggaatttatattaaacaacttactggggagctcgactgcaccaaaattatctaagacaaaagaaaaagaagaaacctgctgattaacttgttaaattaaaggaaatatttactgggaaattatattcttgagtatgcttccaaaaaagagcaagcttttatagctggcatgtggttttgagatttaataaaggtaatttgcttggaatagaaattaattcttaatagtggtcagaatagcagctcaacaatgtaaaaaccttataaacacccagggaagctgtggttttttggagaccttatttcagggacagaggtccctttctttaagggtcagaactgagaaggaatcttagagggaataaagaatgtaagggacacagaatgcttagggatgcaacaaaatcactgcctcactttgtgcagtctgatgggggtgagatgggccccacagaaagatgaacatgcacggaggaaaagcatccctggaagcacaggactccactagctaatctcatatctcagtgtatactttatatcattttttttctgtttttttctaagaaagaggacaatcaattgaaacatttggaaacaggctcagattaggctgatcaagaacagggtctgaagattcagaaaggtcaaatatgtaaatatccctgtgtctcccagtgtttagagagattctcagaagcagaagatacctatccacagagccctcattccctgtgttctctgtgtacctggatatttatccatgaatctgtgctccagttggtcacaattttcagtcgatgagataatgcagacaacttcaatctcacgtgccctggaagccagaaatccagcgcagaggacctgcagcttcacaaagtgaagctccctctgtgggtggcttggtctcagttctcaccaaggacaaactttcaactttaataaaacatttaaaaacctccattgaggtccaggtggggaaaagactgcagcgtgtcttcagtctcatccatagcagtgtggattttgtctatctgcactaatatagtctttagaacaaagtctacaaaatgtgcaacaatgatgtataagtgagccaaaggtgtcttgtgtgaactgcccatatgttgtttgtttccaaattgcagcttatttctctatggcctgtgccaaactcaaactttacaatcctatcatttcaaaaacagccccccaaagcagattttttgccatgtaaagaatgcttacattatgtatctcagagaaccttgctcacatctgctagaaataggtaagccccaggttatgaaaaccccagactaatatttccctctggttctctctgacctagagactccccactgtgctgctgtattgggaaaagctgagtgttgggagaagctgaggcagggcttgcatgtctgacataatgtaaaacagtcttggaacatgtctggggtccagggtctaaaacccattgtggcgtttggaacaccaagctctgtgctataaagggtggaaggctaccctgacacactgtaatctaagcccagggcataaaatccctcgtggcttggatagaatccagggttcatggctctggaatgtgtctacacttgctggctccttgctccttgctctcccaggttcgattgtatcttgagttaaaggaacctgctctccattatctcaagtagcagagcgaatgctaaaccatcacagctataaatcttgtgcctaatgcaacgtgcccttttgacctccacattctcaccacctttttctttgttggataaccaataaatagcactgggctcccagagctcggggccttcgcagcctccatgatcacgatggccccctggtcccactttacttctcaaactgtcttttctcaatcctttgactccaccagacttggtcatccccatgacctggtgttgggtctgatcaccccaacactgctgtgtgacaacacctagacacataagccccttatacagcaaatttcttcctcccccccttctgaataacaaccttggccccttggcctatagacagactcctgctctcaggaactaccggcaaacctgtcaaagcttcacccaataaaagttgtgtgtgctactgccatcctgtggacatctctttttctttgcccaggctccaaagtcctcaaatgatgtacaaacaacaggatcacactctccatccaaccccacaaacactgacttccaaggacacaaacacttccatttccatgattatcttcccatgtcatacaagtaatacacttacttccaattttatgggctccgatctcacagcatcaggcaaaggagacacaactacagtaagatccacctgtatcagtccttcctcattcagatgaccatggttcagattagagacacacagaggcctgcttcccacctggatcaaatggagactgttcttacaccttcttacctgtgtccactgtggagccaccagcttcatccattgttatcaaagccttggcataatgtgttaatgtttgggagacagagatttctatttggaattagaaatattattatttaagtacataggtagtatagggtagcttcaaaacttttttttgcaccaaataatttttataagattttacattttctgaatacgtaagggcaacagattctgaagtaaattaccaaatacaatggcagactccttaaagctttgttgttaattttcatagcgaatagcaatactctctgaaattcaaaaatattaaagaatattttgtaaaaataacatattcttgaattgccttgcaaaagaaagcacgaaagattttttatcatttgtcattttctctcaattcaagcatccatattagatggtagatagaactgatccttcatttaacatactttcagagtaatcctttaaaaccagacataatgcattcaatagtgttcttttttgttagtatgttaagtttagtttgcatttattattttttctttccacctaccaatatttctgaatcctttcactagcatgattaattaagagtctgaaattttcaagactaagaacctgcattgaattggtcaacatcatgggataaaaaagttaaatacacaaaacttacaaaattaaataaaagaaaataataaatattttaaagactggaatataagacttttattgtactcctacctcctcatgataatttgtggtcatcaactcagaatattaacatggagttcgacatttaagatcatttttactcaattactttttccaatcttgttaaaaagtcttattttggtagatttcccaaaagatatgcagaccaagctttcttgtgggatcatacttagaactgcatttgtttgtgttttttaccaagtaagcatgactttgggttaaattacccgagattacatagtactgcaatctattacgttggctctccccagatgttttctctccaggacagtgcgtgtccttgtgaagggatctgatgtaggcacaatctttcaagagctgttcaactcaatcttgagcatatcattgacaaacaaatagttggattgtttccctgttttcatgatcagctgtgtggtagattgacatctctgagctgtgatcgtctttacatgaaagctcaggaaaatgccagtcatgggtaatggtgaccatgagacagtaaagctgtggatccagttcgtgctcttcttacatagagaatttccactcgaattgtgaactcatggctgtggctgcaccacttacaggcccaggggacactcagatctcacttggtagttgacgaaaaactggaagtcctgataggacctcattccacatgatgaggaagactgtgggaagagcttttgttaacaccattcagaaaaacatagtgcaaagttagtttttgttctttctatataattatcctagaaaagtcttcccttaataaatccttctggttaatctggcatatgtgagatgattatgatgggatatataccagattgaacaattggtcaccaggaattttatattcactgcctgaggaataaattgtttcccactttcctcttacctgcactgggctcttgaatctaaatatagagacccacattattttccctatgaggcccttggacagagcgctcttatggggctcactcaccaggtgccaggggagggtagattccaacacttgctatgaacattcttgaacagttatcctggaaaccgcagataccagaccactcttgaactggctcaagactatgttttatttgtaggctgtctgctcatcagtgcttgtaggaaagggtaacgtttccttttttagattagctgggagggagccaagaagaatggcattcatccatattcattctagacatatctctacattgttagggttgttatgctttcctagagttgcatatcctatacaatgggacctacccaagatccaaactgtcacagtcagatccttcctcccattttatatcacattgctcacaggagagacatatcccctgcccgcctgccccattgactctttccacaccactgcatgcaccaggggatttgcatattgtcccacagggaggaccttcccttgtgagtctgagataaaagctcagctgtaactgtgccttgactgatcaggactcctcagttcaccttctcacaatgaggctccctgctcagctcctggggctgctaatgctctgggtctctggtaagaaaagaaggagatgaggaaggagaatagggtgggagggtgagctctagggctccacagcatcccatgatcccatgtttagtcttaccctgtgttagaggagtataatctgtgctgtagaaaagggaacttgatattttgctctgtgaataattagaagcctcataagaaatatgacgtctggtgctctgattaagatcttcaaaatataaaggtctcttatactttacaaaaattgaattcattttagaatgtgtatttttatggcataaatcactattttttaaaattaagtttaaataaatgacataagataaattatgaaaattgctcattaggtttgtacataactttgcaattcattatttcaggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcccacagtggtacaacccctaacagaaacctcctcctggggttgcctagttgctcacatgtgctgcttgtctggagagcagctcagcagggtctctgagtctgcagaagaggaggctgttggagacctcagggcagaggttgctgctgaggactctggctcatgatagcctcagctgtacttcagtcccacatgttaaggccccattaggtgaaaaataaatgattccaaaaactgagatgaaataccaaggagaatcagagtacaattaaggctgttacaaagaagcctcaaaatatggtggactaaatgtgacatggtttctgtgtctgttgcctgacagtgcagaggcaggtgggtggctttggtggtgtcggtggctcttctccaagaggtcactcagatgggcaggagacacgaccaccctcagacacagccttcctccttcctcagagtcacttgcccccatgcccatcctcgacagcatgaagtggaacgactagagagaaagctgttttcttctaaagaccaaagaaatctagagtttcccatcagggataaatgttcttttactttaagcacgcattggagaaattttccattcagtggatctgctgataaacccactttgttttgtttgtttgttttgttgtgttttcagatggagtctctctctgtcacccaggctagagcgcagtgacatgatctcggctcactgcaaactgcctcctgggttcaagagattctcatgcctcagcctccggagcagctgggattacaggcacccaccaccattccaggctaatttttgtatttttagtagagacagggtttcaccatgttggccagggtggtgtcgaactcctgatctgaagcgatccacctgccttagcctcccaaagtgctgggattataggcgtgagccactgcacctggcagttatttgctcttatatgataatgtaaaattattttagaaaataattttttgagtatatagttatgtttgtggcagcctatttgaatttatcatttgataatttctactaaaatgtctttgttataaaagtcatatgactttaattgtcctcttctgaaaagaatatggttttttatcctctcaggctccttttaggacattcagttaatctcattttcatacaatatattaattttagtttattatttctgataaatttattaagtaattttcactataacaaaattaaaaatcccataaattgctatgtcaataacctgtctctgggtgtaaacacactccacaataaacaataaagaacaccaaggtcttagaaacactgggaaaataagactgatagtgtcccattatcaatgggaagtccctaaatctagaacggtgtctcatgtgtgacctgggacatctgggatgagctgccagtgtgctgagttgtggggaacctgctctgtgcttggaggctgaaagcatatcctttccctccctactgccttacctgtgtccacctgctgtggtctaaattgtgttcccacattcatgttgaaggtctaatctccaacgtggctgtaggagataggacctataagaatataatggaagttataagggtggggccctgatccaataggattagtggttctcataagatccagagatctctctttttcctctctctctaactcccacactcttatggaaagaccatatgaaagcatggtgagaaggtagcatctacaaaccaggaagaaggtctttaccagaaagtgaaccctgctggaccttgatgttggacttcccagccatcagaaatgtgaaaataaatgtctatggttcaagccacccacccagagtattttggtgttgcagtgaaagaagactcattcactatccccaccctctctgagcaggatcagcatcaagaaatatctcatggatgtggggacccagctttgctcctattcctcctgctgttctctctcttgaggaagaagggagggttcaggcttcatcttcagtttgtttgcaataaacaggaatgtttccttgacaatcagttaattagcctgttttattttctgaatagaatttaaccaaactgaacaaactacatgcttggtattaatatttggggtgttcatgtttattccacatttagatggacagtctctagcccctcttcatgtgtactagtagagagggtcactgtcacctgcagggccagccatagtctcaacaatgttctagcctggcaccagcagaagccacagctggctctgagcttctgctggctcctgctgcctactctacacaatgcctgttgggtcaggggtgatgggcttggacagagttcactcgggccatcagcagctgagctgccttcatggcgtctcgttttgtgaagaggatgtcagcagccacatgagccatgatagctgggcagagagatcccacatcactctagtcagaggagaagctgccaattgtcaagtggaagggttttgtcctgtgaccctgtgactacacagccactgagtcacatgtgctgctgtgtctgagaagagcccccaggggaggaactgtctactcggagatctgggaacaaaacttctctccaatcagggcccagacccactgcccatctcccagccacctgctgattgtgttccccacaccccccttgggtcttgggggctctctgtcctgctcaacagggacatggggaaaggtcctgagcttcctgaccttcaggaagtcaggaaggatcatgtttatggtgtgctattgctggttttaaatgttcatgctcaatttatcaaatttgaaatcataccttataccaacagttatatctatttctatataaatatacatattatgtagatgtataatatagatacatattatatacagatacatcaataatttatatccataatattatatctatttaatttaaaagtttacacagtatgtccatatattcattatttttgtagcatgtgttccttttatttctaagcagaacagaggctcgctgagtaaagtctgtggacatttgttgactctccctctttggctccaacagggtcctggtgtctcaggaccagtgaggacagagctgaggacagccagccccaggagcccaggcccagccctaaggctctggtctcagagactttcatcctgacctcgggcactgggcttggtgtggcacccgtgggtgtgtgagcagtttccttctctgaagccccattccatgcagccccgtggatagggcctgtggttccccccaggtcctcagccccatggttcaggagagaagctgctactgccacagaccagggccagtgaccggcagcttgggtaatgcaaacattagtcctggactgaggaccctatgccaaatatctcccccatttattccagtacctgaaagtctgtcctggtcttaattgcacaggccacatttccttaactagtgaagccagcattggcaactgaaaaactagaaatttgacttcattgtcatcctcagggtctggcccactccaatcccaccacataaagaggcccttgaactttctctttcccatgcaacttaacttagacacatagtgaaatataaacatcgcaaaactcttggcacctacacagcagccatcccctctccttgggcgtataagggaccagcttcgtcctgctgcacatggcaaggacaatgaagaggagcagggagtggggcacatgagctccacaatgagatgtcagaggtgagcagcacttcagggaaggactttgatccctcataaaggcatagaaggtgaagagctttgtcctgcatttttttcctgaaacaggtatgcgtgcacattgatacttggaggcactgcagccctcctaagatcatgaggctttgaacccaagactgaaaaactgaagtgcaaagaagaaatgtagcaaaaacctgggtccttttgctgtcaccaagttgctgcaccaacctcaaatgttccaaacttcagaattcttatctctgcttcagctattgctatcatttcttgcaattgcttctaaaattattttaacttatccagaaaaaatattcaagggaaagagactgactgggttcttatttgtgtttatgggagtctaagacacaaaaaaaacaggaaatcagaaaaagtgatgtcttctcctaacatctttgtcattctatgcccatggttagagaaatccaaaccactttgaagaatgtataaattctgctctcttcctgtctccatttctctttttatatcttaagcataaaacagctccttgttcttcttaatgtctccatccttcaagatcatagaaacagaatcatggttaagaaactggaaaaaacagttggagaaaacatgaaatctagggtttgtatgcatttcctctacactaatgtggtgtttgcagggttcctctccttctcagttgtttttgctgaagatgccgactgttccagccagattcctgtcagaggttgtgtttggagggtttaaaagaaaagcttccaggggcttagggctgaattccaaaaaggatagccggagagtggctctggattcccagcaaggagaatgccagattgagtcttgggaaaggctatggacatactggatcccaggcagagacttgtagcagggagaaagcctccacagaaaatccctgctagggcaatatctagtagagccatgaaagtgaggcagcctgggagaccacagaattgtagggccagcagcatgcaactccagcctgggaaagatgcaggcacaagactccaacccatgaaggcttctgggtgaagtgagcccagtaaaaccatagaggtggggctgcctgaggcattggtaaaccaactcccaccccagattgccccagatatgagatttgaagtcaaagattattctccacctttaagacttaatgtttttcctgttgggttttgggcttacttgggaccagttaaccctttctttttacctatctctcttttttggaatgagaatgtttatcttatgcctgccccaccattgtacagttgtccctcagtttccatggagaattggttccagggtcctccacaaataccataatttgtggacattcaagtcctgcagtcagctctgaagaacctgcaaatatgaaaagtataccctctgcatctgtggattctgcatctgctgaatactctattttcaatccatggttgttgaatctgtggatgtaaaacccatgggtagggagggctaattgtattttggaagcatgtaacttgataattcacaggcttatagctggaattaatttgcctgggataaatagtgcctcgaatctcacccatatgtgattcagatgaggctctggactttggacttttgagttgatgctggaccaaattgagactttaggtgctattgggataaaatgaatgtgtttttcatgtgaaaaggacatgaactggagagagtagggtggaatgctgtgatttgaatgtatcctcctcagttcatttgttagaaatttactccccagtgcagccatgttgagaagtggaaactttaagaggtaattaggtcactagagctttgccctcatgaatggttaatgtcatcatgatgggggtgagtttgttatagtgagagtgggttacttataaaaacaagtttgaccccttcttgctcttactcactctgtcttgcctttccaccatggagatgcagccagaaggaccttaccagataactgcaccttggtattggactttcccacctccagaactgtgagaaatagatttctaactgaaaagataaatcacccagtttcaaatattctgttataacagcacagactgaaacaaatatgttactgtcattatttattttcagagtcaacattcccctattttgtccaaggggagccccattcaagctagttcctaatacctttttctcttaccccatcattttctgagcacttccttagtttctgacacaagaagtgcaggcttatcttatattttttctgctctaaacctgatatcagatatttttccagtaattattctttttaatagagattgatattcaataaaacaagatttgagcactcaaggtgtttattgagacttgtgtgttactgcttctaggaaaaattacctgtctatctgcatatgttttaatctatatccgtataaaactatccaaaaaattaatgaatctacattaatgtctctaattacaatccaaatctacagtttctccttttttatatttgtagcttttttccaaactgagaatcttggctgtaattattcataccatatttacttaaatgatcaaacattttgtgtgacaccaatctcccactgtccctgtcacctaaactttccttgtggacaacttccctcttatgcctcacacaccttcattagtcttgatactccgtgccagtccaccatgaactttgcatctctgcatagctgccctttcccccccgggctctgacattagcaacagtgtcctccacccttgtgactgtcctgctcatcctcatccagctgtgatgtcctgcataagtgggaggaggggtcttgcatcctgcacacccaggtagggatacttgtctctgctaactatagcttcaacgcccaggtgggctttcctctacaccccacaacacgggtgcactttctatactgtgtaggctcagtatctcatacaattccctggctttttgttgcatagttttctttctgaacctgctcggatcaagtgccctaaacccagtcactaagaactgttttctcttaggagctggaagagattggtgatttggaaatatgcaggtataagaaacagagtagtcacagggatagagggtgacaacttggtttagaggacacctcagcttctgaaggggaatggcttggataagagaaataaaaggcataaataaaattcagggagcacagggaaatatctagcatgagactgtaggatggcatacagagctagaatatagctgagaactttcagaagtaaagggagaaaatttatcatgttggctggcccagctgaaagaggtaggaaagaacattcagatatggaggataacaattatgtgtctggagatgggagattagctatgccagatagccagtggcaggacccttccttgctgtggcactattttcaagtattaggttttttttaagttttttatttcttttttaatgagcaaatctatctatctatctatctatctatctatctatctatctatctatctatctatcattcatgattataccttaatgcatccattgttggtagcactgacaatttacagcactggtggttccagggaattggaccaaaaaggaagtctctctgaccttaatagtactcatctgtatcaaatgcaggaaacttctaaaatgtcttgagtttctagagatgtttttccctagcagaccttgtcataaatagaaagctagcaagagaagcatgtcatgaaacatgaagagagcaaaagaacactccacatataggacagtaggctgattctgtcctgtagcctgcagggagaaacacatgctctgcagactttggacacctgggaggcactgggcctgtgcagtgttattgagataagacatctttgcagctgtgcagatttgcatgtcccacagagcaacgcctactgccctgaacatttatcaataggctggtgacatcctgtgcagaagtctctctcagtcaggacacagcatggacatgagggtccctgctcagctcctgggactcctgctgctctggctcccaggtaaggagggaaacaacaaaaattttattcagccagtgtagccactaatgcctggcacttcaggaaattcttcttagaacattactaatcatgtggatatgtgtttttatgttcctaatatcagataccagatgtgacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgcccctcccactgtgatacaagcccgaacataaaccatggagggaagtagatgtgtgaggctgggctgccccagctgctcctcctggtgccgccctctgctgacagcagttctcagatgcagccaaggtttgaagctccctgggaagttttggtagaaggggtcagggaggcacatttacattctatctctctttatcctcagctccatcagctgatatgcaagtatctctcctgattattattaataaaggacaaagaaaattaaacctaggaggtctagattgcagcaaaagtcagacttatacagaaaaggagaaggtactctacatatttttaaagaattttttttgatacaggggattagagtctaaattatgacctttcaaagatcagacataagtacatacacatataagtatgttcagccaacaacatatcagataaacatattgcacctatatgtatactgtaaacatttatgctccgatcccaccttcttccaacactacccagatcaagatccacactcttcccagcatctcaaatatctccccagtttacttccctgtcaattccgtgttccatctatcatcatcctaggcttccactgtattttatatcaatatttattaatttttcctatacttaagctttatataatttcaatcatacagtatttactctttgacgtcttgcttattttggtcaaaatatttttgagcttcatctgcgttgtttctctggcagtaatttgtgcctttttattgaggaacaattttccatgaatatgccaaaatatattcatttttcaactaattatttgtttttggtttaagaatattactggtaaaaaccttaagaacattcttgtgcttgtcttttgtgaacttatgcactcatttctcttgggaatattcctaagaatggaagtgttgagttataaagttagcatagaatttgtcttagtaaacattgacaatagtttactgaaatgctgaacatgtttacatgaaaccaaccacgtcctaaaagtctcaattgctgtcaatctttttcagtactcagtactgtcaaacttttattatatctagggtggaggccaaagcaaccccatcttggatgctaattttccatgtctgacttctgattaacctgagttctgggacggtctctaagattttcagtttatctattttatcttatttaagagcaagtacttagcataaatcctgcccttaaacaaccttgatgtaatcattctttgattgtcgtacacatcctttctgaatcactggtctcctatggtatacaagccctatttgagaggggtcatggcaagtgattgaccatcttatctgcctactgtcagagacacagacacggcttctgtttttaagtctctattaaatgtttctttctgagaaactggatgtgtcagcctctttcttcagcctttcagcttcctcaggcattggggtcaagtttgcatagatctaccctgtcatgtgcgctccaaggtcagagttaaccaggcccatgcgtgtttatgtctttccacaatgtcagacttttactgatgctatttccaacacagaagctgcaagctacatggagctcccaaggagccattcgattgtcagtgttgcgggcacacaggctaaaaccattgcacaagccggtcaatattgcaaaccatacataatagtattcttaatcaatacataaacattataagttaaagtttacacaatgcaacatttaacaccaaaagaaaaaaaataggagaaagagttatcaaatcaatccaggggtagtgaagaagacaaaaagaatcctggtctggcctgaaggtcccttggtccttgcaaggaagagtctctgatgtgtcagagccttcttaggcagatgaggagttcttatcacaaatgacaacgggatggttgtgaattaagatggcccttttgagatactgacagcccgcactttcatggtcacagagtcctctggtgagaactcatagtgcaagactgtgcttgcttgtgaccttatctggttggatgcagcctttattttttttattttgtaggcaaaacattttattcttgttggcaagctgccctatgaaacatataatgcagtctttatctgagatggagtcaattatgtcaaagttccactatacatatccaacacaaaacatctgtactgataaatctgaagttgtatcatgattaaaatttatacttccttaataggtaatgatcttgagtcacttttcatatatttattttcattggctgtttgcatatctttagggaagttcctgttcaaatcgtgtgtgtgagtgtctgtgtgtgtaatgttatattaatcatacacattgatgcgattagaagttcttaattataatgtaatctaatttgtcattttacttgtcatttttttctcctgtgtttgttttgtgtatttacgtgtgtcctctgtttaataaatttttaccaccaaagggcttaaagatatgctcctatgctttcttgaagaagcatcgttattttacctctcacatataggctacagtctatctctaattcatgttttttgcctggggtgaggtggatcaagaattttattttgatatcttgttttatttatttttattttcatactcaacaactcctcaccatttcttgcaaaaatagagcaaaacacaacaaaacaaaaaacaattgaaaacatatacctcactctattgcctgtgtttaaaaatctcatgattgtgtaaaaataatatttttcttgactctttgtctatctctgtgcttacagtacagtcttaattactgtggctttattataaagaaaaaaaagtcagaagacataataccagatttttagacttaagattttcttggctattctacatcctttgaatttccacgtaaattgtagaatcaccttttcaatttcaaaaattcctttggggattttaattggactgcattgagtctatatatcaaattggagaaaactgaaatctttttttgtattatactttaagttttatggtacatgtgcacaacgtgcaggtttgttacatatttatacatgtgccatgttggtgtgctgcatccattaactcttaacaatatcaaatcttctgttctatgaacagaaaatgctatttatttatatctcctttaatccacattgtatgcagagacctatttctagtgattaagttttagattctttaagaacttatgtacaaattttttcagcaaatacaaatgttttgcttattcatttccatactccatgggttttgtttgtttatttgttttgaatttttgcatgtcttaggacctccattatgatttcatatagtggatggttcagtattttttataatttgagaagtgaaatgtttaatattttatcactaagatgtttgctgtagaattgcctgtacgacttctcaataattttaaacctcagtaattctaaagatggatcatttgtagatgctttatcagaataaggtgtttttcattatcccaggcttgctgagagttttattatgaatagctgttgacttctttcaagtgattttcagctactattgagataataaaagttattgttcttaattctgtcagtgtgatgcattatatggattgattatgtaatgttataataaccttgcacttctgaaatatattcaagttgggcatggcagattatctgagagagatagaggtaaatcttcccttttttttttgaatgtttgtctgtatttatgagagatactgacttttagtttttccatttgaaatgtcttcaatagtcttttgatcttatcactcttattgtgcagttgtcaacataacttatcaaactagacaatgagagattagaacatgagcaacatcattcttaaggctccttgtggttatcgagatgttggaggggatagagagataaacctgagaaatatttcagtgagagagttgatgggactgaggtttgcacagccgatggcagttgatttttaaaaattgcttatatgtgcaactatatttccctttataatttttatcctttactctgtgtgtagaaaagtgtattttatcctgctttactaggacatttgtgttttcatttctttttacaaatctgaaattcatgtttatttgtgaattatcacttcacttaaacattttatacaatgcttttctagcaatttgagattttggagtactataccgctgatattgagtggcaaacataaacataaccactaatcgtatcttatgatctaaatagaatacatactggttggagtggggaaattgtgcatatcatgaagtaaggacaagcattagaaataaaggaaatatttcttaagatatttgatagcttaggaaatatcatttcataacacttatattttcagaaaaatatttgatgtgtttgtgttctatttctgaattagatgtcacagtaatcactgtgctgactcaggctctggtctccaaaaacagcttgatcagttagggctgagcagtgactcagcctggtattggcagaacccagtttagtatcctgcgattcttactgtgtatgcgcctgtctgacttcaccctgactcagtggaattggtctgagacagatgccttgctcacagttaggagctgaaattatgaggctcccacatgatgaggaaacagcctttcttctcattgtaagatgagttctgagggcttttttgcatctgtgaattgtgacttctcacggggaactcacacacttgagtgacctgagaagaccatgaagtgtgatgtatttaacctcaattacatcaccatttctcatgtgatttttttttcatttcagttgtcaacgggaacattatcgtgcccaaacttacaaaacttccagacaaagcttcctgagagaagttgaaaggccaccatcagctgagaagctgtgacgatatttgtagctgcctgaattggagccaacaaaaaccaggtcaggctctgaatcttactatttatagtaattatgacctgcaccttgctgtccttgccaggattagtgacagtgggtggactgatttcatcccctccatcagcagcctggaggctgaagatgcagcgtactgttactgtcaacaacataggagcttgcctgtcacggtgtgagaactctggacagcgagaggacaccaatccactcctttctcttgtcaaaatgactgacatctaagtgggaaatctaatgaacccctcagaaagggcctttggatactactttatcccatgatgaaagacaggaaccgaaaccacacacatttgatgggaatttgggctcatccacttaacagctgtgtgactttcaggacgttacttaaactttctttgcttggttttcccatctgtaataataaaaaataaaggaatagctacatcatacggtattataagagttgaatagatgtttttaaaatgtttataaatagtaaacatttgataacattatttatcattattttgctccacccggtaattatatatataatatttctcaccatatttttaaatttgaaccatttcataatttaaaaattgttttgcaacttccacttctgtaaaatggtggaacggcttatgtggaaccaaccttctgggtacacctaaaaaaagctgaataaaatatgaaaacgtgtttgaaggcattagagcatcaccatgtctgagagtctgattacttttgatgttttatccctgacatcctccaagcccctcctccttttttctctgcccatatctctataagcactggtaggaaattccccacaaccctccagctcacagggagaacattctctcactctctccccttaccaactctaaaagcctaaactctgcctcttcaggcaggtctgcaccagctcgtgcccaccccacacaggcatccttcgtgggaacaataaacactctctcaagttttcttggcctcaacttaataattattaattagggaaccggcccatctacctccatgatggggcattaaacattacaacccagcaggtcttcaaggagacaagaaaagcagggaagcatagacaggggagcactagttttgtgccttcagtgtcccttgagacataagcaggctcagaaatagaggcccagtcctgaaaatctgaaagaaaggaggggccaaggggcctcggagtccatcagagctttaaaaaactctcatatggccacaggtgaaaaactgtcccgaacgactgcagaaaaggagggatcctgacacataccgaggtcttgaggtgaaatcttgctagggaaacataccgggaggaggttgcaccaggagtagcaaggcaccaccgtgctgatacccaggcccaaagtactgcagtcctttgatggcattaacttggtacagccctagcatttcattctggcagaataagaagtaaatcctctctggagtgtgaaaattattccagagcccaaacttgcttctaaaatgttgtagggcaagtatcagtttaaatctacatagatattaagtgtattaaacatagtgtgatttcaatcaacaatacccaaacatacaaaatggagagaaaaaaaacaggcaacagaaagggaccaaaataatttgcggatattgggacaatagtatattatatgctgaatgcattctatgacaagatcaagaattttagcagagaacaagaaactataaaaagaaatcaaacaaatgtcaaatataaagtaattcaaaccaataactcaatggatgaatgtaacggtaaatttgacagttaaatttgctcttgcaagtgatccactggaagtttggtcaggccatgaggcaatttgtaataaataaaaagaataaaatcatttctagacaaatatgatgaacgtgatttgatttaattaagtgtaaattattgtctcaaaaattgtaaattgattgatcctcaggtgaaagaagcaacactccttccattttagaccaaaatgtgtgagaatttcctgaccagagaaagaacacagagcactgggcaagaaaaggaggctgagtgatgaggtggcagcctgggaccctcgaatccacgtgaagccctaaattccgcaggcttcagtgccttgtgtggaaccagagagcaaagccattttcaaaagcattgctccgcctgtaatcccagcaatttgggaggctgaggcaggagaatagcttgaaccccagaggcggaggttgcagactgtcaagacgatgccattgcagtctagccattagcatgggcaacaagagggaaactctgtttcaaaaaaaaaaaaaaaaagaagcattgctcctcgccttcagacacagcttccaatacagttttgaaaaataatttaaatcattccataaatactggaatgcaaatatttcataaaaatctagaatgtactccatttagagaagacagaagaggcagtctttctgctctataatcatctggagggcactgtcctgctctgaacttgagctctagccagagctgataatacgaagacctctctctgtgcagccatcagccctgactcccagcactgcaggggagctgagagaggccagaggcacagacatggtggaaactgcccacagattccgactgagggaacaacgaaagagtggagtaagaaatcactgactgagccgctgtgggcctcaagtctgataaacttacggtcactctattgctaactagagagcgttggacagcaacatattgtgtggcctccacaacacttggaaaccagacatgaggaaatcccaattcataggtattaacatctaactgaaagctacccaccactcgcttatgtttccacagtcttggatagtgcctgaaaaccatttatgattgttttaggcatcatgaacaagcaagcaaacaaacaagaaagcgtgtttgagaatatgcaaaaaagacttactttattcactaggaatgacactgtcaagtacctaccgggaaaaaacaccaggtgtcttggcggagttgaccacaagagggggcacgtgcgcaatagcgatcctagagagggctctgggatctcggattaacaatggcccagagtcccggccggttctgggtattattattattattattattattattattattattattactattattacttcatgatcccagttcatagcttaccattttcacgcactaataattttacacctcttcgcgtttcttatttttctagctgactctattgtagaaggacaattaaacttaggactcagaacaacctaatcaatgggtaattgtttaaacatcagttccctctgtcacatactgtgacatgcagagtgtgtgtaagcctggagaaatgattcacaggaaatgtccatgaggaagagctgtgagtgagagggtctgtctagcaaaggagaggagtgaggactaggttttttggagtgtggcctagtaattgaagggcatcaaaaggacaaggatcaagatgttcttcatccaggtgtgaggacatgcaaaccctgcaggtcctcccaggccagtggtcatggtcttggagacttgtagatctaactgtcatttgctcacatccacagttaccacctggctccaaagatagcactggtatgggctagcttcccggatgctccagaagtgtagatatagtttgccaatgattaagaggacaatgaaaattgtatatttggttagatttatatctatgactccattcaggaaagaaaaatgagcagaagaaatagctctctgaactaaatgaaaaatcacatcctagtgacatttttcctttcccatatcgatcctttaatatcatgtttgacacttcagaaggtcagctgacccctgggatatttatcgttaagtcatgattctgctcaacctgagcccatggttggaccatgcccaggcatctgaatacagccggcctgggagccgcagtgaggcattctctctcataggaagctttgactgaggttcagagatgaatgcctagcactcaaggtcttttgcatagaaacatacatgggctatttgaccgctccatctaaggtgtgaaagtgaacctgttatctgattctgctcatctaggctgaaaacagacttccagaagattcccctgcccaggatggtcttgttgggatggatcctcttgcccctggtgctctgcattcatggtacaggattctttgtacatatatgtaattttcaggatgagaacagtggtggccactcttatccagtgggtgagacagtgaagatcaatggccaaagtttttatttcagcctttcattcagatggcagaggcttaaaaacctgaagaacacctagatatgatgtatcttttttttcattcacaaccattgtttttgacttgcattcagactgatcaattgtttttccaccctttcccatcaggctactgtgctgactcagcccccatccctcctgtctgtggccgtgggagacagggtctccgtctcctgcaaggccagtcgcaatctcatccataggaatggagacatctacttgaacgggttccaacagaagccacaccaatctcctcaaccactgatctatatggtgacaaacagggctcctgggtcccagcccacgtcagtggcagtgggtctgggaggaagttcacactcacaatcaccaatgtggagccaggagacgttgcatattacttctgtgagcagcgcactcactgggaccctatacagtggaacagccctaaacatacacctccctgtcaggcctctgagcccaagctaagccatcacatcccctgtgacctgcatgtatacatccagatggcctgaaacaactgaagatccacaaaataagtgaaaatagccttaactgatgacattccaccattgtgattttttcctgccccaccctaactgatacgatatagtgtcccctgcccttaaaaaggtactttgtaatattctccccgcctttgagaatgtactttgtatgcctatcccaaacctatatgagctaataataatcccaccaccctttgctgactcctttttcagaccagcccgcctgcactcaggtgaaataaacagccttgttgctcacacagagcctgttggtggactctctttacatggacacacgtgacacacccatgcagggtcaacccttctgctcagctgagcatctgcttcctccagggaatcagtgtctgagcagctgctcctcttagagaagaaggaaattggggtgaggtagaaatggtgaggagcccttgaaggaggtgggaagatgtggtgtggctctaagcccaggggtccctctcattaaatgatcagtgtccagacagcattgctgaggcagctcccagagggctccatcctgagtccctcttctcaggccccctgtatcactggccctgaagaaatactctcctgttgtccatggctccaagaacagtttgccttgccctgactttgctgctcaactcacagcctcatggcagattccactggaccatacacagtgtcagatccataaggaggtactggtctgttctaaatcagctgttctgattctcaacttcctgcctaatggctcatctccatgagattcatgtgctccaccctttctggctcagccatgctcttcctggcttcccctaatcccaggttttcccctggaagtttgacaggcttctcctctaagtatgttgtcaatttattttcttacttgcttgattcctggggaaacaagtcctttcaagcctaggcccttctgagacctcagggatgcaaggcaaaaagagcaaagcagctgcacgtgtatgagactgaattggtcacctaaactgtcatttaacttttttgctaagtcattgcttttctctggaaatagtttttcaagatgcaagtatttgatttttaaaacatgtgtggctttaccaaatgcttttcttctaagtcttcttctccacaagtccaagttaggctaattatatccagtaaagtctggtagcccttctctaatagctcctctttccatacccctagcaacactcagtcataatcccactgattcatcagatgacaaatgcaaaaacttggaaaaatatatattcttcataacaaatgctatatattttaaactgaggccctagactttcatcttctccaatattgtgtctcaactgtgtgaattatataatatggcagcaattgtatttcaatctctccagttaggagcagctcagtgcttgcagtatctttccatttgatttctataacattcctagtggtagaaaactcaattcatttatccaattacatggcttagtaacagctgtctgttggtgtatacttctatgttttaataatcctattcccctgttccattattcaagctaacaacattccattggtaaatggcatcactgaaaatttactgtttaagaatgaacattattttttcaatattcttaattggttagcagacttcaaaaataactaaattctgaaaaaaaaataagtaatggcaggctcagagaaaaataaattatttctaataatgtgaggacatgaccaaataggaagagcagtgaaagcagttgcgtgtgctccctttgtccaaaacattttacagaaaggattttattgatcacagtccttcatcatcacaggtaataagacatgttgacattatgcaactcaagatgatgcactggctgacaaggaccatctcttttgtgatattcttgtcaaaaacatataatctgaattaattaatagagaaaattagaagggcaatcttaaaaatcattgatagtacattttacaagcatcaaggtcatgaaagacaaagaaagaataaacaatgatcacagattggaggagattaaggagacaagaaaattaagtgcaatatgtcatcctggatttgatactggaacttgaaagaatctttagtgaaaaatttagtggaatccaaatatggagtaaatactattgtatcaatattaatttttcattttatatcatcccactttggttatttaagatgtttaatattaagagaaggtagaggagaagtatattgaaacaatctactacttttgaaactttgcataaatctaaatttatttcaaaactaattaaaatatacaaatgaaaatataagtaagaaaagaacataagctcctaaggagcaattccacaagtatcattctatttttcctcattttcttatttgtgatttctgtttcttgaaatgacaatcctggtttctattatctatagcagtggtccccaacctttttggcaccagggactggtttcatggaagacaatttttccatgggtctcaagagtcggggatggtttcaggactatccaagcacatatttattgtgcactttatttcaattattattacattgtaatatataatgaaataattgcacaactcatcataatgtagaatcagtggaagccctgggcttgttttcccgcaactagatggtgccatctgggggtgatgggagacagtgacagatcatcaggcattagtttctcataaggagcacacaacctagatccctcacatgtacagttcaaaatagggtttgcactgcagtgaaaatctaatgctgctgctgatctgacagatggtggagctcaggtggtaatgcaagcaatggggagaggctctaaagacagaggaagctttgcttgcttacctgctgctcacctcgcagttgtaaaagaccaaatgagatgttgaattcaatagagttattttaaagatgtttaaaaaatttatttctttcgatcagcactctatgatcaaatacttaaaatggaaaatatgaaaaaaatgattaaacacattgtacctagctgagggatttttcctaaccactgcacaaatgaagaccacgacattgtgtaactgcccaatgtgttcaccttgcctgctgcctagacagagctgagttctcaagacaggggaattgcaacagagaacgagtaattcaggcagggctggctatgcgagagaccagagttttattattactcaaatcagtcttgctgagcatttagggagcagaatttttaaggacaacttggtgggtggtgggtgagccagtgagccaggagtgctgattggtcagagatgaaatcatagggagtcaaagctgccttcttgcactgagtcagttcctgggtgggagaccataagatcagattagcagtttattgatctgggtggtgccagctgatccatcaagtgcaagatctgcaaaatatctcaagcactgatcttaggagcagtttagggggggtcagaaccttgtagcctccagctgcatgactcataaaccataatttctaatcttgtggctaatgttagtcctacaaagcctatctagtccccaggcaagaagaacatctgctttgggaaaaggctgttattgtctttgttttaaactctaaactaaattcctctcaaagttagttcagcctatgcccaggaatgaacaaggacaacttggaggttagaagcaagatggagtcagttaatttagacctctttcactgtctcagtcataattttgcaaagtcagtttcatttgcaataaagagttttggtagacatgaggctggccacaccacatgggagacagagttagtactcaaatcaatctccctgaaggcctgtagttaggggtttttcaaaggcagtttggaggaaggggtggccaggtaatgggtgcttgctgctgattggttgggtcagaaatgaagtcataaaatgtcagagctgttctctggagctgaatctctcctgagtggggccacaggatgtgggttagcaggtccaggtggagccattgctgtcagatatgcaacaatacttgaaaatatatcttaaaaggccaatctacaatagtggtgttatctgcaggagtatctggtgaccagtccacaccttagcagaatcaggctcctcttttcccactatttgatggcctttcatgatctttacaaaggtagctgagttttgggtaacccatatcatcatttaaactataacctaaatggcttccaaagttagctctgcccaaaagcccaggaataattaaggaaaatgcaagatggggaggtgggttagatcagatctcttttactgccataattttcctactattaaaatttttgcaaaggtggtttcaaaatagcgactttcaatataacagtggaagttatgaagacaaaaaaataccaaaagagaattttaaaactgaaaagtagaataactcaattgaaaatttagataggtaccacaatagttgacagtgtcagaagaatcagtgaacttgaagatcaaccaatagaaataatctgttccaaagaataaagatgtaagcagccaagcaagacctcagagatgtataggtcagtgtgaagaacaccaacaaatgtggatgggagtcacaaaggagaagggagagagaaaggagctgaaaaagtatatgaaaaataatgggaacatcttttcaaatgtattgaaatacattactatatagatccaagaaatgtgatgaaacacatccaggggaagcaaaaaagattcataactacacatattgtaattaaaatgctgaaatacagttacaaagggaaaatcttcaagagaaaaaaaaccactatgtacaaagatacaataatgtagacactgaataagggtccattatttctaatggagacgagaagacggtggaatggcatactcaaatgctgaaagaaaaaaatcaacccaaaattctatatacagcaaaagtatactttaacaataaagcaaactaaacatatttctttgtcgataaagagtcaaactctctaaaatatttgaagagatttattctgagccaaatgagtgaccgtggcccccaacacaaccctcaggaggtcctgagaacatgtacccaaggtggttggggcgcagcttggttttatacattttagagaggcatgagacgtcaatcaaacacatttaagaaatacattggtttgatccagaaaggcgggacaactcaaagcaggggtgaggatcgggagtggggaagcgggggagggtccaggctctaactagcatttccttgttgacaattggttgagtttgtctaaagacctgggatcaatagaaaataaatgttcgggttaagataaaagactgtggaagaccaaggttcttttgaagtcatatagtggctgcctttagagacgatagattacaaatatttcctattcagatctttaaaatgtgctacactcttctttaagattgggagagcctggaagaaaaagatctagctatgttaatagagattctttacagatgcaaatttttccccacaaaggacagctttgcaaggccatttcaagatagggcaaagaaacatgttttggggtaaaatattttaattttctgccttgttgcataatgttacaccacagtcaggttggaaagtaagtccagggatatgtagggttaaataaaacccatctgatgagaatttatagtttgtagggcatgactccccagactccttagataggaactgagacaaggaaaaaaaaaatcagagcttagtccttaccttgataaacacaaatgaaaagaaattattacttgtagacattcaataaattatctgaaatcaatttaagaaaacattgttcagaatcacatgaaattatagaggacagtaatttgaatccacaagcagaaataaaggcctcgaaatagtaaagaactgggaaaaaaatagacacaatgataaaaaaaagtttacttcaatttctatgatattcactaccaagtacaaacaaactatcgtggtagatgtcagaaagacagttactttggttgggatggggaggcagttattgaatgggaaggtgtacgagagaatcatccagaaattttgaaacattctatagtttcagctggatagtgaatatacataaaactttattcattccacatttaggatttctgccctttatatgtggtttatttcaatgaaaaaaaaatagaaaagccaagcctagattcttttaaagaaaattggaggcaagaaaaaagaatcagccaatatttatggaaactcaactttattaaagacaagtgcaaaatgtgcctggaaaagtgctaaagaactgttgaaaaacaggtggaaagaaaaggaaatattataatatgtctcttctccaactgaagcaacacagattttatcttggttagttttccttgaaacacgcaggatattttatgtccccttgcccacaagagaagccctcatcctcctgttgttgcgcttagcatcactgcacccaccgggggatttgcatattgtcctctagggaggaccttcccttgtgggtctgagataaaagctcagctctaacccttaccttgactgatcaggactcctcagttcaccttctcactatgaggctccctgctcagctcttggggctgctaatgctctgggtccctggtaaggacagaaggagatgagggaggagaatggggtgggaaggtaagcctgggggtcccactgccttccatgtgtgttctgccctgcccatgtgttagatgtacaggtcttgttctccaggatggggaatgtgaggtttaaatctgtgagagtgaggacaattcaaaaagaagcaaggacctgtgtgatctggtgaagattgtcacacagagaaagggaggtggtgtaggtgatttctagaatcccctttgcggcttgcaaatttggaatatgtttagtgtataaatacaaacaacaaaaaattatatagcctgaaataaaaaatgaaaatttatgataaatgacacatgatatttgtacatatccttccacttctttctatttattttaggatccagtgcagagattgtgatgacccagactccactctccttgtctatcacccctggagagcaggcctccatgtcctgcaggtctagtcagagcctcctgcatagtgatggatacacctatttgtattggtttctgcagaaagccaggccagtctccacagctcctgatctatgaagtttccaaccggttctctggagtgccagataggttcagtggcagcgggtcagggacagatttcacactgaaaatcagccgggtggaggctgaggatgttggagtttattactgcatgcaagatgcacaagatcctcccacagtgctacagccctgagcacaaacctctctgcttgaagtggcccagctgctcacatgtgatgtttgtctggggagcagcacagcaagttctctgagtctgtgcatgaggaaaatgttggacaactcagaggagtagattggtctcatgaattccttggttacatctcaggaactactcatttgtgcagctgcaaaagccttgacatggcaaaagcagtaggagaatggggaaggtcccatggagctgatgctgattcatgatgcaactgaataaaagctcattcgaatcctcctttcttacatttctcaattgtagttaatcagcataagtgccaggcaattgatacaaatgttggcaacacatgctgagtgcctcctcatttgtatgtatttcatccatttttgtatattttaataggataattatttggtcatatttagaaattggtattttccaccttccaagctttctactttccttacttattgcttctcttcctatgtaataaagatactgtagacaacattttacactagttgtaaaatgtggctccccatttatacgggtagctggttgggggcaattagcaaaaatcttggtttttgagtgcctaaatagacttttgtaaattaatgtcagatacaagatccaaatgctaaaactctttgatttgccttgattacttcttactgatagatcataaaaggaattcttgaaattccaaaagttgggttttaaaaataaaagcatacactggaatatacagggcatagaattcaccctatatattgctagaagaatagagaatgataacagttttagacttcgagggtacttcaggaatgggaacacacaaggaacacagtagatatgagctactgtgtctaccgtattagacaatcctcctgcattttaacttacatttggtgaacttcagatgccagtgggtgttgcaagttgatgacataaacctaaaatcaagtcccgaggtatttcttgtgaagagtcacagagttgaagagaccactgcctggcttcctgagttgagcctgtgccactgcaagtttcatgggaaaatggcgagaaaagctgtttaggtttgtaatcatcaaaggtttagtgaagttcccgtgcaaagagactcaatcccattcaactcagcatgaagagatcttctagaactcattctgcccctatagcagagatgatgtggtcaggtttgtggagatgaacatgcaatgacgtgttaaccaaaaggcccagcagaaagggatagtgatcaatgtccatggttcagacatatacaaaggatgatttgcacagcactggaggaaaaaacatcctgagtgttggagatttctgccttcctacccaagctcccgcagcctgtctcctgactcagaactcagcaaatgccacatgaaaaatctggctatggttgcacagaaattgccctgtgcaaccttcaaagctcagttatgttctctcttcttgctgggtttctctgtctgtgccaaatcaaaatttctatccgaacgcacatttggtaaaaaaaaaaaaaaaaagggcagaaaaacaaaatgtcagatgaacaccaactcaactagaattagttgtttttttactctagaattttagatcacctagtcctcatttcttccattactttctaatgtcactaataggtaactttgcattttatttgtttttattggcacattgtaattgtacatatttatggagtacactttgatgtcttgatatgtacatatgttgaaaaatgatcaaatcaggatatttaggatgtgcatcagctcatgtatttaccatttctttatgttactctgggtcccaggtgaggggaatatgcgggggggcgtggggggttctgtgtgtcagtgaaaactctctcaactttgttgggtccttcaacctggcatttccgctcagcaagcacaataattaaagctcaatgtaaatcaatggtcttgactctattggaaagacaatgggtataatctagattacatgtgtgattatttgtttttctgtttaaactgttttttcaaaaaataaattttattctgtatattttaggtttgcaatatgatgttgtggcatacatatagatagtaaaatgcttactatagtgaagagaatgaacatttatcatctcacatagttactttttcgtctgtgacaagagcagctggaatctacttatttaacaaaaatctctaatacagtacagttttattaactatagccctcattttctacagtagatctctatacttgctattcgtaaatatttactaccttgcatctttggacctacatcttcccatttcttcccattccacccccggcccttaataacgactgtttcattctctatttctgcataatttatctttttagttatttaatttatttttaggtttacatgtaagtaaaatcaggcaatatttttatttctgtatcttgcttttttcacttggaatactgtcctctaggtccatccacattacggcaaatagaagaatcttctttttctgctgggtgtggtggctcatgcctgtaatcccagcactaggcgggtgcatcacctgacatcaggagttgaataccagcctggccaacatggcaaaaccctgtctctactaaaaatacaaaaaatacaaaagaaaattagctgggcgtgttggcatgggcctgtaatcccaactactcaggaagctgaggcaggagaatcgcttgaacccgggaggaggaggttgcagtgagctgagatagcatcattgcactccagcctgggcaacaagagtgagacttctctaaaataaaaataataataataataaaaaagaatcttcttgtttaaggctgaattatattccatggtgtgtgtgtgtgtgtgtgtgtgtgtgtgtgtgtgtacatttatgtataccacattttctttattcatttatttgtccacggatgctcaggtttttctcatttcttgtgaataatgctgcaataaacacgggagtgtaggtatctttaaaagaaggtggtgatttcatctcttctgggtatgtatccaaaatagggtcactgttgggttataaggtggttaggttttgaatttctttaggaacctccatactgttttccataatgggtgcaccaatcatcattcccaccaacaatgtacaagtgttttattttcttcacaccctcatcaatatttatctcttgtcttttttataatagccatcctaaagactgtaaggcgttttatttctaatctcagatttcactgtagaaacagtgatgacacagtctccagcttccctgtctttgtctctggagaaaaaagccaccctgacttgcagggccagtcagtgttagcagctactaagcctggtaccagaagaaacctgagcgggttcccaggctcctcatctatggtacagccctgatttgtgatagtgggtcggggacagggcttactctcaccatcggcagcctggagcctggagcctggagatttgcacttcatcactgttatcagcatagtagttggtgtcccatactgattcgacatgcaacaaaaacctccaggagacctaaggtgtttatttgattatactacctgcttcctttttagtcatctgatgtggtgctgctcagttttagcatctctgctttgattggaaattctgaggttctcaaaagtaattccttataatatttatagtttcactcatggatttttttctcagacccaaatgtacagccaggttcaggcacaatttcatggtcaaggccattggatcagactcacatgagtggacgcctctaaaggtcctggccagtgcgataaagtagcagcgacaatgataaagaagaagaattagaaaggcagaattaaaggtataacaattcactgatgaaaggactgtgtgggggagaaatttctaattgtctacacagaaattattagaattaatgagatacatagcaaattgttagattaaagatcaatataaaatatatttatttttatataaatgtaacaactgctaaaattaaaattatgaaacacatcatttatagtagcaccaaaccaagaggcattagaaaaaactaacaaaatatactgacagctccagaatataattcaaagaaatcaaagaaaatctaagcaaatggaaggccacagtactttcaaaggttgaaagtcccagtattgtaaagatgttcattcttcacagattgatatattaaagataatcgaaatcaaaatttcaaaccgtttttaaatggaaatgtaaaagctgattctacatatcatattacattgttaaggagtttgaataaccacaataaacccgaagaagcccaagaatgaggacttacactacttggatactcgaaccatgctgctgatgtgagttcaaacaaattgcctaatgcaacagaagagagtattctgagaatgactaacacatatagtgacactttttagggacaaaggtgacactgcacaacagagtgaacacaataaaaagctgtccaacatcaataatcatcccagtcctacaaatgaaaatcacaactgtctgccactaaaacttcaataggatgactcaaagggacaatgccaaatacagtgacggaaagggggaactagaagggccacacattgtgtttgggaatataaagtggtaccacaagttggagaactgacactgaatatataatccctttttaatccagcccttccactcagaaatgtgtacagatgtgcacagaaagaaatgtgcaataacactcggccgggcgcagtggctcaagcctgtaatcccagcactttgggaggctgaagcaggcagatcacaaggtcaggagttcgagcccagcctggccaatatggtgaaaccctgtctctactaaaaatacaaaaattagctgggcgtggtggcggacgcctatattcccagctactagggaggctgaggcagaagaatcgcttgaacccgggaggtgaaggttgcagtgagccgagatcatgccactgcactccagcctgggtgacagggtgagactacatctcaaaaataaataaataaataaataaataaataaataaataaataaataacactcatagcattattagtgatagccccaaactgggaacattctaaatacaaatctagagtaatttgaataaataaaatgaggtaggtgcatacaattaaatactatggatgaatgaaaatataaaagctgctactacatccatgaatgtgggtgtatcttactagcataataatgcgcaaaagacgttagaaataaaaagctcactatccatgattcctttttatatagttcaaaaaccgccatcactaaatcaatgttactgaaagtgagatttaaatttgcattggagaagagtggggctaatgtttgggaggagacagaaggtgcttctaggagaccgggagtgttctgctttggtacggttgttatacagtgtgttcaatctctgaaaaatttattaaaacctgcattataatttgtgagtgcatatacacatgttgagatttgtgaatatacatgtatgggtaagttttatcttatcaaaagtttattttaaaaaagttatgaagcataatgttatttgcaccaatcaatgcatcctaacttctttccttgtctaatcaaattgtatttaattataatctgtattcattttcacattccatctatggaaccagggcaccaaatgtaaggaagcccagggtttacaaggttaccacactgttagtgtcatcaggaacacatgagtcactataacctcttttatttttttgtcctggaaagcatcaaaattctaagctactcaaaatgtattgcattttaatgatggttcctatttaccctaaatgtacgaatccaattaagtcagtatttgtagaatcagaacaatttgcttcaatgtgtttttcacttttatttattcactgaagacactggtaattttacactataaaaagtgaaataaaaacatacacaaaattatacttgctctatccttcagtaaagatgagatgactaaaacccagatagatttgttgataggaattattcaagatgatccagctagttgaagagcatcacttagaattctggtgacccctttttaggacaaagttgttgctaaataattctaaagatgtgccagtaacttgctaagaacattgaagtacaagtttttgtgtagatatatgttttcctttttcttgggtccacacttaagagcttcctggatcatatggtaactctatgtttaaccacttgaattgcagactgttttccaaacctgctgcaccatttttcatttccaccagcagtgcaaagattctattttattgccaacctatgcaatgagaagaaaaaacctctgagtgaggaggcgtttagaagaactagaatatatccagatgtaagaaaataaatccaaggtagcttagagatgcccattaaatagtttttaaatttttcctagtcttcccaaacctggttacatgtttttactacttggtggatggtactcactcgcaatggtgtttagagttgggaatggactcaggaagtggaaaagttccttcagacaaggaagaactggttcaagacacaaactaaggagagctaatcagaatgaaagacggggagctgaggaaagtgaaatgaaaatttcctgtaggaaggaggtaacatttaagcagaatgccttgttctttaggtagtgtgtctgtccttaggatcttgtgctctggactagtgcctgacataaaaggactgagcactgacatctctctctctcactaattaactttttgtgtcagttgttgtaattccttatatagagtagaatgatctcgaaaggttagatgttttatttaaaaaaaattaataaatgaccaccgtgagtgaatcctaaacaagatagaatgggaataaactgaaagaacaaaatataagcatatatgtcatatttactttttgttatgcctatataaatctataattttaaattttgaagtcaaggaaaatactggttattaaattttatcatctattaaaccagtatgatggtaaaacttgttattgcccttcaattatgattcctaattttgcatgagtaatattgtcattgttatagtcagattattacagttaaattgcattgcattatatgccttatatttgaggaatttttcctatggaatgactttgcatttatcaacacatttttaacttagttagattaacttataggttttgttgatttttatcctcaccaacattcttttacaatcacaaaccacagcttcctcttcttgagcaaccgactttacttcatctctttatcagctgtaatacatttttcaagggtttctagtttcataaatccttatgcatatcataatttacttgtttcaaattaaaaattttcttcatattttatttccctagttcaatagaaaatgcatgcagtataatttcttttataaaaactttgcacattttcaaatataattacattgattactgggagttcattttgcaggccaggactctgaagaaagcctgacatttatctttgaaaaaaataacccttacattctttgaatttgtattttattatgaaatatttgtgttttctcattttataaatgtttgaatacaattgtgtgactccactgaatttacactcattagtagttaacagacatggaaattttatttcagattacatttcttcttactgattcttttctaaggactcatttcttccttaggaaaatgtttaattctcaggtttaactttctactctgtttttctgtctaagctctctctttattatctaatgtcatgattctctcctttgaaaaacaaaagtgctactctagtttgccttccatatcactgttttgatcaattgcagtgccaattctgctatattgtcttgaatattgggttttgtttttaatgatgcagtttgttttatttttcttatattgcaacagagtttaaggaactatgcttacattttcgataattacatattttgtgctatttttcatcctaggttatatgtttttctttattttattgattatgcaaaacataatgtagaaatgttctggagtccgcaagagtttttttttttacttaacttttctcgttaatttattttttttacaacatcttcttgtcctcctttcaattcctccttcttccctttcatttttctttttctattatcttttttaatgggcctcaactttattaactgattgcaaggaataataatcaatgatggttaataacacaattataatgttggtccataatgcacttttattattaatccattatggttcttatttatttattcatatttttagcactcactaatgcattcattaatattagtaatataataaattcatgttactatcctgcaaaacaaccacttaagatatcaactggtatccattttgaggttctccacaatctcttaaacatattatttcccaccaccaagttaatcaaaattttcaattcaatattctttatcaatgtagtttatttcttctatatgtattcctttaaaaagttgtttatttcttttagacattataaaaaggatgtcatactagtgaagtctaagttattaatttctttatgctagatattttgtttattttctctaagaattatttttttatctctagggtcatgaaatatatttctatacccttttgtagaggatttactcttgggcctttcatatttatatttaaaatttattgatgattaacatttgtatatggtatagaattaagattcattttcatataatacagatactgaattgatccagtatgattaatttattttacttctactactttgaagtagcacttttattgtaaatcaaatgactacggatgggtggatcagtttctggattctcaaactgattgaactggctaatttgtttgacacttcactgataccatatattttaattactgtaacttacaggctttggtattgtgtactattagtcctccaacattttttatcttagcaagactgtcttgattactttttgcattttgaatgttcatatatatttaagtaatgtcttttcaattgcaacaacaattccctgagattttttattgtgaacgttttcaacaaatttagggagaatatacactattaagtctcccaattcatgagcatggtgcaaccttccatttattggagttttctttatttttatccaactgcattttgtacatttctgtttggttttgttgaacattttttttatgttttatttttattatttttatttttttattttttattatactttaagttttagggtacatgtgcacattgtgcaggttagttacatatgtatacatgtgccatgctggtgcgcagcacccactaactcgtcatctagcattaggtatatctcccaatgctatccctcccccctccccccaccccaccacagtccccagagtgtgatattccccttcctgtgtccatctgatctcattgttcaattcccacctatgagtgagaatatgtggtgtttggttttttgttcttgcaatagtttactgagaatgatgatttcaaatttcatccatgtccctacaaaggacatgaactcatcattttttatggctgcatagtattccatggtgtatatgtgccatattttcctaatccattctatcattgttggacatttgggttggttccaagtctttgctattgtgaataatgctgcaataaacatacgtgtgcatgtgtctttatagcagcatgatttatagtcatttgggtatatacccagtaatgggatggctgggtcaaatgctatttctaattctagatccctgaggaatcgccccactgacttcctcaatggttgaactagtttacagttccacgaacagtgtaaaagtgttcctatttctccacatcctctccagcacctgttgtttcctgactttttaatgattgccattctaactggtgtgagatggtatctcatagtggttttgatttgttgaacatattttatgtgactttttatttgggcatattgttaaacttaaagaaaaattgccaaagtaatataagaactccaatgtatacgttacccaaattcatttagtaaccatagatgactttctacttccaaattctttctatatttatgagttggcagctagttactactgattcagaacaaatcacccaaaacttaatgacacattacaattgacatcattatactattatctttgtagttgttaggtgtctcctgggctgaccaagatttctgctcgggatttcttacatggatgtagtcagatagcagctggggatggagtcatataaaaggtggccaattcaggctataggatgagtcctcagctgaggctgtgaatctctacatgctcctgcttggcttcttgtacacttcctcgaagagtaccagacagatgttttataacctcttatgacttactatagcctcagaagacacatagtgttacttctatgacaattataggttcactaagattccaaagggggaaaagtatgctaatatgtccaatagggaaattatcaacatcacactattagaggaactaataagatggaagatcttgtgaccatcttggagtatccagctggcaactctctacgcttgtttaaatcaatctacatttttactgtatgcaacatatactaattttcatctgcaacatctacaagcatttcccatgatggtggtaagttaaagttcaagatctcctcatctagatcagactctgtgcagttgagcctctttgcccatagttcctaaatatcacctgtccccctatcccactcaagacttgtgaacaatgatgagacaggactaggatgcacatacttgacagacaatgctgtagatactccctttcaggaagaaggcactcagcagtcaaaattccacagagcataaagccacagcttcctttcagggcttcctgcttcaaacgtctgtgttttttaaatgtttttttccctcaaactgtacttttcttttttttttttttttttgccttggaaacaatgtaattattatttaaaactcagtgaaatcatgaggatacagtcaggcaaaccctaaatgtgggaaatcctataggataaattatttctttcttttttgttttttaagtgtataattcttttttttattatactttaagttttggggtacatgtacacaacgtgcaggtttgttacatatgtatacatgtgccatgttggtgtgctgcactcattaacttgccgtttagcattaggtatatctcctaatgctatccctcccccctgcccccaccccacaacaggccccggtgtgtgatgttccccttcttgtgtccatgtgttctcattgttcaattcccacatatgagtgagaacatgcagtgtttggttttttgtccttgtgatagtttgctgagaatgatagtttccagcttcatccatgtccctacaaaggacatgaactcatccttttttatggatgcatagtattccatggtgtatatgtgccacattttcttaatccagtctatcattgttggacatttggattggttccaagtctttgctattgtgaatagtgccacaataaatatacgtgtgcatgtgtctttatagcagcatgatttatagtcatttgggtatatacccagtaatgggatggctgggtcaaatggtatttctagttctagatccctgaggaatcaccacactgacttccacaattgttgaattagtttacagtcccaccaacagtgtaaaagtgttcctatttctccacatcctctccagcacctgttgtctcctgattttttaatgattgtcattctaactggtgtgagatgctacctcattgtggttttgatttgcatttctctgatggccagtgatgatgagcattttttcatgtgtctgttggctgcataaatgtcttcttttgaggagtgtctgtgcatatcctttgcccactttttgatggggttgtttgtttttttcttttaaatttgtttgagttcattgtagattctggatattagccctttgtcagatgagtaggttgcaaaaattttctcccattctgtatgttgcctgttcactctgatggtagtttcttttgctgtgcagaagctccttagtttaattagatcccatttgtcaattttggcttttgttgtcattgcttttgttgttttagacatgaagtccttgcccatgcctatgtcctgaatggtattgcctaggttttcttctagggttttcatggttttaggtctaacatttaagtctttaatccatcttgaattaatttttgtataaggtgtaagaaagggatccagtttcagctttctacatatggctagccagttttcccagcaccatttattaaatagggaatcctttccccatttgtttttgtcaggtttgtcaaagatctgatggttgtagatatctggcattatttctgaggcctctgttctgttccattggtttatatctctgttttggtaccagtaccatgctgttttggttactgtagccttgtagtatagtttgaagtcaggtagtgtgatgcctccagctttgttcttttggcttaggattgacttggcaatgcgggctcttttttggttccacatgaactttaaagtagttttttctaattctgtgaagaaagtcattggtagcttgatggggatgacattgaatctataaattaccttgggcagtatggccattttcacgatattgattcttcctacccatgagcatggaatgttcttccatttgtttctatcctcttttatttcattgagcagtggtttgtagttctccttgaagaggtccttcacgtcccttgtaagctggattcctaggtattttattctctttgtagcaattgtgaatgggagttcactcaaactgtacttttcatcccttcaagcaacttcatccaaccaaacaacaaataatgagtttttagcagtgtcttctatgttgatcaaaactctcattatcctttgaggcagtttaatgtaaactttcttcattaattctttgccgttttcactttattgtgaatttttttcttgaatttacactgtaaggcatggattttttattttcagttatagtcagtatggcttttgtataaaattctccacattcttcttttactttgtttccctcaactctaaatccccaaattctgttagtatggtaactgaccttataatcttgatccattttgtatggaacattcccaggttaggttcataccaagaaaatgactctgtattcaagccacttgaattaatagctgtatcagtgattattatttatgatgaccatggtcttataaggttcatataacatgcttgtggtcactcgcattagtcatcaccagaacaagaccagctgcagctgaggactgaggaaatgttgtggtgatctggagtattattaagtgaggggttccacatagtccctctacagactgaagacactggggaaggatcatccgtgtgtgtgtgacagctgtgaaataatctgttctggaacaagaagctccaaaatatctcagcctgggatgactttgcgtgctttccatagagcatttggctacatatcaaagccgttatcagtgggctgttccctggctcagggcaggtgtctgcctcagccatgtacataatggacataaggagctcaactcttctgtctcctgctgcctgatcccagataaggaaaaggattatgaggaggtgccacatgatggtgaaatttgctttcttctcattgtaagttgaatctttagtaccttttttggtctgtgacatttgatttctcatggagcactcacagtgttgagtaacatgataagctcatagagtgggatgtgtttaacctcactgacatttgtgcttatgtgattttttcaaaaaaattcaaatgtcaatgagaatattgtgccacctcagttttatttatttttatttttttaacttttgttttaggttcagggatatatgtgaagttttgttacataactgaacttgtgccatgggggttccttgtacagattactttgtcacccaggtattattcccagtgcccaatagttatcttttctgctcctttcctttcttccaccctccaccctcaggtagaccccagtgtgtattgttcccttacttgtgttcatgagttctcaattttcaagttctggactaaggttgagggaagcaagccactatccagaaccctagtgtccctgcatggttgagtgaccacgagtctgaggtagattttgttcccacaatcagcagcctgaagcctgaagatgcagggtactgttactgtcaacaacatcaaatcttgcctctctcgtgtgacaaaactgagcaaaggcagtgcaatgatccagcagtgttatcttgttcaagttactcatacataattgatgaaatcatgtagaaagctcagtgaaagagattttgaaatattagtttctgtgataacagaacacacagattgtaatcacatatcattggttggaattttgtctcttacacttaatatatgtgtaaatttggcaaatgacttaaacacttttaccttgtttttttatctctaataaaggaaaataaagaagtaactataccataaaactattataataattaagtaattgaatacttataaaatgtttataactttcaaatgtattaaacactaaataattactaataatcattataattttgctacatctcttaattatgtagatccagtgtttccccaaatactgttttctttgatgttatttacaaaattatgatttttttcccctaaaactcccactatgttaagtagcagataaatttatttcatgccaagctgctaaaaacagatataaaaagctggacaaaatataaaaagctgatactctaaggtaccatgtaccttcgaataagtgctatgtaataagcatctgactccatttttgatgtttgatcagtgacagctttcaatcaccacctcccactttcccttccaccacatatttgtgcaactgcctgcaggacagtcaaacctcatagatcctcagcaatgcaagatagcatatctccagtccaactataaaaactcagccctctgtgtaactcgagccagcttataccagcttgtgcatatcctgctttccccaagattcccttgtgtgagttagaaaatttctcccaaattctcttgtacatggagtgtcaacagcttcaccataatatctactaattagaaaagatccatctcacctccgtaggtgaccacaaaatatgccaagagagcaagtatttgatgaatcaagaaaataaggtaagcttttatgaactgaatatttgtgtcccctcaaaattcaccagttgaagccctaactccatgtgcgcgtatatttggaggtatcgctaagaaactaacagtcaaatgaggccataaggttgagattctgatctgattcaattagtgtcctcattaaaaaaaaaaaaaaaaaggagagattgggctcagtggctcatgtctgcaatctcagtactttgggaggcagaggcgggtggatcatgaggtcaagagattgagaccatcctggccaacatggtgaaaccccgtctctactaaaaatagaaaaattagctggatatggtggcacatgcctgtagttccagctactcaggaggctgaggcaggagaatcacttgaacccaggaggcagaggttgcagtgagccaagattgcaccactgcactccagcctggtgacagagcgaaactccatctcaaaaaaagaaaaaaaaaaaaaagagaccaaatctattaggccattcttgcaatgctacaaagaaatactgagactgggtgatttataaagaaaagagttttactcagctcacatttctgcaggctttggaggaagcatgatgctggcatctgctcagcttctgggaaggcctcaggaagcttacagttatgatggaaggctaaggggtagtaggcccatcacaaggccagagaaagagcagaagagagagaaggagttgccatatgcttttaaataagcagatctcatgagaactcgctatcatgagaacagcaccaagaagatggtgctaaactgttcatgagaaatctatctccatgatccagtcacctcccatcaggcctgacttgcaatactggggattacaattccacatgatatttgagcagtaacaaatatgcagacaacatccttttacccctggactctctcaaatctcatgtccttttcacatttgaaaatacaataattccttttcaatatctgcccaaagtcttaccttattctaattttaacacaaaagtcccaagtccaagtccaaagccacatctgatactcatatccttccactgataagtctctgaaatcaaaacaagttatctactttcacaacaatcaaaagacaaaatcccattgattagtcacagcaggaattaaaaacttagaaaaatatctattttgagaaataagtaccatgttgatatagccacatattcttcaacttagtccctaggatttcagattcttggaaatcatgtctcaactgtgtgcatcctagtatggcaccaatagcatctcaacctcccactttagaagtagctcaatcaattctaaacttttccatttagtttctgaaatattctaagtgatgtgtaggactatatatttgtccaaattactcaggaacatccatccactggtgggtaccactatgttttaatagacaccagtcctctcttccttccttcacatcatcaacattccagtgttgaatggccatgatggaaatatttgacatttaagagtgagcataatttatttaatcagtattctctattggagagcaggctttaagtagaactgaattctgaaaaaaataaataagtagaaagagaatcagatagtgtctgagttctttcatgcaactataacaaactcacagactgggaaatttataaacaataaatatttatttctcacagttctggagttcagaactctaggatcaagatgctaacagattcagtgtcggtgaagctgtctggtggagccagaaaaggcaaaggagacaaattgaatcttgcgtctgcacatggcaacagagatggaagggccaggcagctctctgaaatcttctatataaggccattaatcccatttattgagggcagagcccatgacttaatcacttcccaaggggctctaccttttaatatcaacttaggctttaaattccaacattaagtttggaacatcacaaacatctaaaccatagcagatgggactagacaactcctaacaaagtcagcacataaccatataggaagagtgacaaaagcagctgccttggttacctttgaccaagactttcttacaaaaagggttccttagcaatattcatttatcaacaccagtgatgacatgttgatactgtgtaactcttgataggatgtactgaagacacatccctgctgtaatattcttgccaaaaatgaaaaatctgactttaatcaatagaaaataccaaacaatagaacttaagggacattctgaaaaataaccagccagcatacatcaaaagtttcaaggtatttcaaaacaaagactaaaaaactgtcagagattgaaggaaattaagaaagcatgaaaactgaatgcaatatgggatccagaaattttatcctaaaacattaaaagtaaaaatggtaaatacatgtatcagtggaaagctcagtgaaattcaaatgtagattgtaacttcattaataatagtggattaaccattaatgttaaagctatttgaagtactagaaaaatcagtttaaaatgattttatattcagcaaaactatccttaaagaaaagaaaagaagccgtgactagcatatatctcctataagaaactcaagaagaaatccttcagaattcagaatcacagtaaacgacaatgaacagtaatttaaatccatgaaattaaatgaaagcttcataaatatacttacctcaattcatatgttgttgatgttcacgaaaactgaatctttgtgatagatatcagagttgcagttcccttggtaggttagaggcagaagctattgactagaaaggtgaatgaaggcagcatgtggagaatttcaaatcattcatatttgtatctgggtagtgaatgtgagtactttatttggctgagcagcgaacatgtttgcactttactcagggcacaatttattttgatttataaaattaacagcaaaccaagaccctttcaacacacatgaagaaaaaaataagaagcaccaaatatttacagaaactcagccgtattaaagagaagtgtaataagcactgggaaaatactaggaagtaaaaaaattgacagtaaacacagtaaacatagaaatatatcctgtcccaatcaggctgcatagattgttatttctgccagttttttctcaagcatacaaaatatgttgttcataggaaaggcccccatacccctgcacatatcatgttatttctacaccactgcacccaccaggggatttgcatattgtcccccagggaggaccttcccttgcaagtctgagataaaagctcagcaccaaccttgacttaactaattaggactcctcaggtcaccttctcacaatgaggctccttgctcagcttctggggctgctaatgctctgggtccctggtgaggacagaagagagatgagggaggagaatggggtgggagggtgaactctgggggccccattgcctcccatgtgtgttctgtcctcatgttagatgtgtacgtcttgtactccaggatggggcttgtaacttttatatctgcgtgagtaaggcatgtgaggtttagatctgtaagaatgaggaagattccagaaggaacaaagaccagtgctccggtgaagactctaacagagaaagagggaatggtagaggaaacttctagcactcaaagcactctgctgtgctttgaaaatatgtttttattttgaaattatatattactagggtctgaatcaaattataaaaattgatttagcctgaaataaataacagaagaaaaattattttaaaattgtgcttaaagtttctacataaccttgcacttctctctcattatttcaggatccagtggggatattgtgatgacccagactccactctcctcacctgtcacccttggacagccggcctccatctcctgcaggtctagtcaaagcctcgtacacagtgatggaaacacctacttgagttggcttcagcagaggccaggccagcctccaagactcctaatttataagatttctaaccggttctctggggtcccagacagattcagtggcagtggggcagggacagatttcacactgaaaatcagcagggtggaagctgaggatgtcggggtttattactgcatgcaagctacacaatttcctcacacagtggtacagctctgaacaaaaacctcccgctggagtggcccagctgctcaagtgtgttgtttctctggggagcagttgaacagaatctctatctgtatgagataaacatgttggagaactcagggcaacaggttgcatctgagggttctgtcccatgggtgcctcagttgtacgtcaggcaaaacccgttcacagccctgtcagctgcaacagccttggcatggcataagccataggaaaccagaggtgatcccagtgcctgcacaggtaatagactgccctgagggagagcttaagaaaatcctattccaatcctccctgccttgcctgcattgggaaataagacttaaagaggtaaataaccagacaagtaacccagatttgttgcaacacttcttgaatatatcttgaggtttagaagtttaaagtctacatttaagaggataatatgtggtaatatccaaaaattgaacttttcaactttcctaacttcttatttttctctttcaccacctatcttcccaccacatattgatggtggaaagagccttccgcacaagctgtcatcatgaggagctggatgagggcaattagtgaaaatcttggatttcagcctcagaatggacttttgtaaattggtgagagatagaaaatatgaatgctaaaattattttattcacttcaattgtgtcttgctgacagaaaaggatagtttttgaaatttcagaagttgagtttcataaacagaaacttaaactataagacataggttatagaatttacctcatagaacactgaaataacacagaatgatatgcgatttctttccccaaaatgtaagagtttgaagacagtgggcagacttcaagaatgggagaattaatggaagatagtggaggtcaactatggcccaataacctgctctttgacttacattaggtacagttgtggatgacagtgactgttgggggttggtgatataaactcagaaaggagcccaaatgtctttcttatgaagaatcacagaggagaaagtatcactccctggctccatgggttgagcctgcaccactgcaagtttcaaggaaaagtagttcatcaagaatgatcttttagttctgcaatcatcaaatgtttattgaagttcctgtgcaaatagacctgaggttctgtgactcagtcacagtcaaactaaaataacccagcagatgccatatggttgggtttgagaacacaaatcatgcagtggcatgctaacctgaagtcccaatagagtctacatcaactggggagcagtggcaatgatgaccaatatatccatgattcagacatgtattatgaatggtctgcgcagaatttatcaacaacaaaaactccatgaatcctctgtatggggagtttctgtctttctagaccagcacccaaagactgcacatgtcatcaaaccacagccaatgttccatggagaacactatctgtgagttgaggctgcattgtgcaaccaaagaggcacagccagattctcctttcacagatgagtttctctgcccgtgccaaagcagaacttgggtccaaatgccaacctggcaaatatggcaggggaacaaaaagtcaggtaagcatcagctcaattagagaggatttcctcaccctggaattttagattacctaggccttattctgtccactgttctctgatgttataatttcataaattttgtattttttgtacctttggcagcagttgctttagggcttttaaccacaatgttattgtacctgggagtggagataactttttcaactaaataatgttttagaaatgacaattttggtattcaattgtcatgaaaagaataaatggttttcaatatataagtacatgcatcattttcacacaatgtagtcattacatgaaaatgaacctcattcctaccttctagtagtaattgtatagaaaatatatagcttgcaaagatgacacttaaaataatgccctaaatgtatttctaaactaatcatgacatgatatgatcaaagtaaaggggcatttgaatcagcaggacaacatactcttttccttgttaaggaagtaaaccatattagaaatgactgtgtattccaagataatgcattctgtggtgagggaagttaaaattcaatttttgaggagagaaatccagaaaaaaatggattatggcaagacgtttgtaacataggcaaagaatgacaatccttcaaagtatttttctgcacatattcaaaagtggagacacacatgcagtcaaaattttaatcattacatactcacaatcacttctgtggggcctggagatactgcacatacgactgttagcaagacactcactgggacgctgcgttgtgtgatggccccacatacaaacctcaaggaggctcagcctctcaatgcagcaggagcagctggggtacccaggccacacgtccataccaggtgggctcagttagagatggctggagagccttccaggaagaggccatgaggtttcagtcacaaacactggctcctcttctgtgtaaacaggggctagagccctccaggacaattcctagagcctctcgctttctctccaattagtgcactgacaccccacagattctccaggaagtggttgtcatgtcctccctgcaacagccactaaagttccctactgctgtcatgaatgcagggacacttagtcacatcactgggaggcgaccctagtgtatcctgacctcacctgctgccactgatgactttcagggcacctctttctccctttgctgagtgactctcactctcaccaaccatcaggagaatggaaagctgcctgcaatgcatgatgttggctgttgagcaaatcaaagctcacaggagtctcaaacatgtacaccacataataatattttctgataatactatttggacttttcttcctttcaattctggaagtaattgagaatattttttgaactcttagaaacacttagtatatatgtgtagtaggtagtaactagttttgtctactggtttattttgtttgcttgtttcaggccatgatgcggcatgttaaaatactgaagacaaagatacattttagaattaagcatactgtacattggctctttccacaccactgcaaccaccaggggatgtgcatattgtcccttaggaatgaccttcccttgtgagtctgggagtaaagctcagctgtaaccttgccttaactgatcaggactcctcagttcaccttctcacagtgaggttccctgctcagctcctggggctgctaatgctttgggttcctggtaaggacagaggagatgagggaggagaatggggtgggagggtgagctctgggggccccactgtcacccatgtgtgttctgtccacgtgttggatgcacgtgtcttgtgctccaggataaaatgtatggtggcacttttatatgtgaaagagtgaggaagattccagaaaaagcaaagacctgtgctctggtgcagattctgacatagaaagaggagggtagcataagtgacttccaaagggcaacttgggccttcaaaatgtctgttttttttttaattaaatttttttggtgcatgaatcaaaattacacacacactcacacacacacacacacacacacacgcgccgcaatacaattatttagcattaaataattgtagagaaattatgataatgtctcatgatttacataacattgtacttcttttttatattactttaggatccggtgggaatattgtgatgacccagactccactctctctgcccgtcaccaatggagagccggcctccatctcctgcaggtctagtcagaaccttttacatggtaatggatacacctatttgtattagttcctgcagaagccaggccactctccacagctcctgatctgtaggacttccaatcagttttctgccttcccacacaggttctccccagtgggaggagagagtagaccagtcatccccagatatatcacaggactagtttcaacctttggaagctggtctatatcctatggttaaataggcatttgtgatacgacctgaaatacatttggacaagaacttcactaacaattgagtcactgaagacttacggccctgtgtgacgcaccacataactgtgagtttgcagtggttgcaggtcagggacagattttatgcttaagatcagtagggtggaggctgaggatcttggctattacaactgccaccacactctacaatatcctcccacaatggttcagcaccaaacaaaagcctcctgcttggattgtcccagctgcccaaattagttccttcactgaggagtagacagggtatattctctaaatctatgtaacaggaagatgttggtgaactcaggggattagtatgaagctacacctcaggcatcacacataagatcacttcagcagtcgcagccttagcatgggcagaacctacagaagatgcaagtgccctctgagccaggagacaggaggaaggaggaagggaaaggtgacttagctcatctcaatcctctctcctttgcatacatttgtcaaccagatgtattcagcctaccagtcacacaactgaggctgatacatgacaacatagcactggtatattcttggtattgtttggcttagcagttactagtatatatttaatgggagaatatttggtggtgttaacacattgcttatctccctttccccagttgtactttacacttgttcttggcacacattctcctccaggactggagcattcacagggttttatgttactgttcttatgggagtaaaaagaaaaacgattcacattcttgctactgagctaggctgggatgccctgggccaagctgaaaatgtgaaaaataagagtatgaatatttattaagttttatctggatctaagatacttatccatgaaccagtcctgcagctgtgcccagcctgctccattccctgctgatttgcatgttcccagagcacaaccccctgttctgaagacttcttaataggctggtcacaccctgtgcaggagtcagtctcagtcaggacacagcatggacatgagggtccccactcagctccaggggctcctgctgctctggctcccaggtacggatggagaacactaggaatttactcagccaatgtgctcagtacagcctggcctttcagggaaatcatcttataaatagttgtgtggattatttgtttttatgtcccaggagtcagatgtaatttccagatgactcagtctccatcctccctgactgcatctgtaggagagagagtcaccatcacttgctgggcgagtcagggcatttgcaattatttaagctagtatcagtagaaactagagaatcctcctaagctcctgatctatgctgcatccagtttgcaatctggggtcccgtcacggttcagtggcagtaggtctgggacacatttcacacattctcaccatcaggagcctgcaacctgaagatgttataacttattgctgtctatagacttacagcagccatcctagagtgttacaggtcataaaataaacccccagggaagcagaagtatgactcatggctgccccaggtgcttccactggtgcctccatctgctgagagtgtttctcaggtgcagccaagatttaaaggtttttgtaggaatggccagaagtctcatctgcattctaactctttttcttcctgcttagccccagcagcacagacatgacactatctctcctgatttaataagggatagcatttacgatacctgaagaatctgtgttattgcatccatctgggtcatagattaaaagagaaaccactctacagattgccagaaggcattgttttaatacagggaattagagttgaatatacaaaactgggagtgtggtagttagggaagctgacactagaaacacgggagtctctggaggtctgccagaagccagagttcatcagccgctaaaggcatgggctatctaaccatatagtcttctttgtctaggaagtccgtatgcgaagatgctgatgctatcagttgttgcagcacctcaccaggtgattctccagtccttatctcagtgaacatgtttgcctaccggtgtcaaagaatattgaatcgccttcttcttaccttcaaatatgatgagaggtcttctctttgagtaactctacaagaaaccatagagggtttaatgtgtttcaggaaaggtgcttttagaaatcatggtgaatatgaggaattacagccaagtgagataagtatttcccaaaatctcagaattttccaggtatggggtggcttcagaatacatttggatgttcttacatgtattattagaaagtttggtattattgcaagaaaattttattaagtcgtaaagtaaaagaaaaaaatgacaacattgcttgaaatacatagcaatcctttgacaaatgaaaaaaaattgacaaaacaaacaagaacacctataggtgcacgtagcatactttttccttaatataagagcactttgctacttaaaatttgtccagattccagtggcattctcagcgtcactatgaacacagtacaaatgcaaagtagcagatgtgctttagaccttgttgcatgataacctgcacttcaactagttaagaggtaacgtacgggtgtttcaagaagccaagttttagaagacatttactttagctaaagatttttttttcccccacagtgagaacatttatgttaaaaccacttaaaaatatatgctgctttatttctaattaatgcaaaattacattcaaaaatatttttaatattctaaaagttgaaaaacaattattttttatcaatggatcaaatactttgatagttaaatgcagtaaacgtttttagaaactttaggacttaacaaagtaaaagaataaattaaattgtgttcactgttttagagaacattaggataccatttgcctggtcagttttgtttgaaaattgtgttcctttttgctgccttccatacaaatgttgtgtcttggctaggcccttccttgatcccaaatgaaacacaatctagaggcagaagaaccactccactaagctcttccttgatcagccacatcattgttatcataaacatctattaacaagaaaatatctgcttagttttattatccgctgagttttgagcagtggataagtgcatgtttccgtaagtgcactttttccataagtgaggtgaatttcacttaattcatatcatttagctttaatttcctctaagtgtctttataaatagatgactaaatatttatatttatgctatcagatttgataacatgcatctatctatatgactggatgtgtgaatattatattggtcagctttcacccaggtggtcatgtcagaaaaggctgttagcttagcctgagtgtagaatttctatcttagatcacatatatcatgtgtcttcctgtcttatatccctgtgtcttcctgtctcaccaattatctagattcagtgaatggtgtgtggtacaagacttgtaggaactaaattaagttgtgtggtcccatttcttttgtttctaccctaaatatgcctagttgttttccctggtgcatgacagaatatggttggaatgaagagttattggaactttatctcccaagtacacctttcacttgctgcttagggatcttttctgagggccctgaagcttcctcaaagagcaacactcaagtacccacagtgctgcaggtgcaggggtgaccacaactgcacagatgagaagcacccaggctctgacccttcaggttaccaatgccatttccctgaagacagacaatcatgctgtccatgcaggtaacagacaatgatgctgtccatataggcaggggacaactccttgggtgatcctctaatctacacaccgcttgattctgtgcaatgcttatatcaatccagagtcaggttctcttctccttaatagttcccagaacctctgcttacaccccctgaatctcatttcatatactgctgctcctttcctttaatcagttaaaatcgtttgctttttcttcctttctcttaggtatcaaggaagcagttttattaatgctgctctaagtttcaattggatcttcattcattctggaaatagagtcaacaatatttatctaactgtcaagacgttatcttggcaagccctgaaatcaaatccattgtgttggagacagagctttaatccttatagattatgtgccattagtaaatttgcttatgtgaaactttggcaataatagaatctacctaaaaggtctctttacaatttatacaaggtaaagcatttacaatagtatctaatcattatatgtgctggtattaattttgttgttactattatgataacatttagcactgtaatgatcattattatcatcactagactaatttagaagagagttaggagaaacaatcttaattctaatccaaggatgtttcatctatagccacattagtttctgagatgggattttcactaactgactcacaattcttaaaatgctaatgatttgttcttgatctatactaacttgctcagaccttcaatcatgcccacccagatgggtccattgcatttcttctcatcattcattatcataactttatcctatgaaaggttagaatgtcatattgctgtcctttcttacataatctttattctgtctttttaaccttttctcattttttctactacatctgccataactcaaaaaccaaatctcagttttttcccaggattggcatgcttctgtgctaaagatgttgttcattctcttactttctggatttctacgggacaaattatttcaaactcaggcctttctaatacctcagaggtatagggcataaaagagaaagaaaaagcatatgtacgagtgtgatttgacaaattgaaaagtcacttcacctttttgtgaagtcatctattctttcttgcaagggttttcaagttgtgcctatatttttaaacacgtatgacttcttcaaacacttttcttctctaagtcttttcctccaaaagccccagtcagattaactgtatccagtaaagtatggttggcccttctctgatatcctctctatatatacccaaaagtttccattctcttctaacatttttgtttcattaccatccaaagacaaaattctattaaattttcagataataacttaaaaatttggagaagtacatatttctagaaataactgtcatgcatatgtagccacatgttctttaactgagggaccagaacctcgtatttccagaaagagtgtctgaactgtgtgcatactaaaatggtacaaatggtatctcagtctcctcagcagaagtagctcagggcaagctgttcctatccatttgattcttgcagtattccaagtgctagaaaattatgtttttccaaacagttgattcagtaactgctgttcatttgttgataccactacattttaataaatctcattcctctgggttttttttcaggctattaacatttaaatggtaaatggccatcatagtaacatttgccatttaaaagccagctcatttatttgttcaatattctctattgtacagtaagtgtgaagagggttaaagcctaagcaacataaaaaaaaatagtttcagacaggaataggttatttctcagaaagtcagcaaataaccaaatacaaagagtgatagaagcagctggcttaattagctttgtccaagacctcctttcagaaaccagaatctttgggacacagcaaaagcagtgtttaaagggaaatttatagcactaaatgctcacgggagaaagcaggaaacatctaaaatcgacacccttacatcacaattaaaataactggagaagcaagagcaaacaaattcaaaagctagcagaagacaagaaataactaagatcagagcagaactgaaggagatagagacacgaaaaactcttcaaaaaaaatcaatgaatccaggagctggtttttttgaaaagagcaacaaaatagataaaccactagccagactaataaagaagaaaagagagaagaatgaaataaacacataaaaaatgataaaggaggtatcaccactgatcccacagaaatacaaactaccatcagagaatactataaacacctctaaacaaataaactagaaaatctagaataaatggataaattcctcgacatatacaccctcccaagtctaaaccaggaaaaatttgaatccctgagtagaccaacaacaaagtctgaaattgaggcagtaattaatagcctaccaaccaaaaaaaagtccagggccagatggattcacagccgaattctaccggtagaaaaagaagctggtaccattccttctgaaaatattccacacaatagagaaagaaagaatactccctaacttgttttatgaggccagcatcaccctgataccaaaacctggcaaagacacacacaaaaaagaaaatttcaggccaatattcatgataaacattgatgcgaaaatcctctgtaaaatactggcaaaccgaatccagcagcacatcaaaaagcttatccaccatgatcaaggtggcttcatccctgggatgcaaggctggcttaacatatgcaaatcaataaatgtaatctatcacacaaacagaaccaatgacaaaaaccacatgattatctcaatagatgcagaaagagtctttgataaaattcaatacctcttcatgctaaaaactctcaataatctaggtattgatggaatgtatctcaaaataataagagctattcatgacaaacccacggccaagatcatactgaatgggcaaaactggacacattcttgtcaaatactggcgcaagacaaggatgccctctctcaccactcctattcaatatagtattggaagttctgggaagggcaatcaggcaagagaaggaaataaagcatattcaaataggaagagaggaattcaaattgtctctttttgcagattacatgattgtatacttagaaaaccccatggtctcagccccaaatctccttaagctgataagcaacttcagcaaagtctcaggatacaagatcaatgtgcaaaaatcacaagcattcctatatatcaataatagacaaacagagagccaaatcatgcatgaactcccattcacaattgctacaaagagaataaaaaacttaggaatacagcttacaagggatgtgaaggatctcttcaaggagaactacaaaccactgctcaaggaaataagagaggacagaaacaaatggaaaaacattccatgctcatggataagaagaatcaatatcgtgaaaatggccatactgcacaaggtaatttatagattcaatgccacccccatcaagctaccattgactttcttcacagaataagaaaaaaatactttaaatttcatatggaactaaaaaagagcccacatagccaagacaatctagacagaaagaacaaagctggaggcatcacgctacctgacttcaaactatattacaaggctacagtaaccaaaacagcatggtactggtaccaaaacagatatatagacaaatggaacagaacagaggcctcagacagatgctggagaggatgtggagaaataggaatgcttttacactgttggtgggagtgtaaattagtccaaccattgtggaagacagtgtggcgattcctcaaggatctagaaccggaaataccatttgacccagcaatcccattactaggtatatagccaaaggattataaatcattctactataaagatgcatgcacacatatgtttattgcggcactgtttacaatagcaatgacttggaaccgacccaaatgcccatcaatgagagactggataaagaaaatgtggcacatatacaccatggaatactatgcagccataaaaaaggatgagtttatgtcttttgcagggacatggatgaagctggaagccatcattctcagcaaactaacacaagaacgcagaaccaaacaccgcgtgttctcattcataagtgggagttgatcagtgagaacaaatggacacagggaggagaatgttataccccagggcctgttggggggtggggggctaggggaacagtagcattgggagaaatacctaatgtagatgacaagttgatgtgtgtagcaaaccaccatggcatgtgtacacctatgtaacaaacctgcacgttctgcccatgtatcccagaacttaaagtataataaaacttttttttaaaaaagggttttattgttcatattaattgatcaccattaataggatatgttgacattttgtaattcttgctgtgcactgaggttgcaccccatttttttgtttttgtttttttgctaaaaataaaagatatgaatctaatcagtagaagacttcaaacaaatgcaacttaagggattctccaaaataacttgccagtacacttcaaaggtttcaaaatcatgaaagacaaaactaaaaaactgtcacaatttgggaaatattaaggacacaataattaaatgcagtgtgggattttggatttttttctggaacataaagaaggagattactgaaaaaatcagtgaaatacagaggggatttcaaattacttaattaatagcattgcatttatgttaatgctttggtattgatacttaccctatagttacgcttgatgttgacattacagaagaagctagtggaagagtacatgagaacaatcttattatattatgcaaattttaagtctaaaaacatttcaatgttattaaaatatataaataaaaataattaaaacataacaaaggacatggattcttatgaaacaatttcacaagattcatcatgttttcatatttgtgtttcaatcatctgttaaagacaatcctggctcccattatgtagagaatattcacttacttggtcaattctagaatatgcataaggcatattttacagatttgtagtgcattccctgaaaatgtgaaatctagtgattagagttacatatatattttttttattttattttttattttattttattttattttattttattttattttattttatcttattttattttattttattttgacagagtctcactctgttgcccaggctggagtgcagtggtgcgatctcggctcactgcagcctccgcctcccaggttcaggcgattttcctatctcagccccctgagtagctgggactacaggtgtgcgtcaccaagcctggctaattttttgtatttttagtagagacggggtttcaccatgttggccaggctggtctcaaactcctgacctcaggtgatctgcccacctccacctcccaaagtgctggcattacagtcatgagccaccgtgccagccaagagttaatatttgttaagtgcacgatttctcttcaaaccgtgggtattgagttcaaattctttacttcagaattacttatgttttaacatatatctatgtcctttcagtgttgctgtcatattcattaaaattcattttagaaggcatctctctttattgtgtcacagagagattgttaaatcctctcagcaaaaatatatgagaaagacaaattaagcataaagctaaaaaatatcaaatcggtttcagcgctctgacaattggcaaagtataaaacatttaatactgtatactattcataacatgaaagaatatgttttgagtaaggaaggaaattatgtctgtagccttttgcctgggatttctcccttccatctccgctctgtcagcatgaattgcagatctggggttttaatgaggatgtcagcttgcagcttgcagtcgaagggagtggacttgagttgaggtggagagtcaagcaagatccttcagtgtttccagctaaatgtgatgaattctgcaggaaatgaacagagcaagttagttcaaactgaggtctctagctggggcaagtggtacaccagctgaaagttactagtggactcctggaagtgatggaatgatagaattgctaaaataatgtctgcacagatttctggtgacttaaaagctgccgttatgaataacagggatcaaaggtggtgcagtgaaaagtaaaacagagggagataagaactggctacattttgtatacacttttcagaacacacacagatgaataggtttatgagtttcacacatttgggaaaaacgtttgcccagctcattgctatgatcttcttttccaggaccttagccagccagctattcagaaatctatatgtatacttgactccagacacttctctatctactaatttgatgaacatgtgctctgctcagatgtaagataactcaaggtagtatttgacagccatgcatgaccgttgccatagtgtggacacagtccacacttacttacacaaacatatgatgccaagccattcaagaggaagcccagcttgttctcatttttgctttgattttctttgtttttgcttattttcttttttttttctttttctttttttgtattctctctctggcattagctgatcaggaaaacccatgatatcatagagagagctgatgcagaggtgttaagttgagagagaaaagtgatataaggaactggaacatctgtctatggaaatgaagcatgccttctgaatctgcttgaacccagtcactaaactaccatctgcatcccaatattgaatggtgctgagcttcacctgatcttaaaattggtgagagtgacattctcagtttatgaggggcagcttagtcacttaattatttagtcaaacagtcaattactcatggacatgcctacatggaccctgtgatattttgagagctgcattttgagtagtgagttgtttgtgtgttgtttgtttgtttattttgggggcatttcaggatcttgctcaagaactgtagagatttttttctgtgactcttttttggtgcttgcatggaggtttacagagtttcctcatctaatatagattatctagcaccaggcaatgtgctggatctcatggctgaagtgacagaggcatttgcattaaaactcaaacttactacagaatattttctttctcagagtttattcataaaagacagccttccaagttagctgataaatgggttggtatagtaaacccaagtgcaaaatgcattgtcaacactctaggatggcttaaccagtaatgtgcttcattgctagtggttggaagtacaaggtgcaattatttttccttactttggaggggataagccagcatgactcatactccttttataaacacttgacatcttctctaatgtgacaagcccttgatgttttggggcgtgcatcccaccctctagagcacatgtgttttcacaagaaattcagagttcttacaatgtccagctcatcacgtctaattaccatgatgtcatcaatatagtgttgatgctttgtggaacgttcacaaagctttttcagcctacattgtgacagagagcaggagagttaacatagccctgggacgagactgaggatgtgagctgttattcaccccagataactgcagactctcccagagatggcgatggactctgccttcactctgcagctgtgccctggggtcttggtcaagccctgccagagcctcagcggagctcgtctgcaggtgccagcagagggcgcttcacacccctcatggaaggggccgggagggcgctctcctggcaacagtgatttctgtttatttaaaccagcaggacatccccataatttgcatgtatcgttcctcctatatgtgaagaggccctgcctctcggtatcttaaaagaggttctttctctgggatgtggcatgagcaaaactgacaagtcaaggcaggaagatgttgccatcacaactcattgggtttctgctgctctgggttccaggtgagaatatttccacaaacctaggcggagatattctttcaatctgtaatttctttcattggggactctgcaataggtgatttttggcttgattttaaaatcctaattttaaaaatgtaatgcatattctttcttcatgtctagcaagattaaaggtgattttcatacacagatatttatgttgtactgatgtttgctgtatattttcagcctccaggggtgaaattgtgctgactcagtctccagactttcagtctgtgactccaaaggagaaagtcaccatcacctgccgggccagtcagagcattggtagtagcttacactggtaccagcagaaaccagatcagtctccaaagctcctcatcaagtatgcttcccagtccatctcaggggtcccctcgaggttcagtggcagtggatctgggacagatttcaccctcaccatcaatagcctggaagctgaagatgctgcaacgtattactgtcatcagagtagtagtttacctcacactgtgttacaacccagaacaaaaactagttcagcctggctgaacagagaaactgggtgataccctagaatacttctgattgttacaggtgctttggaggcaatgagttaaccaatacaatgaagtctggctcacccagcagagaggaaactagagtcactgctgcatactttcatctttttaaaaatgaattattttatttatttcaatagtttttgggggtataggtggtttttagttacatggataagttctttagtggtgatgtctgagattttggtggacctgttacctgagcagtgcatactgtgcccaatatgttgtcttctagccttcacctccccttctatccttcctccccagtccccaaagtccattatatcattcttacgcctttgcatcctcatagcttagctcccacttatagatgaaaacatataggttttccattcctgagttacttcatttagaataatagcctccagcttcatccatgttgctgcaaaggtcattattttgttctgttctgttttatggctgagaagtatttcgtggtgtatatacaccacattttctttatccactcgttgcttgattggcacttatggtggttccatatttttgaaatggagaaatgtgctggaataaacatgcatgtgcatgtttctttttcctataataactttttttttctttgggtagataagaaaaataagtactgggattgctggactgaatggtatttctacttttagttctttaaggaatctccatactgtttttcatagtggttgtactagtttacattcccaccagctgtgtaaaagtgttccctcttcaccacatccacgccaatatctattattttttgacattttaattatggccattcttgcatgagtaaggtggtatttcaaggctatggttaccaaaacagcatggttctagtataaaaataggcacatagatcaatggaacacaatagagaacacagaaataaacccaaatgcttataaccaactgatcttcaacaaagcatacaataacaaacagtggggaaaggacaccctattcaataattggtactggaaaaactggcaagccacaggtagaagaataaaactggatcttcatatctcaccttatacgaaaatcagctcaagatgaatcaaaggcttaaatctaagaactgaaaccatataaattctagaagataacattggaaaaactcctctagaccttggcttagtgaaagaattcatgactaagaccccaaaaggaaatgccacaaaaacaaaaaataaataaatggaacctaactaagctaaaaagcttctacatagcaaacagacaacccacaaagtgggagaaaatattcacaaactgtgcatctgttgaaggaataaccataatctatgaggaactcaaacaaatcagtaagaaaaaaacaaataatcccaccaaaaagtgggcaaagaatatgaacagacaattctcaaaagaagatatacaaacagccaacaaatacatagaaaaatgctccacatcactaattatcaggaaaatgcaaattaagaccataatgacatactttcgtctttacccatatttactttcaaaatacatggacagttgttgaaggtcacctctcccttttctttccataaactatcttttacaagttggtaaaaactttagatttctcttcagagctacagtttctcatttatggcaaaagagtttaaaagggtaaagattaggaaacaagcaggtgatggcctagagctatagtgacagaagattcccatggattgaggtttcagttattgtgggttcacgggtgtgacaaattaattctatttccaaagcagccccctgaagcatgtttgttaagtcagattaacgttaaggttcactttcaccagtgcggcattcaactgagaattcaggaaatgctgaatatttgggttgcgatttctgaaaactggtccacggaaaatgtaactatagacatttctcttggaattttgaaaaggagacttttccaaaaagaacatttacctggaataaaaaaccagaaggatccagagccctttgttgccagtctagggagcaggacaagattccaggcccaaggaagttgaaattaagaatcctcgattccctaataagaataacttcaccaaaagttgagtgtaccaaggcactaacatgtcagagaaaatagtctgggagctcagatgaggtggaaaactcaatgggcattttatgttatatcttgccctgacatatgaaatacaggggggcaaccctccaccctgagagtaaatattcttttctgtgtatcagaggtattgtttatgtcctctttcatccacctccaaaatccaaactgcagtttgaattttcttattttaaaaaaaaatttcaccattcttgattataggaccagtatcctgctcctagaattttttaataccaagagcaactcagcttatttgttttactttgtttcctgtgcacattaagtcactcattcaaaaataatttttggcatacaatgtagtcattgagaaaacagacatatcagatttggtgatatttttgtgagtgactttcaccgtatttggtcacaaaaagttatatcggttttcaatacattttttatcacatatattttacaccaaagtgcaatgatctactacaagaaattgtatttctacattatggtatcaggcagacagtcaccagttctttcacagggtagtttcaagttgcagaccctcatgtagagaaactcaaattgtgtgccatgattggttaaacccaaatggcaagaaaaggtgaggaagaggtaacattttgtgagatacttttgtttgaatgtctgtgagctgtttgtatgtgtttagaaacatgctgtttccaacccgtattccactcatgctatgactattcccaaagcttccccaccaggactttcctcttgtatcaaaacccatggaaaaaggaattactcatagtcatgtctggtcctgatattggatgcttgcctgaggtcactcatcacaccctcccccaccttccagggacagacaccctgaccctctccatcaagcccctcccactgtgagggcctttcttctgcctactggacatcttacatgcaaatcgagtttatctaatttcaagatgatgcttgttactcctatatatgtgtttttttcatgtccagtggatctttttcaactataaaagtagttaattgtctttagctgaggggaagccatgatatcttcttcaataaaaaataaacatatttttgcatttaatggattttaacataatatcagagttttcaggaacaattcaaagccatcatgtgagggttaggagcatttgagtaaataagacaattttgatcccaagtactgatattcagtagggaaatgagccattcagagaacaatacctacacagtgaaagtgaaaagaatcatttcaatagctgataaattgtataaaattcaggcagtggcatgtggtatctggaggccgagaccatttatttgtgcggaccagggaaggtctcggggtcatactggagatgcatctgaacagtgaggaggcagccacgtgaccataggaacagcaaagaccatgggatcatcacgagaagggcagggactgggagatttcagataaaccattgtgcattgaaaacgccaaccagtaccataataataagatgtcttctgtgattttattcctttcaggagaaaatttatactaatatctttcatcaaacaccttgacctgggtcacacccataacatgaaatgttccctggctcagaagctggaagttcagttttgcatccctgttgtaagtctgcaggctccacaaagcccctccctgccactcaagcccttatcagtgggttggttgctgcctttagggtgggatcacctgaggcagaggaagcactggacctgaggctctggcccttgggtcctggcttcagctatgggagctccatgtgacagggttcttatgtcccgtgctgagatacagaccatcgctcagcaagcccagcattcatctcccacttgatcagccaacacgagtctctgggaggcctgtagagtgagacatcattaacgctggggaagatttgtgttttgtttccacctcagattccagtggcaacattgtgggccccagattccagcttctccctcagtatctccaagacagagagagagtttccatcaccagcctagaagcagatgaatccagggaatgtttcaaagatccacccatgtgctttgtctacattggccatggtccaccccagcttggcacggtggtcttggggcagacacttccttaactttcagcagcttgggtaccctgatgacattgctgattattattgtctaaaactgtatcctctcacagggtaaacacttgcagtgcccagccacaaataatgtgaattagaattaaaaattaaaaacatgttttctcagttacactagctacatttcaagtgttcagtagccacatattactaatggctaccctattgtacagcataaatgtagacatttttattgtcttagaaaattattttgcttaaaaccgctctaaatgttgacaagtgttccctcattgtgttatagctcagagcataaatctcaccagctgttagtctggaaaactgggagtcctcagaagctctccagctggtacaaccactgtggtcctcagatctgctctggaagactttccagaataacgggaatgagcctgggctgacagatccagaaaagaggaccttggatttcctctccagcccctgccattatgcccggcagggtctctcacacccctttttctctcttccaaaactacattttcagcatttcacatggatttcagaacctaattcctaatcgttttgtgagcaacatcttttctggatatcctttgtcctcaactttgggactggtttatcaaggagaggtgtcattctgtgttccttataggatctggcctactgatggatgtaataggatctgtttcatcattacccatgaaaagactcaccgtcaagattgactgggactcagcatctaaaatcctataagatgctatgtcaccaaccagccattagatggcagacaaaccccacagtaaacaccagaaataagcctgatcttagaaatactaggaaaatcaacagggatattttagggctaaaatgaggtctcatttatgacctagattacatgggaggagctgccagtgcactgagttgtgggaaactccctctgtgctctgtgctctgagattggaagcccagccttttcctccccaccgcgttggctgtatccccaaaccctacctgatgtgggctgaatccaggcagaggggaggctgccaatggtccctggagtggtttctccctgttaccacacagccactgggccatgtgtgctactctgtctcacaaaggccaccaggggaggacctgcccaccctgagctctggggacaaaagtccctccagttggggtctagacccactgcccatctccccagcacctgctgctctgtgattccccagacccccgtcaggacagtcagtgtccttagcaatgggcagggaggtaccgctcagcccagaatggatgtaggtttggtcctgagcttcctgaccctcaggctgtgtagtgatgaaggggccatggggtggtgcaaccattgctggttttaaatgtttgtgctcaatttatcaaagtttaaaaatcatatcttacactgacaattaaagttatatctattaacatataagtgtgcatattatacttattcctaatatagatgcacagtatatccaaatgtataaatataatttatatctaaaatattatatgtatatttaatatgtaagggttacattacaaatatatacctatgcatgtaattttatgtttgtttattacttatatctaaaatattatatgtatatttaatttgtaagggttacattgcaaatgtatacctatgcacgtaattttaagtttgtttatttagcatgtgctctttttctttctaaccagaacagagcctggctgagtaaagactctggggacatttgctgttcctccctctttgactccagcagggccccagccatgcagaatcagtgaggacagagctgagagcagccagctccaggagctcaggcccagccctaagggtcgtgtgtctgagactttcacactggcagtggactctatgcttggtgcagcgcccatagaagtatgagcagtttccttccctgaaaccctgccaggcagctctgtgggcaggacatttggttcctcccaagtcctcagccccatggctcaagagagcagctacttcctccacagcccagggtcagagcccagcagtctaaagtagtgcaagcttcaccttagtcctgggttgaggaccctattccaaatctctcctcatttattcccataactgaaagcgtgtcctggtcttaaatgcacaggccacatttacacaattcttaaagctaaagatgtcatatgagaaatcagaaatttgatttcgttttcatcctcagagcctggcttcttctagctgtatcaaatcaaagtgttcatacattctcctccctatacaacttaacttagaagcacagcaaaatttaaaatgtgacaaagctcttggcaactatgcaacagtcatccccttcttcctttggtgtatagggcaccaactgtgtcttgccgtacatggtgagggtggtgagtttctcccagcccaggatgggagcagggattaagggcacatgtgatcagctccaaaatgataatgtcagaggagtgggcagggatcatgggaaaatggttatacctcagaaaaggacagaaagtgaagagctttgctttgcatttcttcctgtaacagttaagagaggatatgatgcttagagctgctgcaatcctcttgagaccatggggcatttacaacaagaatgaaaagccagtgatgatgcaggtgcaaagcaaaaatgtagtaacaatctggggcctttcagctgtcaccaagctgttgtaccaaccttaagtgcttcaaccttcagacttcttgtcattacttaaaccattactattatttctttgacttgtttctaaaattattccaacttatctataaaagacacttaagagaaagatcctggctgggccacagactgtgcttcagaagaagaaacatattatcagaagtgtgtgtgcttgtacgagtctgaggcatgaagggcaggaaacatgataagtgatgttctccctggcacctttgtcctgctatgcccatggcaagagaaacccaaacaatgccaaagagttcctcaattctgctctttcattatctccatttctccttttatatcctaagcatgaaacatccctttgttctccttaattcctcccttttccaaggtcatgaattgttgtcaagaaagagacaggaaccgtttgaaaagataaaacctggtgatactgtgcatctcctcaacaccaacatggttctgcaagtttcctcccttctcagtggttttcttatgggaagttgctggctgcctcagccaggtctctgtcagaggttgcatttggagggtttactaagcaaagcttccaggtagttagtgctggattcccaggagagtagcaggatggtgggtctgtattcccagcatgcaggaggccagaatgagacctgggggaaggctgtgggtgtgggaagaatggacttagaactcagacctgtagccacggcctttggaacccaatagtgtacactaaacagatggagctcaggggaaatctggtttaaaggtgttatagtcatttgtcatcttgtttatgtttctagtgctacacaggaatggatttgtggaagtttttattgtggaaataatgcaatgaaaccccattgcctatagtgagtcacaggttagttgtagaataactattaaagaatttgatttgtaaatgacatatggttaataatatcttccatagcctctttttctaagatactcaagggtgcatttaaagaaaactgggtatataaaatgtgcgtataatgtgtgtgtgtgtgtttatgggcacacatatacactcttcagggtgcatcatttggttaaactctcacaataccccatgacttccaaagtgctccatttcacatatgagagaaccagctatgagagctcatgactggtttgccgaaagtcacatggtcagcaaatgcccaaagtcacatggtcagacttgggattgaagcccaggtctgtctggctttagtatgttccttctacgtggccactttcatcccatggttgagcccaaagcctataaataggaagaagggaccataaaaacagtgtggaatccacagctccctgctgcctctgtctcatgccaggctggccctaatcttaaactagcctcttctgtggttttctcttcaaaatataactctctcgaagtctttaaaaattgtaaatgactttgctttatattttggagtaggaacacatcttgctttcccctgaccctgttcacatcttctctttcccttccagtttctctaagtcttccttctcaggttccaatctctctaagtctttccttgtcaggttgtgttctaactttcctgccaaacatgaaaacaaacacacaaacaaacaaaccctcctctttctatcaggtgctatgagacctgatcccttaactctccaacacacattggaaaagagctaatcaaagggtttactctagacattttctacctaagaagaatcccggtgcaagttctcatagaaaatggtttacatctcttgtcaaaactggcaccagattataacaacatggaatgtttgggagaacagaggacaccacacactcagagacgtaaaagacatttttccccttgcattagtttccaattgctactggttaaattgccacaatatttctggcttctaacaaatttattatcttatggttctggagatgagaagtctaactgagctaatatcaaggagacatagggctctattccttctagaggctctaggagagagaatctgattctttcctttttaatcttcaagatgcctaggccgggcgcggtggctcacgcctgtaaccccagcactttaggaggccgaggcgggcggatcatgaggtcaggagatcgagaccatcctggctaacgcagtgaaaccccatctctactaaaaatataaaaaattagccaggcgttgtgttgggcacctgtagtcccagctacttgggaggctgaggcaggagaatggcgtgaacccgggaggcggagcttgcagtgagcccagattgcaccactgcactccagcctgggcgacagagtgagactctgtctcaaaaaaaaaaacaaaaaaaacaaaaaaaagatgcccgaacattcctggctccatgacccgttcttccatcactccagcatccctctccattgtcccagctcctatctaactgccaccctcctccctcccaattgtaaggacctttgtgattatattgatctcatctggatgatctaggaggttctcccaaactcaaaatccttaatccttaagtaagttgcatccactaagttttgggattttttttttttttttttttttttttttgctacgtaagttagaattcataggttctaggtactaggacatggacaggatgtgggcattcttcatttcacccacaattaatatcttccccacaattgtccttctctaaggtagaattaaaaatcagagggcatatttatgaagcaagagagctagaaaaaatcttagattcagggccctcaaatctttgggttttaaatgctgggggacacttattccactgcctctaatgtggacttcacaatgtgtagctagttttagaggctcctttaatttactaacccagaaaaaattcattgcacaaagacaatctaaaatagattagtaaagggaaattaattgcttcctgaccattcctgtattagggttctctagagggaaaggactaataggatagatgtataaatgaaagggagtttattaaggaatgttgactcacacagtcacaaggtgaagtcccacaataggttgtctgcaagctgaggagaaaggaaaccagttcgggtctcaaaacctcaaaagtaaggaagccgacagtgcagcctttagtttgtggctgaaggctgacaataccctggcaaaccaccagcgtaagtccaagagtccaaaagctgaagaacttggagtctgatgtttgagggcaggaagcatccagcacgggagaaagatgaaggtcagaagacttagccagcctagtccttccacattcctctgcctgctttctgcttttatcctagctgcactggcagctgattagatggtgcccacccagattgagggtgggtctgcctttcccagcccactgactcaaatgttaatctcctttggcaacaccttcacagacacacccaggaacaatactttgcctctttcaatccaatcaacttgacactcaatattaaccgtctccagtaaagactgatgaagagccaataaacacagaaaaagatgctccacatcactaattcttagggcaatgaaaacaaaatctaccttatacctattaggatggtttccctcaacagaaaatgaaaactgttcatgagaatttggagaaattggaaatcttgtggacactgttttggggatgtaaaatggtcacctagtataagaaactacattgcaattcctcaataaattaaaaatagaaatactatataattcagcaattccaccattggacatatatccaaataactgacaacattaacttgaagaaatatttatatacccacattcagagaattattgttcataatagccaaaaggtggaatcaactcaaatgttcatgcagggaagggtggataaacaaaatgtggcatataaatatatatgcaatggaatgttattcaactttccaaaggaaggaaattctgacacaggctcccacatagatgaacagtgaaggcactatgctcagcaaaatcagcaagccacaggactaatgaagtgtgatcccactgcagtatttgcagcacagtctccagttggctttggaccaacccagtctcctcccctttctcactcttagttttcaagaatcactgtagaatatcctgggaatgtaacatcctgagatagggcagtattggccaccacagcacaggctctgttccaatccccttgtgccgagttctggctgcatgttctcacggcccaataactagaagcagagaaactaggaaagaagggaatttattattgtaactggatacaggaagaaggtcagagataatatcaccagaccaactgcaagtgttataattttccttccctccttccttccttcctttcttccttctttccttccttccttccttctttcttttctttctttccttctctctctctctctctctctttctttctttctttgatgaagtctcactctgttacccaggttggagtgcagtagcatgatctcagctcactgcaacctctgcctcccaggttcaagcgattctcctacctcagtctcctgagtagctggggctacaggcgcccaccatcacacctggctaatttttgtagttttagtagaggcggggtttcagcatgttggccaggctgaaagtgttacaattttcttagtgcttatataggttggctttatgtgcctacgtgcagtaaaacatttgcctaagtctataggcaactaattttgtttcaactaggtcagaggccaaagaaatgctaattccgattaagctgtgagggccccagtaccttcaagccctgtctcctaaattctaatcagtgaggactgtggtaccggagtgattatttctatcttatctcatttacagcttggtccagagagctgccttagactctccagtgaatctattcaaacagctgcctctgttaccttgactcatctcattttattgacccaagacgggtcctggcactaggaatgtaaggctgtctccattattttgacttgctcgaggttagggagaagcctgtgcaagcctcccactgacctatgttttacttctagctttgatgcctgggaaccgattcccctaggtttaattatttgctcagtgttaaggcagcgctgtggaaatttgttggtgtaactggactgctacacaggcctgtctgtgtgactgtcatgcagacctgtctgtccaattgacagggagtattgtcctgccataccctcttgaaacaagatttccttcaacactttagctcagcatgatatgtgactccaagatataaaacccagggtgggtccaatccagagtgcctcagctgcagtatatatgaagcagtctagaccccatcagccccaggcagctttcctgagccttgggggaacagacctacaataaattcttggattttgctatcccttgctgcctgtctgtaaattgtaaattgcttcacataactagttgtgtaagggtgtttaatctccctggactcaaataagttggtaatcactgcacagttaacctgcttaacaaaattgccccattgagaagattctagtatgacagaaccatggcttattggtgaagtgggaagaatgatacctcccattacttggccaggggaggaccattagactggaaggtgcaaggcctggacatgcatctgggtgctttatggggaatgagggaggatcagtgggttatagatcactctctgcatgagtttagatgagctggctgcctgaattaaggcagagagaaaggagtgtagaaatgagaatgaggcacaaaatcctctggttcatagacacttgcataattgctcattcctggagccagagagctagggaaacgggtactcaaatggaccctaagatccctgagagggaaccaacatatgctatttgggctttcacacaaagggagactcactctctaaataagagatacagaaaaagttcagggaagtcttatgcagactgtttggtatatttgtttgataaagcaatatttgcagttccaaatttcttgatctaaatgtcactgttagggatacagccaatgactttgggtgctcaccagaaaccagtggccctagaccatgtaaaaataaaaggagaaaataaggaaatacttttctgggtttttgggtgccagagcccataggtctccattggggaaaatttaaccaatgacattgagaggttcagggacaaatgcagtggccatggtgcttctctgcttgtggatggtgccctgtgggccatgttggggctggtgactgtagttcccacctcagagtgcagtacaggcattgatatttgcaccacagaacatcactgctgcataaaaggtatattccctcgcagctaagaattcaagccttaacaaaagggaatatccactgaagcctacgacctaagctacgcatgactccgtgggttatttgacaaaaacagtactgtgtactaagtgaagaataagacattacctgtttttttcaagacttgctacaaatagattaaaatgttacatagtcccctgtcaccatggagcaactcagtttggcggggcaaaaagactttaggggaacagagactaacgatggactatttcacgttgaatgctaaggccacttggacaggaaaccaaggaaggatagcagatatagttaaacattgttggtactagcagcaaccattaataaaggacaacagctggtaggcttctttgagtattggtaacagcataaacctctctggggtgggctttcagtccccttagtcaaaatcaaaatcacaaacaaaaccaccaaccttgaacagagccctttgcaacagcagccttggaagaagttcaacaggacatggtccaaacacttcttttagacctttagagcctgttagcctgatggaagttcaggtgtccacagtctctatgtatgctgactgtagtatgtggcaacagaaaattgtcactgagtgagccagcctctcagatactgaacacaaaccagctgaagcagccaccagatgtccctctttggcatagcaactccttgcttgctatgggaaactgacagggactggacatcttggggctgagcaccaagtgtggcgctgctgggtgaactgctccttttcacttgggtgcctaaaatccaaccagtgaaactggacaggctcaatagagctgcattatcaaatggaaatggtgtattcagaatcaggcccagccagcaacccgtgggatccaaaggctccataaacaaatggcgagcttgctagaagggactaaatgacccatgggggatggtttggctctgcttttggctacccgaagtccaagattcagagacatgccgacatcggtatggcatggttcacttagggctctgcaaaacatgtagactgggggtggctaccatctagccagtggatgactattttctttcctgagactgataatggtcattccacccaatggtccaaactacatgcagtggtaatggtcatgcaggcctttctgccacctcttgctatatttttaccaactcatgggccactgccaacagtctagctatctgatcaggaaaatagcaaccgagtgactggactattaaagcatcccctctgtggagaaaaggactatggcaacagcttgccacctataagagacaaatatgtcactcagctggatgctgggtctaccatgaccacccttgagatgaacttatgccatgtttttggatgcccactgagactttgctttgaccaaggaaagttctttactgcccaaatgacgtcaatggacacactctcatgggacatgatggattttccatacaccttgttatccaaaggccaatggatctatttaatgctagaacagctgactcacacggcaactgaagagtgtacatcagggcaacctgctagtagagtggtaccccatctgactacagcaattggacattaaacactgcactgcagagcaagggaaagacggcacggaggtgcaggttgaaaaacactgagttgagtgaggaagaagttgggcaaggccagtttcctgatagagctgccactgtgaaatcccaaactcagtgtttccaatcatttttttccttttatagtgatgttcttgggggtgttgcagtttaggccaccatgataacccagacaggcctcctaactctaattggatggaatgattcccctgggtgccttctatgggttccacaggatcaagaaatatcagggtgttaatttccttctgctggtaggagggtcatctgattcctccattagggtggatgacgttatcagacatgtcaattttctacagtacttgacctgccttctagaactggacaaccgagggtgaaaggactggatcaagcaacaatggcaatgggtgcccaaagaggtagtagtctcagaacagggagagacagactgagtccctccactaactcagcccaacacctgtggatgagtaggggatgcctgagatcctggggtggatgggaggtggggcactgatctgtcaatctgctttttcttcaaggatcaggcagcagagacccagaagcttcatgtctttgtaaggctcttccaagccaacacagataatttgacaaaacactgtatctgcatcccagacctcaccctgtcacagactgaagtggttgtttcatcctactaagggtaaactataccagctatacagaataaaaagactggatagtttagaggatcacccaagaaatagttctttgcctgcatggacaaaaccatcttctgtctttagggaaatggtatcactaccctgaggatttggagcccaggtctcacttatctgtgcagttgtgaaagtcctcacacccacagtgctgaggttaattgaatgttactcttttaatttctgcaaagaatgagacagcttctggaccctcaggaaagatcactaacaagtaaatacaagtatatccggaagataaagttgtaatagactcttcctttcaacctgatccatcatgcatttagggagctgactgggcacaagttggagcagaaagagaaaaatgaaaccacagccttctattttgtttctaacagacttgtaccaaacattctgtggctcaatctaggtgatggtgagacaagaggacacaggggttaaattctgtggccgcaggggagaagttctaccctcagactgagccaacggccttttctggcctgatcacctgggcatgggctgctgagagcagaaaggggaggcagattgtctctgcagctgcaagcccagcacccgccccagctgctttgcatgtccctcccagccgccctgcagtccagagcccatatcaatgcctgggtcagagctctggagaagagctgctcagttaggacccagagggaaccatggaaaccccagcgcagcttctcttcctcctgctactctggctcccaggtgaggggaacatgggatggttttgcatgtcagtgaaaaccctctcaagtcctgttacctggcaactctgctcagtcaatacaataattaaagctcaatataaagcaataattctggctcttctgggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcccacagtgattcagcttgaaacaaaaacctctgcaagaccttcattgtttactagattataccagctgcttcctttacagatagctgctgcaatgacaactcaattttagcatctcttctctgcttgggcattttggggatcttaaaaaagtaatcccttgatatatttttgactctgattcctgcatttttcctcagaccaagatggacagccaggtttaagcacagtttcacagtaatggccactggatcagatttacatcagtggatgtcagtaaaggtcccaaccagagccataaggcaacaacaatagcaacaaataatcaaaattggaaaagaagaattaaagctgtcataattcactgatgaaggattgtgtgcagataaaattcaaatttgtctacagagaaactactaaaattgacatgagaaatagaaaatcattagattcaagatcaatttattaattcatagattcaaaaatcaatttcatttctgcataataaaaaatgctaaaaattaacattataaaacaaacacaccatttacaaaaacatcaaagtatcaattatttaaaaaaaatagactaaatacactgacgtctccagaatattattttgaaaaataaaagaaaacctaagtaaatagaaattcagttcaaagactgaatgtctcagtactataaaaatgtcaattcttcaaagattaaaatattgattacatataagaaaaatcaaaatcctaaagtatactccaatttaaattaagaagctaatctaaatattatatgggaatgtcaaggatgtagaatagccacagtgaacctgaagaaacaccaaaatgagaacttccagtgcctgaatacctggaatatagtgtgggtggcagtatggtgatggtgagatcagaagtttaaaaatttgcaaacgtgcttatttttggaaataatcactacgcagatgtagccaaaccctcttcaactgtgccaccagaatctcagatttccagaattagtttctcacagtgtgattcttaacatgacatcaataattctcagtctccccagtaaacgcagctcagtgcatggtgcagctatccatttgacttctacaaatattttaaaaggtagaaaattatatttatttatccaactaattgactcagtaacagctgttcatttgcagagaggtactctgttttaataaataacaaaactaagaaagttagtgaatgaccaagtaggaagagtgataggaacagctgtcttagctttgtcaaaggcttccttccaaaaggaatttcactggtcactttcatttatcaccaccaataatttattataacttattgtaatgtggtttattgaatattatatgaaagtgaaaaacagagtagttgtaccagtactggaagcactgtttctactgaatacaaataattttcacactattgtaaagtcaaaacatcttaagtgcaaccaccatgaattagggacttactgtaagttcagggaagtaactataaagaaactcacaaattttaagaaaaatagaatatattcctgatagaggtacaggaatatattatctaaaatatacagttttccattaaaaaatcctgcaaagaaacagaaaagtatgatcaatattgagggaacaaaacaaaacaactgcagcaagaaagcacagtcaatgaaagctgattctgacttgtcctgaatatcagctttagcaaagactacaaagcaattattatatagatgtttaaataattattcttaaaactacgatcatatagttttaaagatataaagaggaaaatataaagacaatgactcagcaaatggaaactcttaaaaaatagaaactatggaaaagaatcaagtgagaattctagaaacaaaaagtacaataactcaactgaaaaatatattagataagtccaacatcagtttaagatggcaaaagattcagtgaacttaaaaatagatgtacagaaattattgaatctaaataaagaaaggagtttaagaaaaaatgcgcaagacttgacagaattacagctcaggttgaaagataccaacaagtgtgtaaaacgagtcacaaaaaaagcagagagagagagaaagtgatcaaaaaatacttggaaaagtaatgacaacagcttttcaaaaataatgaaccacaaaggtaatttaatctatagatgaaagaaactcaatgaaacgctttcaggatataatacaagattaataacaaaatacattatactttaaaatgttgaaagacaaagagaaattcgtgaatgtgtcaggactaaaagctgactctacatatggagacacaataataatgccattggctaagttttcattaggaccgagggaggctggaagagattggaatgagatctttaaatactaaaaggaaatgaaagaggacaaccagcaattttgtttctggtgaaaatattcttcagaactaaaaatattccttgataaacagaataaattcattaatagcagctctgccttataagaaattcaagatgaaatctttcagaatcacagaagattacagcaggcgggattttgagcccacagcctataatgaaggactcaaaagtagtaaacaataagaataaagctagaaaaaagcacacaattcaatttatatgacattaaagacataaaaacccaaattactgtgttcgatgtcagaatgacaattaccttggttgagatggggaagcagttactgaagaggaaggtgcatggaggaagcatcagcagaaggtaaatattctgtagttccatctggccaatgaatacacaaaaactattcagttacaatttgaagatgtgtgccctttgtgccctctgggtgttttatcacttaaaataatacgtaaaaataccatatagaatagaaaatatttatgaaaactcagcctattaaagaccaatgtaaaatatgcctgggaaagggaaaaataattagaaacctcttagagaaaacagaaggatattaaaaaatatgtcccttcggccgggcgcggtggctcacgcctgtaatcccagcactttgggaagccgaggcgggggggatcatgaggcttaagatccaggtctggaagctcgtcaaatgctaaattatgtaaaacacaataagccaaggatgcaggttgtagttctctggggtactcaattataataaaataatacagaactaaaaaacaaattaggataaaataaatcaacactgtaaacaaaatatgttgtgccaaatatgattgaatttttagataaaagattgtaaataaataaatgaaattgcatacacaaaaataaaatcaaaagacaactaaaaacaaggagaaactattcttaatatattaaacaaataaactgttactgttctaatatgaaacaactctattaaaagttaagataatgggtcaaaaatccaatagaaaaaagaagaaaagagaacagacaatgcattataaaagatatatacatatagcatttaaacacaagtaaagtgtgtaatctcagtaatgagggaaatgcaaattgaaactactttgaggtagtattatctggtttaagaaaatccaaaaaatattaaccgtatttttaggcaaggttatagggaaacaggatttctcattaacagctgtgaggatggaaactaatactacctttttaagaaggagaatatgacaacatctacaaaactatcttaatgtgtaactttgacccataatcccattcctaggaatctctgaagatacatcttcaacactacaaaattacatatacacaaggttattcattggaacattaattgtaatgatttgtaaaatgttgacaccacccagaatattcataaataaatattttgttgaaatagctatggaacattcatgcaatggagtatgtatcaactgtcaaaaggaagaagttatctatgaattgacaggaagttatttctcagatatacagttgaatgaaaaaaagcaaagtgcaaacaaatatctataccgtgttaccttccaagtaagaaagcagaggagatttaaaaacaaacagaaccgtaaacgaaaacaacaaatttgagaggatagacagagtgaggctggcagggagtgataagaggaaggggctggtaacggggtgaagggatgagatgagagtggtacagaaggggtggaaggcgacacgtctctgagcttacctttttgtttttgtgaatttatgtctttggagactctatttatactacaaatatttgaaaataattgaaatcaagaaagatgagaggatccaaatgggttacaaacaagagtaaatgaaactaaatgtattacaaatgaattaaaaaataacaaggtggtggatatgggaagaaaagactaatataagtattgttgggacccagtattttgactatttccactaaagctaaagacagaaatatgtgtgattcagtattttactggacttagtagcttcaatttttacaggggtatagttaagcatgtgcacacatatttttctttatttattccaggcaatggctacatgaatttttaaaagttttattttgattttaattgacaaatagtaatgtatatacatatggggtacaatgagatgcatacatgtatacattgtcgaataatcaaatcaggttaattaacatagtcctcacctccaatatttatcattttttgtactgagaacattgaatatactttgttattttgaaatacagaatatagtattattaactacaaaaccactgtcataaggttaacaagaacagtattccaggttccagactgaaatatagttaagcattaatcagacaacattctgagccacttcccttagcttctcactaataaaagtcaagttgcaataaatacagaccattaacgtccccattgttcccaaatataacaccttcaccattatgagcataaaacctaatctttgagatatttaccagatcctgaattccagtagaatagctgacaccaacttgtctaaagaccacccccctcccaaagaaccgagtcaacataagaaagcagtttcttcacctcccagtcccatgacttcatccttcactcttcaaccaatctgcctctccatccaaaaccacttaaagtctttaaccccaaagtgcttggggaggtagatatgaggcttcctcctgtcttctcatttaattgccttgggattaaatctctttctctgcagcagcccccagtgtcttagtgtatgttgacttaccatgtaataggcaatcaagcctgccagaaatacatctatataataatgtcgccatgctatgcaacagatcaccaaaacttagtccccctatcagactgatattttgtaccctttaacaatgcagtctctggtaaccagcattctacttgctatttctgtgactttcatttttttagatttttcttcctaagcttagaacaagggattgctgtggccatggcagaagaagtttgcctctgtatacagagtttccctccactgcaaaactgcagcctctgccagttgcatccactgtccttatgaataaacatacctggaagtgttcatagtatttgcaacgaattatacaagattttgaagccccccctctctttctcttccttttttgttcttttgtgccatctttaaatttttcatttagcacaatgcatgactgttggggctcaatacatatttgttgcaaaaagggtaaaaaaaggtgtttcttcttttcaataggaaaaattgtagtttaaatctcacaagaccgtcttgtagtcagactcaaactcacatccacagtcacctcctgtggatggcgaaaacgtgaactttatgtgtatgtctcctcatacattgaatggtggtccagatttccagcttctcgggatctgtgcacacaggctattgtgtccggagttggttcctgctggtgagtctggctgacttcaagaatgaagccacggacctttgtggagagtgttacagctcttaaagatggcacggagcggcagcaaggattactgtgaagagctaaaggacaaaacttccatagcatggaaagggacccttgcgggttgccactgctggctggggtggccagcttttattcccttattgtccccacccatgttccgcttctgtcctatcagagtgcccttttttcaatcctccccacgattggctacttttagaatcctgctgattggtgcattttacagagcactgactggtgcgttttacagagtgctgattggtgcattttacaatcctcttgtaagaagtccccactccacccaggaagtctagctggcctcacctctcactatcaatgactgaaatgatcattagtagcagtggctttggttaaatgtataccagtagttacatacagggtagaaaaatggtctgaagaggtatattcagcatcaaatgaaaaaattacaccttgtgacccctttctctccctgtatgatcccttaagattgtgctgaaacctcagagcatcaggtcagcctcatattgctccttcctaaatcttggtccctgctcaacctgagcctatgtttggccatccacgggcatccatgtatacaactttgaaggcaaaactccctgcttggagtggctcattagatgaccagggtccagatagcattgccaaggaggctcacagatggcttcatactgagtctctcccctcagcctcccagcatcaccagccctgaaggaatgtccctgttatccgtggcacccagagcacagtcagccctgccctgacttcactgcccaattcacagcctcatcgcagattccactgcaaaatagacagtgtgagatctcaaagacaggctgatttgtagtcctgaaaagcaacaacccatcgttccctcgatctctttggtggaatttcaaagttcgtcataagctgaatttctgtacaaacatactctcttaacaatggaaactatttgcaatatgggaaacataaaacatgggaaaagtttaaatctctcaagagcatcttctagtcagattcatattcagcttccctgattctgaactttctgtcttgcggtcagcttcttttggtccatttgtttcaccctttccagctcagatcttctctccctggctacccttagtctcaggttgtccttacgtttgataggcttctaccttatggatgctgtaaggttatcctctcatttgctggattcttgtgggaaaaaaaatccctccaagttcacatcctgagacttcagactccactcttccttggagagccatcctccatttcctgcaggtctggtcagagcccctttcatagaaatggaaacacttacttgaattggtttctgcagaagccagaccaacctctaaggtgcctgatttatgaagtttctaacaggaagtctggggtctcgggcaggttcagcagcagtggttcagggacagatttcatattgaaaatcagcagggtagaggctgaggacgttggggtttattactgcctgcaaggtacacaagtgcctcccacagtggtacaaccctgaatacaaacctccctgcttggagtggcccagctgctcaaatatgttgtttatctggggagtggcacaacagaatctctgctgtataagatgaagatgttgggccgaggcgggcagatcatgaggtcaaaagtttgagaccagcccgaccaacatggtgaaaccccatctctactaaaaatacaaaaattagctggatgtggtggtgcacgcctgtaatcctagttactcaggaggctgaggcaggagaatagcttgaacccgggagatggagcctgcagtgagccaagatcacaccactgcactccagcctggatgacagaaggagactccatctcaaaaaaaaaaaaaaaaaaaaaaaaaatgaagatgttggtgagctcagggtaaaaggttgcagctgaatgacctgtcccatgggggactcagcagtacatcaggtaaaacccattcatggtcctgtcagctcccacagccttggcatggcataagccaaaggaaaacagagataattcaagtgccttcagagtaagcagacaggactgagggagagcggagggaaatctcacactaatcttccctgccttgcctacattcgacaatgagacttcaaatagcttaatagccagacaagtaacacagattcgtgtcaacacgtgttgaatatctcttgaagtttaggtcttttgtgtatatttttaagagggtagtatttggtagtatttagaaactggtatttttcaacttttccaatttccttcttctcctttttactagttctcttcccattgcaccacataagaaatagtgaaaagagcattctacacaagctgtcctcagggagagctggctgaggacaatcatgaaaaagcttgaatttgcacctccaaatagacttttgtgacgtcatggaagacagaagatcctgatgttaaaactctttcattcatttcaattacttcttgctaataaaaaaggataatatttgaaattccaaaagttggattttaaaaacaaaaacttaaactggaacaagcagattatagaatttatgttatatgccactagaataacacagaataatgtgaggttttttttttctttaccaaagggtgagaattttaaaactgtgggcagactccaggaatgagaacaaagaagagaatatagtagaggccaactacggtccataatctgaactttgtcttgtatttgttgcagttgtgggtggtattctgtgatgtatatgtaccacattttctttattctgtctaccactgatgggcatttagttaattccatgtctttgctgcagtgaacatatgtgtgcatgtgtctttatggtagaacaatttatattcctttgggtatacgctctgtaataggattgctgaatcaaaaggtagttctgtttaaagttctttgaggaatctccaaactgctttgcaccgtggctgaactaatttacactcccgccagcagtgtataagcattctcttttctctgcaacctcatcaacatttgttattttttgagtttttaataatagccattctgactggtgtgagatgatacttaattgtggttttaatttgcgtttttctaatgattagtggtgttgagaatttttcatatgcttgttgactatgtgcatgttttgttttaagaagagtctgttcatgtcatttggccactttttaatggggttgtttttgtttgttgcttgttaatttacgttcattacagattctggttattgggtctttgtcggatgcatagtttacaaatattttccctcaatctgtaggctgtctgttgacgctgtttatagtttctttaacttgtgcagaagctctttactttaattaggtcccatttatcaatttttgtttttgttgcagttgcttttggagtttttgtcatgaaatttttactacggcctttgtctagaatggtatttcttagattttcttctagagtttttgaagttttaggttttacatttaagtctttaatccatgttgagtagatttttgtatatggtgaaaggaaggggtccagtttcaatcttctatatatggctggccagttatgctagcaccatttatcaaatagggagccttttctctattgctaccttttgtcaacattgtcaagatcagatggttataatgtacagctttaagtctgggttctctaacctgttacattgatttatgtgcctatttttgtaccagaaccatgcaattttggttaccgtagccttgtagtatatagtttgaagtcgggtagtgcaatgcctctggttttgttcatatttgcttaggacggctttgtctattcgggctcttttgtggttccatatgaattttagaatagtttttctacttctgtgaaaaattttgttgatagtttgatataaatagcattgaatctgtaaattgctttgggctatgtgatcattttaagaatattgattctttccatccatgagcatgaaatatttttccatttgtttttgtcatctctgatttctttcagcagtttattataattctagttgtagatatctttcagcaccctggttaactgtattcctaagtactttattttctgtggctattgtgaatgggattgcattcttgatttggctctcagcatagacattgttggtatatagaaatgctactgattttttacattgattttgtatcttgaaactttgctgaagtggtttattagatccaggaacatttgggcagtgaagacagggttttctaggtataaattatatcagatgcaaagagagatagactgacttcctctcctcctctggctaggacttctagccctatgttgaataggagtggtgagagtaataagcatccttgtcttgttctggttcttagaggaagttcttccagcttttcaccattcagtatgatgttggctgtgggtttgtcatatataggtcttataattgtgaggtatcttccttcaatgtctagtttgttcagggcttttaaaatcaagggatgatgaattttattgaacgccttttctgcatcagttgagatgaccatatggtctttgtttttagttcctttcctctcagatcctgtcctgaaaatctaacgagtcctactaatataataagaaacaaacaaccacacatgctcccccacattgtgctgtgagagctgacccctaggatctcagacatgcagatcatatgagacctaataaagggattctcacaagagattttccacctaagaattctggtgctagctgtcctcgcagtaaaatgttctctgcctctgatcaaaattgacaccaaatgataacacaatggaaatgtttagaagaagaaggacaatcacacttttagaaagataaaagacatgccttatgcctgtaacagtttcctattgctagggcaactaattaccacaattataccgcattcagtatgatttattatctacaataaatcctatcaaatttattatctacaattctggattgagaagtcttactgagctaaaattaaggagtcactagggctgtatttcttccggaggctccaggggagaacatcggatttcttgattttaatcttcaagataccgtcatattcctggctccataactccttcctccatcattccagcacatccacgcaggaaaaaaaaaagatgcgaacttacatttaaatctgcgtctctctagaatttgatcctggcaagctggatgtaagcaagtttctctaaaaaatcaggctcatgaaaggccacaggaggacggtgcacaggctagactgctgtgacttggcctcccctagtcttgcgtgcgaatgttccctggagtcctcaggctccagtctactgatgctgatgcaatttattccactccttctgttgctgaaccaggctgagacaatcagggccaagttagatatgtaaaaaatcggatttcaaatctttgtccaattttattagaatctaaaatacttttccatatacgtaagcagtggcttgccaggagatgaagactctccctcctaccaatcccaacagagaagctggaatctgggtcaggatgatgtccccattcattgcttaagcgtaaaagaggaaagtggcattgatggtgcacagcaggaacatacacccaacagctcaatgacctggcctttccctggtgcctccccctcacctgctctccagaaagccggggtctaggagagcagttcctgagttcacaagaacatgctagtagggagtagagctcagagcattactgagggaatatgatattggtctctactgtctctactaaaaatgcaaaagattagccgggcatggtggcgggcgcctgtggtccccagctccttgggaggctgaggcaggagaatggcctgaacccgggaggcagagcttgcagtgagccaggatcacgggccactgtactccagcctgggcaacagagcaagactccatctcaaaaaaaaaaagaaaaacaaaaatctatattccatagttccaccttgacagttaatatacacaaacttcattcagttacactcttaatatttgtgccctttactctggggattttgtcaactaaaatgaaactaatttaaaaacctagatgctaaaataaatatgaaaataataaataagaataactggccaggtgtggtggcacatgcctgtaatcccagcactttgggaggtggaggcaggaggatcacttgaagtcaagagttcgagaccggcctggccaacatatgaaaccccatctctactaaaaatacaaaaattaaccaggcatggtggtgcacgccagtaatcccagctagctcgggaggctgaggcaggaaaatcgctttaaccttggaggcggaggttgcagtgagccgagatcctgacactgtactccagtctgggtgacagagtaagtgaaactctgtctcaaaatatatatatatatatttatacacaaaataatatatatatttatatatatttatatatatcaaaaatatatatatttatacatatatacatatgtgtatatatatgtatgtgtgtgtatatatataataaaattaaataagaataaccaaatatttatggaaactcagcctattaaagacaagtgtaaaatgtgtctgggaaagtgaaaacaatgtagaaatctcttagaggaaatagaagaacatgattaaatatgtccctttttccactcaggcagcacaaactttattaggttccctctaaacacagaggacacattatgtcactgtgctcacactagatgtccccatactctccttggctctttccaccccactgcacccaccaggggatttgcatactgtcccctagggaggaccttccattgtgagtctgagataaaagctcagctgtaaccttgccttgactgatcagaactcctcagctcaccttctcacaataagggtccctgctcagctcctggggctgctaatgctttgggttcctggtaaggacagaagggagataagggaggagaatggagtgtgagggtgagctctgggggtcccactgcctgtccacatgcacatcttgacctgcaagaaaaggtgtataaagtttagaactgcaagagtcagaaagagaagattcctcactcttatagttctaaacttcatatcctagaaggacaaaggacttgtgctctcatgaagagtgtcacacaggaagaggataatagtgtaggcgacttcttgagtctcttttgtgccttgtgaatgttggttctttttatgcctggatgtttaggggtatgaaccaaagtcacacaaaaaaatcacttagcataaagtagataacagaaagaatatcatttcaatggttcccaatatttgtacataactttgcacttctctcactatttcaggatccagtggagatattgtgatgacccagactccaccctccctgcccgtcaaccccggagagccggcctccatctcctgcaggtctagtcagagcctcctgcatagtaatggatatacctatttgcattggtacctgcagaagccagggcagtctccacagctcctgatttatagggtttccaatcatctttctggggtcccagacaggtttagtggcagtgggtcaggtagtgatttcacactgaaaatcagctgggtggaggctgaggatgttggggtttattactgcatgcaagctacacagtttcctaacacagtggtacaaccctgaacagaaacctcccttcttgctgtggttcagctgcccaaatgtgttgtttatctggaaagcagacactgtctattatcttgggagagtaaagaggaagatgatggagaattcaggagaatacattacagctgagggctcttgaccatcaatatctccgttacatctcaggtaccacaatttagtccccatcagttgcaagagtcttggcctggcagaacttgcaggagaatggagggaggtcaagtgccctctgaacaaccagtcatgttgcaagggaaagctgaatcaaagctcatcgtaatcctctctgccttgcctacgttcattcactaactaaattcattcagcctgacagccacctaaatgaaacagattagtggcaatacaaaactaatacgttcttggttttgatttggtttagcagttactagtgtacatgtaccttgacaagatttggtgatactaaaacagtttctctcccatcttctaccttccactttacacttttcttaacatatatctctctctgggacagcaggaagcacagcattttatcctatttttttttcagggagtgcttgcgtgtatttacattctagactttgtaactgctagatatattttggtaagtttatgcaaaaacaaagacctagtgacaaaaatctttgaacaatcttattcacagtatgttgaaatgaaaagaaaattctatgaaatccaaagctgtgttttaaaaataaatatccaagtttcaaaagacaaaagaaaaaatgactaaaaatgtatgccatagtcaaaaatgtatgccatattcaatggaatctggattaatataaaataatatataagcttatattttgccccttgaaaaataataatctatagactttgggcagagggcagtaaatgagaatgtgagggcagctgttaactgtgttagtggtggtgtgttggagttgatatatgaacccaagtggaagctctgctgtatttcttggggagttgtggggatcctgcgtggagttcaagactgtgctctgatgcaatggcaaactcccagggaagtattgcatcacacagtctttagtgactcaaagagagtccctgtccaaatgtacctcaggtcatatcacacattcctagtcaatccagcaggatgtagaagaccttggaaaagtagattctgcccccatcatttacctgggaatgattagagaaagaaaggatcattcaagaaagcttatagttaaaataaagatgatgctgaccagagcagtgcaggggctgggaagatgagtaggaggtgtagtggtgggagcccaaagcccatatttcagacacacataaaggaaaatcaaggcagcatggtaggggagaactcaggagaatgcaggaggtttcactgtgtgtctctagccaacccacccagctaccattctcaacccaggcctcaacaaatgtcccaaagagaaattcagcctggtgttaagggctccactcatgccatataatccataatctgtaaggcacgtacatgcctctgccaaaggtgagatgaattccccactcttgtagagatcttctgcctggaccaaaccagaatctccaatcacgctcgtatttggcaaatttcactaagacacaaagtgacaggaggacacaaggcaatatacaaaggcatctttcctctgtggaattttaggctatctgttctttatttgttccacaactctctgatgttataacaaacatgattttttaagttcatttttgctctcctgcatttattgcaattcttgtgtccatcttctaaggcctattccttactacttcactactgaaaataaattgttctattaaattacaaagtagggatgtcagtttgaatattatattgcaaaacattcacatctagatcaataaatgcacatggcacatggaaatgaaggagaaaaacaactgcagaaatgataatgatcatgtcagtgtttaaaatatttgatactgaataccaaacatggaacactgaattcaatattccagtaatgtatgctgaaattacatacacatatgctttaaatatactacatttacaataatactttaatattattttgatccataaaagggcatatgtattatttcatcatgctatagtagaagtagatggtttgaattaaatcaaaatgatcctgcttttgattaaggacataagctatctggcagatggctgccttttccaagaaaatatatccaatggcaagtatacttaatatatctatgtattatctttgctgagtatgaagttgtatggcaatatttatatgtaagaaaaacaactcaaaaggaactcaatccttccaaggaaaataaatatcagtaagtaatttaacatctttggggcctttgaaaaggaaagaaaaaaatgaggcaaaatgaatgtgcaaataaatactgtttgtaaaacaacaaaatattaggcagctatatatcagtagtactctataaaagaaatgctaaagacagttctgcaacagaaggaatgcaagactaaatagaaacataaagatacataagagatggacactggaaaggatatgtataggaataaatacaaactaaaatttgcacacgactatagatgtcatggtttgtgaattttgcaatgcatatataactgaattgcatgaaaaataacacgaaaaagtagtgtaaatggaatttaaaaatctaactctattttaggaaatggtaaattaatatttggtactaggaagtaataagttgaggatagctgctgtataataaatgattgcatgtttaacaagttaatgtaaggaaaaatataacaaaatgtctaatccaaaggaaagcaagaaagcaggaaatttgaaaaaaaaaggatggtagatttatctctaactaccaataatttagacatcataaacagacaaatttatctaagtaaaatttttaaattattaaacaagattaaaatgaaaggtttatgctgcttataaaatacacactgcaataatatcataaaatgactttgaaaattaaaaaacgaaaagtacatatcatgcaaaaactgaattgacgaaacctgacttatactttaaggcaaaggagaaaaggggacatttcataatgataagtgggtcaatctattaggaaatcattaaaatactaaatctatatagacccaaaacataacttaaaaatatataaataaaaaattgattaaataaagaaaaagtcaactccatgttatggtgggagactttatgctcaagaggtgatagaaaagcagaaaataacataataaggatttaaaagatttgatcagtataattaccacatttgacatagttaaagaagaaaaaaggtatatggtcgtctcaattggtatagaaagaagcactggacaaaatttagaccctgtttatgtaaaaatgtcctagaaaattagaaatggaaaaataccttccttacctcttagagaatacacaggcagacagagagacagacagacacacacacacacacacacacacacacacaatcacaataaatgctgaaaaattgtttttcttcattttggaattagatatttttaaaagatgtaaagtatcatcattcctagataatactgtactggacctcttactagtataaagggcaagaaaaagaaataaaatacatgagtactggaaataaagaaaacgaatagttattatttgtagatggtgtaattgtttggatagtaaaccaaaaccacaatctagaggtcttctttaacattttaataatgttttgtacagtatcaagacttcacatcttaggcccgccgcagtggctcgcaccaataatccccatactttgagatgaggcaggcgaatgacatgaggccaggagtttaagacccacctggccaacatggtgaaatcctgcctctactaaaaatacaaaaattagccagtcgtggtggtgtacacctgtaatcccagctactcaggaggctgaggcacgagaagagcttgaacccgagagacggaggttgcagtgagctgcgattgtgccattgcactccagcctgggcgatagagactgtcttaaaaaaaaaaaaaaaaaaaaaatgccgggcgcagtggctaaagtctgtaatcccagcactttgggaggtgggcggatcacatatttcacaattccatctccaatttgtttgttgctggtatgatctttttgcacatggtttttatatttattgacttttctaaatttatttattcattcaaaaatatgtatttgcctttactacatttacctgatttttaaattgtcctttgaatcgtgtactagctaataacattaaatggacttttagaaataaaattatatatgttccttataaaaattctatgggcatccctaccagatttagatacttgactttctgaatttatttccgaaaataagttctctgtttattattgattcaccaagaaaaaataagtaaagaaatattttcctattaacaccctcgtctctatgagaaatcatcagctctatgtaactatttttgccgactgcaagcccatttgctgattgtctactgaagctcttggcataaaaatacaacagtgagttctagagaagacctgatcctgtgctgcctggatcataagagaaagaccaataaaataatggagtatatacctgaaattttgaatagtcaagcattccaatcggtgtattattttctcagaatgtatttattgaaaattcaaagcacaaaaagaatgcaatttagcaagcacttacttaatagggcaaggatgatacagtgtttaataaggtaccttctagagctgtggtcaagacagattttggtgctcctcctctttcagtaaaaaaagacaatgatttgttgatttctcctatgtgcctaggaaaggtgagtggcaacatattcgagatataactaattctgttacagagcaaaaaccagtgatatcttctcagtagcattttttgtctaatatgtaaactcagaaaataattattaattaataaataattttagctgctttaaaattacgcattttcaaatatgttcctaggtgcctcttttcttgcagttcaagaaattaacttgcagttcaaatatgaattcacctgataagaaaagaatagtgtgtcttagcagatattacagtacattgcacaaaaccttcacatatctaggactcaaaaatatatttgacacattttaaacatgaaaatattattaaattagtgattcagacatttaattaatcttttaaggtaatttgtgcattggctttttgttagacatatcaacacttcaattttttatttctatgtttgaatttaaatatatttaaattggtttaatacaattataaaatcaaatttcaataagcaacaaggaagtaaactctataaaatatatcaaatacttaaccataaatgtttgcaataaactctgaaataaagattacaatattatattgaaacagtggcaagttcacaaagaagtatgttaaggctcacaataatgagcaacaaattaaaggcaaaactgacctatatataatcacattactttatccagtctgtcactgatggacgtttaggttgactccatgtctgctactgcgaatagtgctgaaatgaacattcacgtgcatatgtcttcataatagaacaatttatattcctttgggtacatacacggtaatgagattgctgggtctaatggtagttctgtctttagctctttgaggaattgccacactgtcttccacaatggttgaactaatttatactcccaccaagagtatataagcattcgtttttctccacatcctctccagcatttattttttgacattttggtaataccagttctaactggtgtgagatgatatctcgttgtggttttgatttgcatttctctaacaatcagtgatattgaacttttttccatataagtgttggccacttgtaagtcttttgaaaagtatctgttcatgtcctctgcccactttttaatggggctatttttttcttgtaaatttgtttaagttctttatagatgctggatattaaactgttgtcagatgcagagtttgcaaacattttctccctttctataggttgtctgtttattctgctgatagtatctttggctgtgcagaagctctttagtttaattaaaccccttttgtcaatctttgcttttgttgcaatagcttttggtgtctttgtgatgaaatatttgcccatgtctatgtcctgaatggtattgcctaggttgtcttccaggatttttagagtttttgggttttacatttaagtctgtaatccatcgttagttaatttttgtatatggtgtaaggaaggggtccagtttcaatcttctgcatatggctacccagttatcccagcacaatttcttgaatagggaatcctttctccattgcttgcttttgtcaaatttgtcaaagatcagatagttgtaggtatgcagtcttatttgcaggttctctattctgttccattgatctatgtatctgtttttgtaccagtaccatgctgttttggttactgtagccttgtagtatagtctgaagtcaggcagtgtaatgcctccagctttgtgctttttgtttacaattgctttgactatttgggctcttttttggttccatataaattttaaaacagtttttttctagtttgtagataatcacaatggtactttaatgataatagcattgaatatataaattgcttttggcaatatggtcattataacgaaattcattcttcctgtctatgaacatggaatgtttttccatttaattgtgtcatttctgatttctttgagcaatgttttatagtcctctttatagagatctttcacctcttgggctagctgcattcctaggtattttctttctctttgtggcaattttgaatgttattgcattattgatttggctctcagcttggctcttcttggagcacagaaatattagtaatttttgtacattgagtttgtatcctggaacttggctgaagttgtttgtcagcttaagtagcttttgggctgagactatggggttctctagagatatattcatgtgaggccaggcgcagtggctagtgcctgtaatcccagcaccttgggaggccaaggtgggtggatcacttgagatcaggagtttgaggccagcctggtcaacgtggtgaaactccatctctagtaaaactacagaagttagctgagcatggtggtgcatacctgtaatcccagctactcaggaggctgaggatggaggatcatttgactccatgaggtggaggttgcagtgagcagagattatactgcgacactccagcctgggtgacagagcaagattctgtctcaaaaaaaaaaaggaaatcatgtcatatgcagcaaggatagtttgacttcctctcttcctgtttgggtgccttttatttccttcttttgcctgattgctctggtcagtacttctaacaccatgctgttaggattggtggagagagggcatcattgtcttgttacagttttcaaggggaaagcttctaacttttgcccactcagtgtgatgctggctatggcttcgtcctaaatgtctcttattattttgaggtatgttccttcaatatctagtttgttgagagtttttaacataaaggatgttaaattttatcaaatgtcttttccgcatctattgagatgatcaagccatttctgtgtttagttctgtttgtgtgatgaattatatttatttatttgcatatgttgaaccaaacttatatcctgtggataaagtctcttgatcatggtagattagctctttgatatgttgctggatttgatttgctagtattttgctgaggatttttgcatcgatattcatcaaccatattggcttgaagttgttgttgcatctctgccaggttttggtatgatgctggcctcatagaatgagttagggaggagtccctcctccttgattttatatatatatatatatatatatatatatatatatatatatatttttttttttttttttttttttttttttttttgagacacagtcttactctgttgcccaggctggagtgcagtgatgtgatctcggctcactgcaagccccacctcccgggttcaagcaattctccagccctagcctcccatgtagctgagattacaggcgcatgccaccatgccagcctaatttttctgtttttagtacagacggggttttaccatgttggccaggctggtctcgaactccggacctcaggtgattcacccacctcggactcccaaagtgctggaattacaggcatgagtgaccaaacccagcctttcctcttcacttttttggaatacctttagtaggaatggtaacagctcttctttgtacatctgatagaattcagttgtgaatccatttggacctgggatttttttggttggtaggctatttattactgattcaattacaagctcatttttgctcacttcagggactcaatttctttcaggttcagtcttgggagggtgtatgcatccaggaatttatctatttcttctagattttctagttattgtgcatagaggtgttcatagtagtctctgatggttagttgtatttctgtggggtcagtgataatgtccttttgtcacttctaattttatgtatttggatactcacccttttcttctttattagtctagctagtggtctatttatctcattagctttttcaaaataaaaacaggcactggcttcattgatcttttgaatttttttgtgtgtcttatctacttcagttcaactctgattttggttatttcttgttttctgctagatttggaattggttttcccttgcttctctagttcttttagttgtgatattaggctgttaatctgaggtataactttctgatgtgggcatttagtgctataaatttccctcttaacactgcctaacctgtgtcccagagattctggtatattgtatctttgtcctcattcatttcaaagaacgttttgatttctgccttaacttcattatttacccaagtcattcaggagcatgttgtttaatttccatggttttgagtgattttcttagtcttgaattctacattcattttgctgtggtccgagagaggttggcatgattttggttcttttgcacttgctgaatattgatgtatgtccgattgtgtggtcaattttagcatatgtgccatgtggtgatgagaatatgtatattctgttgttttggggtgaagagttctgcagatttatataaggtccatttgatccagggttgagtccaagtcctgaatacctttgttaattttctgcctcagaaaattaattatacagattataatctgtataatactgtcagtggggtgttgaaatctcccactattattgtgtgggaatctaagtctccttcaaagtgtctaagaactttctttatgaatctaggtgatcttgagctggcagcatatagatttagagtaactagatcttcttggtgaattgaaccctttactgttatgtaatgcccttctttgtctttttgatttttgttgacttaaagtctgtttcatctgaattagaattaaaatcctggtttttttctgttttccatttgcttggtagatttttctccatccctttatatgagtccatgggcttcattgcatgtgagatgggtctccttaaggcagcataacatttggtcttgcttctttatccagcttgccaccctgtgtcttttaagtggggcgtttagcctgttgacattcaaggttaatattgatatgttagatttgataccaccatcatgctgttagcctgttattttgccaacttgtttgtgtggttgctttataatgtcactggtctgtgtacttcagtgtgtttttatagtggctgataacggtgtttcatttccatatttagtgcttcttccagaagcttgtgttaggcaggtctggtggtaacaaatttcctgagcatttgcttgtctgaaaaggatcttatttctcctttgcttccgaagcttagtttgtccaaatatgaaattcttagttggaatttattttctttaagaatgttaaatataggcccccaatctcttctgctgagaggtcttctgttagtctgatggcttccctttgtaggtgatctgttttttctctctagctgcatatacttacaaatatatgcatcatcatgtcaatatattttatttttaattttttttagaaaggaacaatgataaacttacagaaaagttgcaagtatacaataaatacccccttccctaaccggaattatacaatagtcttttaaagaccttagaattctatcgtctaaaactttactatgtgtttcctacaaaaaaagaatatcctcctatatactccccatacgccaatgaaatatgatactccaccgactcctgaggaatatttcaaattgtcaaaaaaaatctaaaaaatgtctctcgtaacaaaatagtctccagtagaaacccattctctgcagacaaatctgtgctaccctgatcttacctgggacacctggggacactgagctgctgctgagttactgagatgagccagccctgcagctgcgcccagcctgccccatcccctgctcatttgcatgttcccagagcacagcctcctgccctgaagccttattaataggctggacacacttcatgcaggaatcagtcccactcaggacacagcatggacatgagggtccccgctcagctcctggggctcctgctgctctggttcccaggtaaggatggagaacactagcagtttactcagcccagagtgctcagtactgctttactgttcagggaaattctcttacaacatgattaattgtgtggacatttgtttttatgtttccaatctcaggtgccaggtgtgacatccagatgacccagtctccatctgccatgtctgcatctgtaggagacagagtcaccatcacttgtcgggcgagtcagggcattagcaattatttagcctggtttcagcagaaaccagggaaagtccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttaccctcccacagtgttacacacccgaacataaacccccagggaagcagatgtgtgaggctgggctgccccagctgctcctcctgatgcctccatcagctgagattgttcctcagatgcagccacactctgatggtgttggtagaaggggacatgaagtcacctctgcaccctaattcttttctctttctcagccccaactacacagacatagcaatgcctctcctaatttaatacagacagagatcatgacacctgaggagtctagtttatggcttcagttggactttatataacagagaagaagccactatagatattctaggcaggaattgtcttaatacagagaattaaagtaaactactgacgtctaaataaaatgtagagatgaatctctaaatgtaatgttttatttacacagaaatatttcccaaatggggcatacaggaaaactcagtggtcttcaatatgtggcaagaacaaagaaaaagttagtgtttcatgaaaaagggaaaatattacctatggctctttgagaaagttcattggcactaggaagggttgggagctggcaagctcagactgggaagcagtggtggacaaagtgaatcctagaattatatcaagttatctcagaagttgtggacaaatttgatttcaggttacaagaagccaaagcagtgaaggttgcagagtgttttgttactgaaataccagggattcagcgtagatcctgcagctcaccacacagaaagccaatcactaaggcaagtattgccaaggaaaaggctttaatcaggtgctgtagctgaggagatgggacaccattctcaaatgtatctccctgaccaacaaaaattaggggtttatatagcacggaagaaatgtgggaaaacaggaattatggagggttaagggagataatttggtcaacaagaagcaggaggtcagttatgcagtcataatgagtgaagggtctgatgtcccactgtcctgattcagtgatatgtaagtttcagctccttgatagtatctgggaggcctgatggttggtttactgaaaaaagaactcaggtaagacagatgtaactatcttgagttttaagatcggggaagtcaatttctatgtttattcaaaaaaccataaacattagttccatggcataatagggcctatttcaattgcattctagaaacaatatttttcaccctgagtgcctttcccctctggtttcatggctctgtttggtatgacaagaatgacccaattcctatgattaacattcacactacaacctttcaaaaccaaggatatagtattcaggaaagttgatattagaagcagcattctttggtgctcccactgaaaacagaatgtatccacccctgaagtaagggttttctaaccatgtggtcctcagtcctgtctggaagtttaagtctggaattgctgaagttctcgcttcctagagcatctttccaggtgtttctccagtcctcacctttgtctctctgcctcttaggtaccaatggataatactgagtcttccttttctcacttccaaatctcatgggggaccctcttattgggcaaccctataggacatgagaggtaaagagggatatttccataagttaaaatgattttcccccaaaaaggtcatttaaaaaaattatatttgaagccacatgttgaaaacacatccagctttgttttcttattaatgcaaacttacatttgcaaatattttcaggattgtgaaggttgaaaacatgattatttgtctatggaatgatcaaacacctctacaattaagtggagtaaacattttcttaaaaacttatactcattgaaataaaggaatatatttaaaatgtttgaagctatgttagaaattattggacttaaattcaactgtgcggtttggtttgggatgttgatcactactgtgacctgccacaagaatcttgtgtcatgtgtagtcactgctgttcagccttgtcgttaaacaactgatatctacaggctgaatacaatctacaggctcctctctgctgagaggagccactcagcagagaccttccttgatcagccagatgattgtgaacatgagcatctatgaacatgaaaacaaatgtttactgttatcagccactgagttgtacatttaaccagttaccgtaattaatgcataaacacttcctgatacagtatttacacctctacctatataaacatacatattttttcttgaattggtggtataaatatgaatatttagtaatcaaattatgaagttattaagagaaaaacacaaaattaaaactaattagtatttcaataaaaaattaaaatttaccttctttatggaaaaaagtgcatatatatttaagatacatagaagtgaatatatatttatttgataaaatgttggctacaactacgtacagtattcatatttaagtacatttattctattatatatgcaatatatacatattttatttataaaatattatctaaattatatacatttaaataattgttacattccacacaaaaaaaatggtatttgtgatgacacctaattcatactcttgctacagaaaatttatttgtagcctttatttttaaaactttaccaaatggttgtccttacctaaaatatttttccaatccagtagagctccaagggtaaggctagagcaaattttgactaatgttgaatattaaccattgcatcctataaaagtctccattatgttcatgcccacaatgatgatattccaaatagagttctcacaacaatggatgctggatggagtcacatcagtgccattgtcaaggaagccctggaaatgtaaaactcataacagtgggtaaactgcaaggcctacatctgatgatcacgttgcaaagagaacagcagtttaataatattggctgttggttttgacagatcatcaggccttaaaagaaatgcaacaggatgatttcagacaaagtcattctgtaagagctatgactagaagtttcaaaaatgagccataatcaagaataagaagctttccaagtgaatattaattgaaatgccattaacgaccagggggcttttaataatgaggatgattcaacatatggacttcagttacctcttccagctttcccagctagcctcacgaaccagtgttatggaggtccctgtggagactcaataatatgactttcaactaactgagatgtacagggctactggctcttctgaacacccaatttgccaagaaaactgacccctccagaacccttaacattgtaccacacatcagggctcagactaattactggtatcaggtgattctagtggacctcatggaacatgaggatggcagtggttattttactatatatggatttgccttccttttcggttatgtttctgcataaaatattatttgtggattttcaaggagttttcatcagagtcaggaagttcttccataatatggctttggatcaagcaacttatttgcctcaaaaaaagtgaagcaaaatgtagctcatgctcttgtcatgtgcacaggtgcagctttccctatagacagggaaaaacccattattagtcaagcaaagctgtcacacaaacccttgtgctattgaattgctatgctgtcagaagtggtggaggctctgaaacactaatcatgaatggtgctgttacttccataaacagaatatttatatcttgaaaatgagctgcagattcatcattcttgtgccaactgaacagcttgaaatactctatttctattttctcagggctgtggttttctggctgatggttcttaatgcaaagaattgacatgacaattattccaagaaattggaagaaatgatatgataagcatgtcaccatttagacttaatacaatactggataagttgtcaacacagggcattcagatgtgtgctggggccatagatgtagcccatataaagcaagagcaaaaataactgattttacatattttagagaggaagtacagaaaatatggaccctaggggaccttctggaatctttctatttattgccatttccactggtaaaactcagagaagatttcaacagtcatcaggatgaagttctagggatcacagtcatgtgaagcattacttgcacttggatctccagtgaggcaaagggaagatgaaatgcatagtgggatgtggaggggtaaacaccagaggcagacacctggtcagcttcaacgttgaaaagtgtatttattttttctctttacttttatcactgaatcatttggatctaagaaaagcgattatggctggttaggcagaaaggtgtttattatcatgaattaaatggattgaaaacatttggggaaaccagagtggaagctcaggcaactccaagtactccttttgctattgcttgaccctcctcgcctccatattttccacagtcaagaaagatactctcattttataggaacctggcaagtgaagatattgtgcccacaggactgtgctgcctggctgagacccagaccaggaaaatgagcacatttgagtgaaatcagacatttcccctccctcatctcaatccaaaacgactctgtagtgacacatctgatgggcagtcagagaaaggggtcagatttccagcagttgagagttgatagcagagctgctgtcctcctgggggcagtagtgagaagagctggtctcttttctgctgcaaaagacagcttgaatgtctcaagcagtaggagctcctccccagcctgtgccagcagtatgattcttggaattgttctagaggctttgactggagcctgttctttaaggcttttcaacaatttgtaaggaatttaatatcttctagttaatcactttatgcttcatggatctgacatttgcaacagggaatatacgcagtccgcagtgacatcattcacagcctccttttttcttgctaaatatataatgctttccaggtggacctgccagaggaagacaatgtgaacaacaatccatgtcaacaaaaatgcaagacaaataagctcaggaaagccactgggttctcacctagttgcactgtccccctgagtctttttttttttttttttttttttggtcaccttagtcaaaatcatgaacaaagttgccaactttgaatggagccctttgcaacggtagccttggaatctatacaactatacatgtccaaggcatttatttaagacctttagagcctgcttgctcgatggaaatccaggtatccactatttctatgcatgctgactggagtctgtggcaatgtcactaggtgcaccagactcagcttttggatgcaaaagtttcctgaagtggccaccagttgtgcctcttttgaatggcaactcctcgcttgctgtaggaaaatgatagggcctgagtatctcaagatttcattttttttttttcttcagatagagtctcactctgtcactcaggatgcagtgcagtggcacgatctacactcactgcaacctatgccttccaggttcaagcgattctcctgcctcaacctccagagtagctaggactacaggtgcacaccaccatgcccggctatgttttgtacttttagtagagacagcgtttcaccatgttggccaggctggtctcaaactgctgacctccagtgatctgccctcctcagcctcccaaagtgctgggattataggcgtgagccactgtgcccagcctcccaaggtttctaaagtggaactctaacattcctgataagaacctgaccatcttccaaggttgctgatagagctggcatttccccaaagcaccaaatgagatctagccagctgaaggtgggatggtccccagaactgacctttcactgatttttcctcattataatctcattgtaatactaaaatatccacccaaggcagggcttatcctccatttcctcaccatgttatatatgttagagcatgacgctccactgcacaaatgcaaagaaaactttgcctaaccatgcttgtatgtcattcctttttccgcctcagcttccttaaaatggtaagagctgggcacttcaaggaatagccaccaggatctcttacccataggctgctcccttgctttgctcttgccacaaacctattaaaccttgcctgagacaatttctgtttggcctggtgttgatttctatttacaaaagaggcaaggggtcaggcgcgatggctcacacctataatctcagtactttgggaggccaaggtgggtggatcacctgaagtcaggagtttgaaatcagcctgaccaacatggtgaaaccccatctctactaaaaatacaaaattagccaggcgtgggggtgcacacttgtaatcccagctacttgggaggctgaggcaggagaatcacttgaacccaggaggcagaggttgcagtgagccgagatcacaccactgtactccagcctgggaaacaaaagcaaaactctgtctcaaaaaaaaaaaaaaaaaaaaaaaaaagcggcggggaggagacaaagaacttggggtcccagcagcagcaaaaattgcatcaggtgggaatgaagagctgattagaacttttcttccaagcctttcacttgccacttagtgatttttaccaagtgtcctgaagctacctcaaagagtaacactcaagtaactccagcactgcaggtgcaaaggtgaccacagctgcatggatgggcaggacccaggctctgacactcaggctgccaatacaattgccatgaagacagatgttgatgccatccatgaaggcaggggataattccttggctgattctctaatctccactacactcactctgcacaacacatctatcaaactagactcaatttctcttctccttaattgttttgaaaaactctgttcacagtccagagcttcatttcctacaaatctgcacctttcctttaagcagttaaactcctttgctttctggacacttcgcctggtctcaaggaagcaattttattaatgctactccaagttctaatggaatcttcatccatcctggaattagagcttcatgtacagccaggcaagatccatgcaacagtccagatgttgtcttggcaggccctgaagtcaaacccttggggttggggatggagctttaccgcttacatgttgtgtgacattagtaaagtaacttaacccccctttgcctccttttctatacccgcaatgctgtgacaataataggttctacctcataggtcggtttacaatttaaacaaggtaaaagatttagaatatatccaacagataatatgtgcttctattaatttaggtatccttatagctataatacttagcacttagcagacacttattgaaaatagttttaaatccaagttctttccatctacagccccaagaggtgctaaaatggggctttttactacccagctcacagccctttaaatcctaaagattttgtcttgatccatgctaaattgctcaaatcaatcatgcccatgcatgtctgtccaatgcatttcttctcaccatccattatcacaacctattattctatgataggttcaattgtcgtattgctgtcctgctttcttgtgtaagtcttattctatcttttaaatcttttctctatttctctaatacttgtgccaaaactcaaaatctaatctcagtttctttgacatgcttctatgctaatgatgtagtttatttgatgttgtttatgcttttacttgttggattcctatggaaacaaattattttaagtgcatgtccttctaagaccacagagctagaaggtgaaaaaaagctaagtggaagtgtatgaagaagagtgatttgggaaactaaagtgtcacttctccaagagttttcaagttgtattttattttttgtttttttacaaaccatgtgtgactttgtcaaacactttttatctaaagccttttttctctaaaagcccacgtagattacctacatgcagtaaaaatctgctcggcctttctctagtttctccctgtatacacccagaagtccacacatgagaccccgccagatttaacagccttggcctggcagaatctgcaggacaatggaggggatccatgtgtcccctgaggaaccagacttgacagcagataaagctgagtagaagggcatcctaatcctttctgccttccctacgcattttggtcaattaaacccattcagtgtaacaactttgtatttaaggctggttcacaccaaaccaaaactaatatgctttctgtattttattttgatgagtagttactggtttacatgcagctgggttagtttaggtatataaaaactgtttctctcccttcccccaccttcacacttccactgtttcttagcacctgtctttctgctggaaaggggctggaaagaccctttttaataccattgtttcagagagtagccaggtaaaactattggcattcttggcttttggctactaaatagatttcattaaatctacttaaaaactaaagtaggctaggcatggtagctcatccctataatcccatcttggggcgccgagatgggtggatcaccggaggtcaggagtttgagaccagcctggccaacatggtgaaaccccgtctctactaaaaatataaaaactagcctggcatggtggtgggtgcctgtaatcccagctgctcgggaggctgaggcaggagaattgcttgaacccaggagacagaggttgcagtgggccgacatgatgccattgcactccagcctcagcgacagagtgagactccgtcacaaaaaaaaaaaaaagtcatgtgtcaaatgtctgatcagtcagacacagcacgatgaagtagatgtaggagagatttcacactcagtacgagtaccctgatatttgaggaaactaaagatgccagaacaccctagcagaaacctgtctccagtgagtcatggcattgtgtgatctacctccacagagaacaggtagaacttaggcttgcttctaacccatatggtatggcagaggttatgagatgtctttccaatgattgtattgtattctgtaagcctctgtcatagcagactggaaagagacactctctgaaaccttctgctggccttgaacaaacaaccagccatgtgggcattgcctgtgtgagcatcacatggcagggaattgtccacagcctctgggacctgagagcagccttgagccaagagccagtaagaagctgaagccctgagtcacagaggtgctaaggcatgggctctgcaactacctgaaagagctctaaaatatctctcttctcagggagtctcaggtgagaatgaagaacagtctacactgtggcacagtcttgtgaaatccaatgggcaggatccagcaaagccatgtgctgactgctgactcagaaattgagagattataaatgggtgtagtcttaagttgataaatttgcaggtaatttcttacatgtttataacaaactgaacacacattttaagaacaaataatagacctaagagcagccatgccactgacattgaatggagatgggcacaggcttattctcattgtgaccttagggtttccaagcactgtgaaagagaggaaagcttcgatgtgcaagccctttccaatattccaattctgtcacatctgctattatcctattggcctgagcaagacacatgggtaacacctgagtccatttagaatgaggccaaccaaaggatgagtgcagggaagggatttattgtagctaattgtgcaagtagtttatccataatttataaattttttcctgagaaataccctgagaaaagggaaacctctttaaaagtcttaaagtttttaggttatagcttcattgattatagtgttctgcttgatatccaagtataaataaccgagaactccttcacactattttttctatgatggtttattttccccatacctttacaggtaattttggtcctgtagtgtgctgtccaagtttactctgcagagctgaccatttgcacaatgtagctgacacatcatcgcaccttgaatgcggacattgactggtgacctatgagaatccgcttcaaaagaatgtatttgtcaccgctttgatctttatcctatctgaatccacacacttctgtattgttctatggctaatccatatcctgtctctattaactcactcttgccataagtgactaagagcatctaacacagaaataataaatacttccagttctgaaaattcaaattagttgaaaagcatggggacattatagaaagaaaatgtataactattttaaagacaaagaaaatgaagtctttgtattttggaatgaaactgtgtgaaaactatctgcaggtttcagcaccagggagggcccctgtctttcctgtgactgagcacattgcctttctcacacctgcaggcaaccagggaagtgactggatggggtgagctgagctgcactgttgggccaccctggggagactttggtaatatatgatgcatttcagatgataacaataactgatgacagcagttcagcttcttcattaccaatgttctgtgtggaatttcccccaaacaacctacaatgaatagacgaactcctgagttgatctagaaacgaactgaatagaggttggggaacaggccccatctccctgacctatgtaaaccgaaaccaaatgttgtccaacctgcacatcaaatcagcttccagataggttaaacaagtcatatcagaccatctagtcacaactgaaccacagggtaactgcagacacatgagcaggctcagcagagatcagttcagccagcccagaatggaggaaccacagagttgatcctcagagttataaggagcagtatagtcatctctctatccatgggatctgcatccatggattcaactaaacctggatcaaaaatatatagaaaaaaaatccacaaagttccaaaaagaaaaacttgacttcaccatgtgcttagtaccacttggttgaatccacacaggttaagtcatgtatacatattgcgtcaggtattataagtaggctagagatggtgtgaagggtacatgagtatatgtgcacaatctattactaatgggggaagaaaaatgacataaaacaaggtaaaattttatatttattttaaatggtaatattatgacaccaacatactgtgagaagctatggatataaaggaaataccatgacaaccaatttaaaaatcactataaaaagagataccctcaaattaggtaaaattaaaatgaaattctaaaaatgttcaagtaacccaaaggaaggcagcaaaaagaaaacggagaagcaaaaaaagatacagcaaaaaagtagagcaaagacttaaatcttagtatatcaataattatcgatatattaaatatgcaaattagtaaattataacagacagcaattgatgaatcaaaaaggaatgtccgaacagtatactgtctataagacactcacatcaaatatgacactagaagtagactcaatataaaagaaaagaaaatggcatagtatgcaaaattaataaaatgaatcagtagcaaatactaatatcagataaagtagactacaaagccaagaatgttaccagtgacagaaatgtacattacataatgaagaaagtcatttcggaaagaagacagagcagttctaagtgcgtagacaccaagcaacagagcgatacagtgcatgtagcagaaactggtgtgaaatgaaggaggccttcattttctatttgggaagcaaatgctctctaagtatagcaggacattctgggatattttttaagcaaagtacccccgtggtcatatttttttttgtagcagagtaacccgttccctcttcaaaccacatccctctccattgtcccagctcctctctgactgcaagcctcctcttttattttaaggacctttgtgatcatattggtttcatctagataactgggtcgcttattcttcacttatatctgtcaagttctctttttgctatgtaaggtagaatttttatgatacggctccgttgactggaggaacaccagggttcttggtctcacaccactttggataaaacaacacagacacacgtggagtggttttagggagagaaaggtttaatatgcaagaaggaaggaagaagaaaacagctcccccacacagagacagagggaggagggattccaacaaagacaaaactccattgcagcagaaaagtggctcttatatgaggaggctggaggaggtggtgtctgatttatatagggctctagggactggtttgaccaggcatgccattcatgaagcctgcaaaataactggccttcccaacaagacttttaatatgcaaatgcagggtgccaaaatattctctacacatggggatatgtgggggcagccttgttgtcaggcacatgtgggggcaaggaagaagatggtgggaattgacaggtttggctggactcagtttctaatggccggaatttgcaaatcaaagcttcccagcctggctctaagagccagggctttcctgctagacaagaaacgtttctggagctgctttaaaggaaagaaaaccttaccaaggacactcttttcctatctgcctaaaataatttcttaataactcctgtaacacttgggttccagagatgaggacatggacatcttttagggtagagacattattcatcccattgacaataaatatattcccccaaattgcctttctctaaagtaaaattttaaaaatcacgaagtattttttatgaagcaagagagctggccaaaatcttagactcaggttcctttaaattgtgagctttaactgttaaggtatgatcattccactgtctctaatgtagatttattgatgtgtagattgttttagaggatttttaagtttgtgaccagtataaacaaaacagtatctgagacgggtctcaatcaatttataggtttattttcccaaagcttatggcctgtgacacagccttaggatgtcctgcaaacatgtgcccagggtgacaagaatacacatttaaatactttggagagacagaaattacagggaaagacataaatcaatacatataagatttacattagtttgtcctggaaaggtgggatagcttgaagtaggggcttccaggtcataggtggattcaaagatttcctgactgccaactggttgaaagagttaagctctgcctaaacacttgaattcatcataaagaaatgcttgagtttagaaaagggggtgtggaagcaaaggttcttgtcacctagatgaatcctatgggtagcaaacaaagtaggtggctaatgttgtttatcagaccttaaaaaaaatgtcagactctttggaaaagacttagtaaggggaggagattctctgcagaatgcaaatttcccccacaacaggcagcttgcagggccacttcagaatatgtcaaagaaatacttttagggtaaaatattttgattttcttcagggcctattatctgtcgtgttggagtatggtatcttattgctacaaagcatctgttttgtcaatccaaagatctctgttgtaatgataatgctggtcagttgtgtctgaactccaaaggaaggaccatataatgaggtacatctaaacccacctgccagtcatggcctaacctagtttttcagatttctttgaagttctctctaccaaaagaggagtccgttcagctggttagtggcttacaacgtaattttttgttttaacacacacacacaaaaaatcaccgcataaattcaatctaaaatagattggttaaaaaaaaaattgtgtgtttcctgaatattcctacatgtcaaagaaagggaaatgataaaagaattcagatgagaaatacccctcatacaaaagattaatgattttatttactatcttagtttgggtccaccagcaatgaggattcctgtttaggcagcaaatttacactgggaggaaaggaagaaagtgagggagggaacagaagatgaatggtaaaagacacatcaacaacccacctgactcaggataactgaagatcaaccacatgtggaaacatggactaaattcctctgggctattccacctgagagacgaggaagctaaggtatgtatacacctcattctgtcctcactgattgtgagctgtctctcttgttctctttcaagctgctataacaggttaggttccttgccactgtgtaattcataaagaacagaaatttattttctcacatttctggagaatgggaaatttaagatcaaggcatgggcaggttaaggtcgtctttctctgctttcaagatgacgcctggagctttcagtccttcaaaggaacgaaggccatgtcttaacatgacagaccagcagaagagacagagagattccagccccataaaccctgtttatagtggcattaaggtattccactagagggctccaccctcatgatctaacacatctcaataggccccacctggcaataccatttcactgagatttaactttacaacgatggattctggaggacacagtcaaaccatagcactttcctaagagatacacattgcaggccatctggccagcaaggcatgcaagcagacctctctgcccaagatcatgaagcacataagacatatatatagccattggaaatgagcagagatacagcaaagggaaaagccctagactatagatggggactgctacattcatcatggtacagttaacccttgaataacttgggtttgaaatttgcagatccacttatattttcttctgtgtgtcacctgtgagcaagcgcttaataagtactaaatatattttctcatttttaaggttttctcaataacattttttctttagcatactttattggaagaatagagtatataatatgtataacataaaaaagggttaatcaactatttattttatcattaaggcttccagtcaaaagtaatctattactacataacttggagatgcaaaagttctacacaggttttcatctgcaccagtggtcagtgccccaacctccacgttgttgaggggacaactgctctttcagtctgtagccacatctctctggaacaggatcttggcaggtgggttgcaagtaaaggaatccagaaaataacatctcaaactgtgctgcatttgtatgatgattatataaaaccaaaggcatttagaaagcaggaaatgcacagggggcttttcctaaatatcccctacctgcctaaaagcaaattcttcagaaggaaaccaatttttaagaaaactcttcctgagaatttttatatcaaggaagattaacacaaaagaggaatcaaaaatggaagagactcaaagttgatactttacctagggaggtgattacctgttcttttgaggatgcatttctattctcatctattctctccaggttgcctacatttcccaattacctcttccctagaaaggaaacataaacacctggatctcattgagttatctgggtaatcaccttgctatgatatcctgctgcactttaagtgaattttgtttgccttttctcttattaatcttccttttgtcagtttattttcagcaaacatttagaggacaaatggagctttcttcctttcttccaatataagcaatttcccttaaaattcaggcagcttataaagcagcaggaaggtttgtgcagaggctacagcactgtgatttggctctcctagtcaggcatcagtaaaattttatggagtcctaggctgcagcccactgatgctgatgtagttggatccacttcccctcccacggaaccaggccgggacatttttgggcacattagagatatgagatataacgagtgcaaatccctgtccagtttcatctggaaccaactgatttctccatgtacctgggcagttgcttgataaaagattgagtgcctctttccaaaagatgttaacagggatcttggtgtctgggtcaggatgatgtccctgataaaaagtaaaagaagaaagtgtcacctatggtgcatggcagggacatgctccatgcagtgatcaccctcactaagagagatgaatgttgggaaataatacttaatggcagaaaagaaggtagactatgaaggtgcccaaaacaggaataaggtgcaaaacaggaataaggtgcagcccatttagtctctggatattaaagagacctagagctcttgataatggtggatctgtaattgctgcatgcattgaggaaacacggtatcaacttagtgtatctgaagtaaattgcttgatcttacagtggtaagaacaatggcataacaccattacctaacatttacaaatatatgtagcatcatgtgaataaattttatttttaatttttttttagaaaggagcaatgttaaactcacagaaatgttgcaagtatatgataagtaccaccttccctaacagaaatcacatgagagtcttttgaagacctgaaaattgtagggtctaaaattttactatgtgtttcctacaaaaaagaatattctcctaaataatccccatacaccaatgaaatacattgctccatcgactcccaaggaatatttcaaattgtcaaaaagaaaccataaaatgtttcccataacaaaatagtccccagtagaaacacattctctgcagacaaatttgagctaccttgatcttacctgggacacgtggggacactgagctggtgctgagttactgagatgcgccagctctgcagctgtgcccagcctgccccatcccctgctcatttgcatgttcccagagcacaacctcctgccctgaagccttattaataggctggtcagactttgtgcaggaatcagacccagtcaggacacagcatggacatgagagtcctcgctcagctcctggggctcctgctgctctgtttcccaggtaaggatggagaacactagcagtttactcagcccagggtgctcagtactgctttactattcagggaaattctcttacaacatgattaattgtgtggacatttgtttttatgtttccaatctcaggtgccagatgtgacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtataatagttaccctcccacagtgttacacacccaaacataaacccccagggaagcagatgtgtgaggctgggctgccccagcagcttctcctgatgcctccatcagctgagagtgttcctcagatgcagccacactctgatggtgttggtagatggggacatgaagtcacctctgcaccctaattcttttctctttctcagcaccaactgcacagacatagcaatgcttctccttatttaataaaaacagagatcatgacacctgaggagtctagtttatggcttcagttggaaatcataatgcagaagaagccactatagatattctaagcaggaatagtcttaatacagagaattagaataaactgctgaagtctaaataaaatgtagagatgaatctctaaatttaatgttttatttgaagagaaatatttgccaaatgaggcatacaggaaaactcagtggtcttcagtacgttggaagaacaaagaaaaagtcagtgttccatgaaaaagggaaatattacctattgcactttgagaaagttcattggcactaggaagggttgggagctggcaagctcagactggtaaacagtggtggacaaagtgaatcctagagttatatcaagttatctcagaaattgtggataaatttgatttcaggttacaataagccaaagcactgaaggttgcagagaattttcttactgaaataccagggacttggtgtagatcctgcagctcaccacacagaaagccaatctcgaagacaacaagtattgccaaggaacaggctttaatcaggtgctgcagccgaggagatgggacgccattctcaattgtatctctctgacaaaattaattaggggtttatataggagggaagaaatgttgaaaacaggaattagggaggggtaaggaagataatttggtcaagaagaagcaggaggtcagttatgcaatcacagtgggtgaaggttctgatgtctcactgtcccaattcagtgatatgtaagtttcagcttcttaatagtatctgggaggcctgatggttggtttactgaaaaaaaggactcaggtaagacagatgtaactatcttgagttttaagacagggagggggagacaatttctaagtttattcaaaaaaccataaaccttagttccatgggataacagggcctatttcaattgcattccagcagcaatattttgcaccctgagtgcctttccccactaggtttcttggctctgttgggtataacaagaatgaaccaatgcctatgattaacgttcagactacagcctttcaaagacaaggatacagtagtcaggaaagttgatattagaggcaggattctctggttctccctcagaaaacagaatgcatccgcccctaaagtaagggctttctaaccatgtggtcctcagtcctgtctggaagcttaggggtaggcgtgctgatgctcttagcttcctgcaacatccttccaggtgtttctccagtcctcacctctgtccttgtacctgtcttagttaccaatggataatattgagtcttccttttctgatttccaaatctcacgggaggaactcttattgggcaactctataggacacaagcacagcaaaaagggatatttacataagttaaaatgatttttaccccaatgagtccatttaaataaattatatttgaagccacatgttggaaacacatccagctttattttcttattaatgcaaatttacatttgcaaatattttcaggattgtaaagtttgaaaacataattatttgttcatggaatgatcaaacccttctataattaaatggagtaaacattttcttgaaaatgtgtactcactgaaataaaggaatatatttaaaatgtgtgaagctatgttagaaattattggacttaaattcaactgtgcagtttgatttgggatgttgttcactcctgtgacctgccacaagaatcttgtgtcatgtgtagtcactgctgttcagccttgtcctcagacaattcatatctgtaggctgaaggtgagctcagtgccctgcagaggaacgactcatcagagcccttccttggtcagccagaggattgtgaacgtgagcatccatgaacacgaaaacaaatgtttactgttttctgtcactgagttgtgtatttaaccagtaaccaatcattatgcataaaggcttcctgatacggtatttacacctctacgtgtatataaacatatgtatttttttcttaaattggtggtataaatgtgaatatttagtgatcaatttatgaagttattaagagaaaattaagaacagaattaaaactagtatttcaataaaaaattaaaatttaccttatttatggaaaaatgtgcatatatataagatacatagaagtgaatatatatttgtttgataaaatgttggctacaaatatatatagtattcatatttaagcacatttattctattatgtatgcaatactcttgctacagaaaatttatttgtagcctttatttttaaaactttaccaaatggttgtccttacctaaaatatttttccaacccagtagagctccgagggtaggactagagcaaattttgactaatgttgaatattaaccattgcatcctatgaaagtctccattatgttcatgcccacaatgatgataggccaaatagagttctcacaacaatgcacgctggatagagtcacattagtgtcattgtcaaagaagcactggaaatgtaaaaatcctaaccgtgggtaaactgcaatggttacatctgatgatcccattgcaagataacagcagtttaataaatattggctgttggttttgacagatcatcaagtcttaaaataaatgcaacaggctgatttcagacaaagtcattctgcaaaagctatgaccagacatttcaaaaatgagccataataaaaaaaatgctttccaagtgaatattaagtgaaatgccattaacaagcaggggcttttaataatcaggatgattcaacacatggacttcagtcaatcacctttcccagcttccccaggtagcctcatgaaccaatgttaataaggtccctgtggggactcagtaatgtgagtttcaactaactgagatgtacagggctattggctcttctgaacacctaatttgccaagaaaactgatgcctcttgaacccttaacattgtaccacacatcagggctcagactaacagctggtgtcaggtgattctagtggacctcatgcaacatgaggaaggcactggttatttgcaatatatgaatttgccttctttttcggttatgtttctgcataaaatattatttgaggattttccaagtgttttcatcagagtcaggaatttcttccataatatggctttggatcaagcagtttattgacctcaaaaaaagtgaagcaaagtgtagctcatgatcttgtcatgtgcacaggtgcagcttaccctatagacaaagaaaaacccattattagtcaagcaacgctggcacacaaactcttgtgctattgcattgttatgctgtcagatgtggtggaggctctgaaacactgttactctcataaacagaatatttatatattgaaaatgagctgtagactcatcattgctatgcccactgaacagcttgaaatactctatttctattttctcagggctgtggttttctggctgatggttcttaatccaaacagttgacatgacaattattgcatgaaattggaagaaatgatatgataagcatgtgaccattcagactcaatacaatactggataagttgtcaacacagggcgttcagatgtgtgctggggccatagatctagcccatataaagcaagagcaaacataattgactttacatattttagagaggaagtacagaaaatatggaccctaggggaccttctggaatctttctatttattgccatttccactggtaaaactcagagaagatttcaacagtcatcaggatgaagttctagggatcacagtcatgtgaagcattacttgcacttggatctccagtgaggcaaagggaagatgaaacacatcgtgggatgtggaggggtaaacaccagagacagacacctggtcagcttcaacgttgaaaagtgtatttattttttctctttagttttatcactgaatcatttggacctaagaaaagcgattatggctggttaggcagaaaggtgtttattatcatgaattaaatggattgaaaacatttggggaaaccagagtggaagctcaggcaactccaagtactccttttgctattgcttgaccctcctcgcctccatattttccacagtcaagaaagatactcccattttataggaacctggcaagtgaagatattgtgcccacaggactgtgctgcctggctgtgactcagaccaggaaaatgagcacatttgagtgagatcaggcatttcccctccctcatctcaatccaaaacgactctgtagtaacacatctgatgggcagtcagagaaaggggtcagatttctagcagttgatagttgataccagagctgctgtccttctgggggcagtagtgagaagagctgctctctcttctgctgcaagagacagcttgaatgtggagtctcaggcgcaggagatgctcccccgacctgtgccagcagtacgattcttggaattgttctagaggctttgactggagcctgttttttaaggcttttcaacaatttgtaaggaatttaataacctctagtaaatccctttttgcttcatggatttgacatttgcaacagggaatatacgcagtccgcagtgacatcattcacagcctcctttattcttgctaaatataatgctttccaggtggacctgccagaggaagccgatatgaacaacaatccatgtcaccaaaaatgcaagacaaataagctcgggaaagccactggattcttacctagctgcactgtccccctgagtctttttttttttttttttttttttttttggtcaccttagtcaaaagcatgaacaaatttgacaactttgaatggagccctttgcaacggtagccttcgaatctattcaacaatacatgtccaaggcatttctttaagacctttagagcctgcttgctcgatgtaaatccaggtgtccactatttctaggcatgctgactggagtctgtggcaatgtaaaattgtcactgggtgcaccagacttagattttggaggcaaatgtttcctgaagcagccaccatttgtgcctcttttgaatggcaactccttacttgctgtaggaaactgatagggcctgagtatctcagagctagaggaccaggagtgacactgctaccttaactacagattctcactttggtgcctacaaacacaatcaataaaactggacaggcccaacagatccaaattactaaatggaaatgttacagtaagaatcagccctaaccaggatgccacaatacccatgtgccccataaacaaatgacaagcttgcaagaagggaacaaatgacccacaggggacaattcagcttctcctttggccacatagagtcaaagattcaaagacatgcctatgtcaatatggcatggggccctgatgattgtacaaaacacatgccagtgggtccactgggtgtggccaccatccagccaggggatggcatcttttgattgacactaaacatggccattctgcccaatgggccaaactacatacaatgatagcagccatgcaggctgcccctaacactatattttgctccatttccattaaatcatgggccactttcaacaacccagtcatctggtcaggaaaacagcaactgagtgactgaactactaaaggatcccctgtgtggagaaaaggactatggcaatagcttgcttcctggactgctaaatatatgtcactctattagatgctcgggctaccatggccacccttgagaggaatttatgtcatattttggatactccatgagacttcactctgaccaagaaacaacctcactgcccaatcagcgtgacaatgggcacattctcgtggaacataacggatgttccatgtaattaccaacacccaacactgccttctgtacctggataaacacctcaggtatcctagaaatataagtagaggtgatcctgatgcaggctcaatggctgcagacaatggggcatctgaaagatccccctttcacctctttggcatcttaatttcttgatcatgggatcctagactaggtcactgcttttgggggtcttatcctcctgccagtggtagtagccttccttagaccagcgaaatgtactctcactatggcttaataatctgcactgagattgtgtaaatcaaggtgcttcgtcaatctgaaaagataaacctctgccttcagtttgggggacattggtgggtgtaggaaatatgctagctttactaagggggatgtctaggtggtggggtaactgcaagacagttctccaatgaccctgggctgacttagttctctccactttcttgattattttaagagttctcaagaataattgtagaatgtgctggaattgtaacatcctgagatagagaggaactggccagaacagcctacctgtgctgtattccagtttctcatagaatggaatgtccttaagcacgttagccctgtgcgtctcattaccccaggatataaaacccagagtgtctgcttttccggattcctgagctgtgatgcaagcggggtacacacagtcgactctatcagctccacataactttcgtatgccttgggggacagatccataatgagtccaagagttttgtgatcccttgctgcttatctgtaataataaacccccttcatgtaacttgctgtgtgggggtgttgtgttcctcgcgctcaggtacgttggtaaccagtgtacagtgaacctgcttcaaagatgtcactgacatagaggcagaactggaatggaggttgctagggataaggatagaggaaacggggggagtattgtttaaggggtatagatattagtttttataagacgaaaagaattctggagacagtatcggtaataatagcagaacatgtgaatatgcttaatgccactgcactgcacttttaaatatggttaagatagacaattttatgttctctgtattttctacagttaaataattgacatctttattatagtattgttagctcagaagacattgctttattttgtaattttcttagccaattgttcataaataatcacttcgtgatgccactgttcacaaattgtgtgtgtgtgtgtgtgtgtgtgtacacatgtggtttccctatgttgcccaggctggtatcaaattcttggccttacgtgatccttcctccttggtctctcaaagtgctgagattacaggtgtgagcccgagcaccctgccataagaaacaatgtataagacatttcataggggacttcttcaaaatatatatttcattgcagccacatccaaagccaatctcctaagccatgtttctgtacacaagtgcacttctccctctgtgatgtcacatcccctcagcataaagtcacacagacacataggagaacaaggctaggagtcaacccaactttatgagtggaaatcactgcaaaaatctggcattaataggttttaggtgttgcagcacttctccactagcaaaacaccctctgatttgtcttcctggattgttttctcagaggtttcctaatatttaatgctaaagctgagattagaacctttttatccctagtctagctgaatgctatttcactcaaaatgtattgtcttaaggagtatgataataaatattggataatgcctgttactactcccaacattccctttagatctcctgttatcatcctaaatatcattacttagaaaaagtgtttaaaaggggttaagacaatattgatcctgttttcaatatcctgatacaagtcaagcacccacaaaagtcaaggaaattgtaaggaaaacatgacttaatgatcattagccattctggtcactgttgagtgatgattaagaaaaagtcttaaaaacaagtagctgaaacattgagaactctcatcaattctgggctgagatgtaaaatggtataaccactttggaaaacagtatgacagagtattaaacacttactgtaagacccagtaactgcactcctaggtatttgcctaaaagaaataaagaaatattcatgcaaagccttgtataatgccattcgtggtagctttatccataatagcccaaagtggaaacaacccacatggtcatcagcaggtgatgggatacattgtgaaattactacatatttaaatagtactcaaaagtaaagagtaacacatcacgaggacacaaggcgacatgaatgagcctaggaaacaattatgctgcacgaaagtcaccagccacaaaagaacatgtgctatattcctttatgtgaaattcttaaaaagatagtggaatctatactaacaataagctgaataaggatggtctgttctgtgaggtggaagcaagttgattgctgaagagcaggacaaaactttttggagttacagaaatgttgtgtgtattgattttgcttccaagaatgtatttatttattaaacccaacagtacacttaaaatcagtgtatttgattggaatcttttttttcaataaaattggttaacagtgaatagtgaataattgcaaatccaattaagtaacattgtcttcacatcttttattcttgcagtgtcctggaagctatatgagccaaaagttatttctgggagataatctcagcctgacactaaagaactgtgtatcttctggcaagagctcacttttctaggtatttttggatttttccaagaatttaaatatatttcataggttaaatcaaaatggtaggcttttaatacacatttcttatttatatcaactaaaattctaagcaataaaaagtcattaaaaattggtaaagaatttaaatgtgaagaaatattttttaagttaggggaagagatccaacataccttatagttcatatacatttttcagaaattaaaattacctatcaagagtttttataaaaactgtaacactttttacaatgtgtgttcactaaatgtgcagatatacagtgggattgcatttttctttttttcttaagatatttatttttatattcacaatggatatcagcctttaatttctttgttttgttatgtgcatattaatttttggactacaggacattatgacctcctataataattctgagagtattttttattcacttgaatctttgtgtaactttgataagtaccatgtcactaactaccaaatataaaattggagttttctgtctgggtaaattttcattacagatttcttgttacttttgaggcaagaggtaggcaggactccgctcaggaccagatgtgaggctggccaaaacaggaacagggttctgaaaggacctctccataagacatacccaccagtgccatgagagtttaccattgccatagaaacatccagaagtcacagcgcttgccatggcaacacctggaaattcctgcccctgccatagcaacacctggaagttggggcaacaccacccattttctagctatttctgaacaacctaccccttaattatcacatgattaaaagtgggtataaatgtgactgtaaaaatgcccctggctgctactctcggccctctgcctatgaattacccctgctccgcaggagtagtcacagagctgtaacactgctgccccatcaataaagctgttttcttctattactggcttactcttacattccttcctgagcaaagctgaggacttgccttgcatcaatattgagccagccactcaccactagagatggtgagaagcagcatttgatgtggcagtaagacagtggaaacagcggagaagcaagacagcaagagacagcaagagatggcactttatgagaagatggacacagtgatcagcaatgggcaagacagctattggagaagtggcaagacagcgatcagtgagagaggatgagacggtgatcagcgctacagcgatcaaagctacagtgtctgtgtgtctgtgtgactttatgctgagttgttaacattgcagagctattaacactagccaaaggctgttttaagaaccatcatctttcctgacaggtgttggagctctggggatgggcaagaggccacagagccactgcttcatgcaggccagccgctccgtgctccagttcccccataggagcccaacccatccgagctgggaagcctggagagatcttcatgcaggccccatgtcagacactgcttggccccattttggctcctgcacacctgtaagtgtcccatctatccacctgcctatatagatgatccaggaaataaggcctttggctagatagtccatttgaattcccccatagcacacctgactacatcctcattgttctttctcttagtcatttctcctctaatgccattttatttatccatcagccattttattttattttctgccccgatatatgtgtttgctttgcagttttttctttgggtccctgctaattatgtttgtgcaattgtttaaggcaggacacttggatgtaagaattctcctgttctgttgactctaagaagccagagtcacattgttttatggccccaaccaggcctttggggctcattgttggccaccccactgaggctccaggattttctgcactggtcagcccctggatactccagggtttcctggcatttggtgtggggacactcataggctgttacttgggtattctgggttttcagcatttggtattttgggccactatctggatgctccagagttttcacccttgacattcctccttggattgtgcattggaggcttgccctacaggaatcttggtttgccttttcttgttttctgccctaaagttatcgttttccattacggcattttgttttcttattgtcaccttacttacactttttcttctacactttacttaataaaaatattgcttaaatcccagtgcggtggctcacgcctgtaatcccagcacttttggaggccaagatggacggatcatttcaggtcaggaagaccagcctggccaacacagtgcaaccctgtctctactaaaaatacaaaaaaaaaaatgagctggacgtagtgacacacacctgtaatcccagctacttgggtggctgaggcttgagaatcactggaacccaggaggtgaatgttgcagtgagccaagattgcacccactgcactcctgcctgggtgacagagtgacagtctgtctcaaataataagcaatagaaatttaaaaataaaaaataaaaatactgtttgagtcatattttgttcactaacaaatgcttacaatccattttcataacgtctggctacctatatgtataccttctatgcaggaagtggaaatctgagatgagaacaatgatggcccagtctctttccctcttgttggacttagaaaaacttctatgtccagtagaaatccttgttagacatggggacaatggcgagcatcacagaggacttaccactagggtgtctattaggctattggagcaaattcaaattcagcttaaagaaaaagaaactcattttctatcacaacactgcttgggttcaacacaaattagaaaaccaagagacttgtcttaaacatgagtccatacattataacgctattttacatttagacttattctgtaaaaaagaagaaaagttgtctcttgtgtacatgcttgtgtggccctttactccctcctgttattagctgggtgtggtggcacatgcctgtaatcccatctacttgggaggctaaggcaggagaaccacttgaaccagggagatggaggttaccgtgagccaagatcgcaccactgcactacagcctgggcgacagagcaagatactgtcaaaaaaaaaaattgtagctttgaattttaaacatctatttgacaagaaatgcatagttccttctctttaaaataatgtaatgtttctttcaagaataagcttggtttgatgcctctctccccaacatgatagaagtgtagcataaatctatgaaaaattccatttccctgtgcctacaacaactacctgggattgaaaacttcttcccttgctctagtcctttcttctacacctacttccacatcatctgtgactcaaaacaatacttgtcaggaaagatcccggaaagagcaaaaaagacttccttagaggtgtcagagattcctatgccactatctgtcatctctagaaggggttgtgagtatgaggaagagcagagcttgtaaattttctacttgctttgacttccactgtatttcctaacaacaacaaccacagcaacacccataacatcacaggacaaacttctagtacttccaaggctttagtctcagtaaatcttctctacctccatcacagcagctagaaggtttgatactcatacaaatagtactgtagctttctgttcataattggaaaaatagacaagacccaatgtaatacaggctttccttcagccagttagcgttcagtttttggatcaccattgcacacatatacccagcatatgtctaatatatatgtagaaatccgtgaagcaagagttataatagcttgtgttttctattgtattgtattttcctcttatatcatcttcttcttcgttcattaaaaaaaaaccgttcaagtaggtctaaattaattattggatcataagtagataaaatattttatttcataacacattgacccgatgaatatgtttctttgccagacatagtcctcatttccaaggtaacaagcctgaaaaaattatactggagcaagtcaacaggtaatgatggtagcttttccttattgtcctggggcaagaataagacaaaagataacagggtagaataaagattgtgtaagaaagaaggacagcaacaggacatgggaaccttttatagagtaacattttgataatggatgatgagaattaatgagttagacagggatgggtgggaatgattgaaggtgtgagtactttagcacagattaagaccaaatcattaggatttaaagagttgtgtagagttagtgaaggaaaagccttagaattaaatttggctgtggataaaacattcttggattagactgaagactcttttctgtgctaagtaagtatatttatgataatgatgatgactgtagtgctgaatatttaataaataaaaacaaaattaattgccgcatacataatgtcctgaatactattgtaaatgttttatcttattttctttaaactgtctacagcactataaggtaggtaccagtattgtcacagttacacagatatggaaaccgagacacagggaagttaagttacttgatcaatttcaagcaatcggcaagccatggagcatctatgtcagggctgccaggacatgtgactgtaaacagaagtttttcactttttaactcaaagagggtatgtggctgggttaatggaaagcttcaggaccctcagaaaacattactaacaagcaaatgaaaggtgtatctggaagattaagttttaacagactcttcatttccatcgatccaataatgcacttagggagatgactgggcatattgaggataggaagagagaagtgaaaacacagctttttatattgttcttaacaggcttgtgccaaacatcttctgggtggatttaggtgattgaggagaagaaagacacaggagcgaaattctctgagcacaagggaggagttctacactcagactgagccaacagacttttctggcctgacaaccagggcggcgcaggatgctcagtgcagagaggaagaagcaggtggtctttgcagctgaaagctcagctcccaccccagctgctttgcatgtccctcccagctgccctaccttccagagcccatatcaatgcctgggtcagagctctggggaggaactgctcagttaggacccagacggaaccatggaagccccagcgcagcttctcttcctcctgctactctggctcccaggtgaggggaatatgaggtggttttgcacatcagtgaaaactcctgccacctctgctcagcaagaaatataattaaaattcaatgtagatcaacaattttggctctacttaaagacagtgggtttgattttgattacatgagtgcatttctgttttatttccaatttcagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctcccacagtgattcaacatgaaacaaaaacctcaagaagaccatcagtgtttactagattataccagctgcttcctttacagacagctagtgtggtggccactcagttttagcatctctgctctatttggccattttggagctcaagttctcaagtccaaaattacttatgttagtccattacatcataccatttcagtgtggctattacattcatttaaacgcatttcagaaggcatctctgtttatggcatcacaaagagtttaataaatctgtgcaagaataaacaacaaacacacctataaatataaagttgaaatatcaaaactatttcagcactctgaaaattggcaaagcataaaataattaaggatgcatattctttatagaaaaaaaaagtactagtgctttgagtaaggacagaaaatgtctgtagccttttgcctgtgacagcacccttctattcccagctcagtcaatatgaattgcagaactggagttttacccatgtaaggatagcaaataaaactggcagcttgctgccaaagtgggtggacttgagtgaagccaaggagtgggaaataattcttcagtgtttccagctaaacagggagaacaccataggaaatgaacagaaaaagcccacagccttgctagtccaagatgatgccttgtttgaggcaagtagtacatctgctgatagtaaatagcagattcctggataagatagacccacattgctgaaataatctctgcacatattcctagtgacctagaagttatagatatgagtgatgagaactaggagtttccggtgcaaagtaaaaccagagggaggtaagaactagctgcattttgcatgcagtttgctttttaaactacacacagatgggttgacagaagatagatttataacctccagatatttgagcaaaatgtctcagatcattggtgaccacttcgctatgcagatacatgtgtagttcctataaaatcaaactaaatattaatattaagaacagaaagaagcagagatatctgtggtcaaacgccacatgagatacagatttttctatatcttgcattgaaaatacatttaatacatctaatccacttaacattatgcctcagcctatcctatcctaaatatgctcagaacacttacattagcttactgttggtcaacattatcttacacaaagcttatcttacaataaagtgttgaatacctcatgtaatttattgaatactatattgaaagagaaaatagaatagttgtgtaaatactagaatttctatttctacttgaatgcatatcacattcacaccatctgaaagtcaaaacattataactccaactgtcataagtcaggtactatcagtaagttcagacaagaaactaagaagaaaattaaaaaatgatcagaaaaacaaaacaaattccaggcctgacatggtggctcaagcttgtaatcccagtactttgggaggctgatgcagaaggattacttgatgccaggagttcgagaccaggctgggtgggcaaaatagtgacactcttatcttacaattaaaaaaaaaaataacagagagtggtggcatgcccttatagtcccagctactcaggaggatgaagctgcagaacctctggaccccaagaggttgaggctgcagcaagctatggtcacagcaccacactccagcctgggtgaaaaagtaagaccctatttctaaaaaagttaaaattaaaataaaaaagcccaaaatctaaagacagctactataatatgctatcaaaaatgtacaatttttagtttcacaacttctggaaaaaagcagagaagtatgaacaatattaaaggaataaaaataaagcagctacaataataacaacagaaaatagtcaatgaaagctaattctaacttgtcccaattattggatttagcaaagactacaaagcagttaatatgcagatgttcaaataattatgtttaaatctatgatcattgacataaaaaagaaaatatttaaaaaaaaaaagaagattcggcaagtaggggctcaagaaaagacatggaaaatataaaaaatgaccaaattggaactctagaaatgaaaagtacaataaaccaatttaaatatttgttagctaggtctaatagcaaattgagatggcagaacaatcagttaacttgaaaatagaggtatagaaattattgagtctaaagaaaaagtttagaaaaaaaagaagacttcagagatttatagctcagagtgaagaataccaacaaatgtataataagagtcacaaaggaggagagaaagagaaagtggctgaagaaatctttggagaaataatgacaaaaacttttcaaaagtaataaaaaattcttagatgaaaaaattcaataaaaatcttttagataatcaataggaattaataactgaacacattatattaaaatattgaaagacaaagagaaaatcttcattgcatcaagaatgaaagcagatactatatacagaaaaacaacaacatagccattggctgagttttcatcaggaccaatagaggctagaaggagtgaaatgtcatatttaaatgctgaaaggaaaaaaaaaggcaaccaggaaatctatatccatcgaaaatacccttcaaatctaaagaaaaagcaaaaaaattatttgataaacaaaatacattcattcatagcagctatgtctcttacaagacatttgagagaaaatccttcagaatcacaggaaatgacataagacaggaccttgaatcctctgaaagaaatgaaggcctcaaaagttgtaaggagcaataccaagtctaaaaagataaaaatacacttaatgctatttatataaagtttaagacaggaaaacctaaatgattgtatagatgtcagaaagacagttaattttgctgggtgggaggggtgataactgacaaagattgtccatgagggaagcacaagggaatgtgaaatattctatcattccatttggacaatgaattacacaaaaactgtattcagttgaacattcaagatttatgcactttactctggctactttatcagttgaaataaaactaataaaaaccaaacctagactctttcacatttaccagtaatcacagccaagagcccagactaatttggattattattattattatcaccacttcaataccctttcttgacatttacactttttatccagctacagtttcacagctccacctccggcccattcttttggaagaccccatagccataggttaggtaacacctatggaagactcataaatgacatgattgatgggtgtttagcagaaaacaagtagtatgtatcacagactgtcctatgcagagggtacaatacacgtcagtgagagagtcccactagcacagaaaagaagtgtgaactacaccttcagaatatggtccagattttagagttcatcagatgaacacagatcaaggtgtcctctcatctgggtatgggaaagtgaaatgactgcaggttctccccagatcagtggcctctgtctttggagacgtgtacatgaatctcacatttgttcacatccacagtcacttcctggcttcacccatagcaatgatggtctggcttcgttatttaggaactctgcacataggctgtcagttactaaaatgaaaattaaaaacagtgactttggttaaatgtatatcagtaggtacatccttgagggaaaaatgagcagaggtgacatattttaatatcaaataaaaaatcacaatcttgtgactcctttctcttcccatataattcatgatggttgtactgatatttcagagtatcaaatgagtcttatattttcatccctatagctttgtccttctccaacctgagcccacattttggccatccagtggcttccgagcacacttgtgagatgatcactgtccaaacaggattgctgggataactcacaggcagctccatgctgagtctccctttgaactcccagcatcactgaccctgaaggagtgtcctcctgtcatccaaagcacccagagcacagcctgccctgtggtgatttcactgcccaactcaaaacctcatcacagattccactggctcagagacaaagtcaggtcccaggcagaggctggtgtgggggcctaaaaaaaccctcttttcatcaatctttctgttagaaatttccagggatttataagctgaatttctataatagttactatcttaaaaataaaagctatttgtaatatgagaaacataaaacatgggaaataattaaaacccacaagagcatcatatagtcagagactcaaaattcacctaatctaattcggagctccctgccttatggtccatctccatggtgtctatgtgctccacccttatcaaatatatgttcaaagaattattttaacctataataaaagactgaaaaaggaatttgtaaagacaatgattcaaccaatagaggctctcaaacagagacaaaactatgaaaacaagcatactgggaaatctagaaatgaaaagtacaacaactcaattgaaaaatgtattagatagactcaatagcaatttaagatgacacaagaatcagtgaactgaaaaacaagtcaatagaaatggtctcatataaagaaggaaaaaattataaagaagaatgaataaaacctcagacattataggtccatgtgtataataccaacaaatttgtattaggaatcacaaaggagaagacagaaagaggctaaaaatgtgttcccatctttatgcccatgaataccccatgtttagctcccacttataagtgagaacatgtggtttttggttttttgtttctgcatctgttcacttaggaaaatggcctccagctgcatccaagtttctgcaagggcaagattttgttcttatttatggctgcatagtattccatggtgcatatataccacagtttctttattgaatccctggttgatgggcacaatagacattgtgctagaaggaacacaaagggagaaagggcaggggctgaaaaactacctatgggtacaatgttcactaactggttaataatttctgtcataccccaaacctcagcatcatgcaaaataactttgtaacatatctgtacatgtatggtttgattctaaaataaaaactgaaaaagaaaaaaatggagaaataatgaaaaacatttttcacaatgatgaaacacattagtctgtacatgaaagtaactcagtgaaacccttctaggataagcacaatacagttcataacaatacacattatagtaccaatgttgaaagacaaagacacagagaatttggaaggcatcactaaaatactgacttactctatactaggaagcaataataaaggtattggctaaattttcatcattactaatagaggtgggatgagagtggaatgatatatttaaatgctgggggagaaaagtcagccacaaatgctatatccagcaaaacaatcatttaaacataaaagcaaggtagaaatgttccttcatacacaaagactaattcattatagcatatgtgccttgtggaaaattcaagagaaaatccttcagaataacagggaatgagagcagacagcaattcaaattgataagaaggaatcaagccctcaaaaaatgaaagaaataagaaagaagctacaaaaaatgtttacctgatatgaagattaagtacaggaaaaaaaaacaattataatagatgtcacagtatcagttacattgattgtgttttgagcagcagttgctgactgggaaggtgcataatgaaagcagcaagagaattggaaaccttccatattttgatgtggatcatgacatgaaatgatctggattttgacattcatttgcacccttaagatttgaaccttttgcactgtgtgtttttccttaaataaaataaaataaaacaaacctaggctcttttaaataagcctgaaccaagaaataagaatcaccaaatatttatgaaagctcaaccttattaaagagaagtgtaaaacatgcctgagaaagtcctaacgaactagaaattgggtagaggaaatagcaggaaacatctaaatatgtcccttctgccactcaggaaacagattttacctctcttgatatccttaaaaacataaaatatatttatgtcattttgctcacaagagaggtccccaccttctccttggctctttccaccccactgcacccaccaggggatttgcatactgtcccctagggaagaccttcccttgtgagtctgagataaaagctcagctctaaccttgccttgactgatcaggactcctcagttcaccttcccacagtgaggctccctgctcagctcccagggctgctaatgcactgggtccctgctgagagcagaagggaaatgagggaggatgatggggtgggagggtgaactctgtgggccctgccacctcccatgtgtgttctgtcctcgtgttagatgtgtcttgtcctccaggatggggcatgtgatgtctagatctgtgagagtgaggaagattccagaaggagcaaggacatgtactttagtgaaagctgtgacacagaaagagggggatgggataggtgacttctagaggcttatttgtgctttgcaaatcttggttctttttaaacctgtatgttttgggagtattaaccaaaatcatacacaaaaaataattgagcaaaacataaataacagacagaaaattattaaaatggctcacaatgtttgtacataaccttgcacttctctcttattatttcaggatccaatggagatgctgtgtgacccagcctctactctccctgcccgtcacccctggaaagccagcctctatctcctgtagatccagtcatagcccctttcacagtaatggatacacctatttgaattgggacctacagaagccaggccagcctccacggctcctgattgatttggtttccaacagggaccctggagtcccagacaggttcagtggcagtgggtcggggacagatttcatgtttaaaataaggaggatggatgctgaggatgttggggtttattgctgccagcaaagtacacattattctcccacaatggtacagtcctgaacacaaacctccctgcttgctgtggcctagctgcccagatgtgttgtttctgtggagagcaggcactgtggattctcttagatgcctaaagaccaagatgttggagaactcagaggacttggtacagctgagggctcatgaccataaatttctcagctacacctcaggcaccacattttaagttcccatcagctgcagcggcctttgcatgacagagtctgcaaaaaggaggaggtacacctcccctttgagcaatgagacacgagagaagagaaagctcaatgaaagctcattctaagcctctcttccttccctacattcattcatcaagtaaattcgttctgcgtaacaggcacctaattgagactgattactggcaacgcaaaactaatacattcttttgatttggtttagcagttactagagtatatgtatgttgataaggtttggtaatattaaaacagtttccctcccctcctccacctccccccaccacttttccgaaggcagacccctgaccaggacaccagcaggcactgtattttttcctacttttttcagggagtaccaaaatataactcttcacggtctagatttttaagttactagatatgttgctgcaaatgtatgcaaaaataaagacctagtgccaaaagtctttccacagtctcaaccacagcatgttgaagtaaaaagtagttttctgaactccaaagctgggtttcaacaataaggaccaagtttgaaagaataaaggaacataagtatgccatcttaaacagaattacaagataatatgtaagccatatttttaccccatgaaaaataaccatctgaagacttggagcagaggtcagtacgtgagagactggtgggttgcgtttgagatatgaacccagatgcaagttcttatgtatttcctgggaagaatcacagagtcgagagacccctgcctggcattcaaggctgggccctgatgccactgcaagctcctgaggaagtgctgcatcacacagagctctaggtctgtgtggtgactcaaaggttaccttaggtcatatcacacattccaggtcaacccagcaggaaatagatgatcttccgaaggttgattctgcttgtgtcacttacctagaaataatttgagagagaaattttaatacactatatgtgtattaggcattaataagttgaggatatcttctgtataataatcttgcatatttagcaagttaatataagaaaaaatctataattaaactaattcaaatgaaagcatgaatcaagaaaatcagaggaaacaagacggtaggtttaaccctaactttacaataattgcatcgtaaataaacaaatttttccaagtaaatcataaaattatcagacaggattaaaatcaaagatgtatgttaatcattaaatacacactatagtaagaatatagaatggctttgaaaatgaaaggatgaaaagtacatatcatgtaaaactgagcaacagaaactaggtcatgactttaacgcaagagataaaatggacattttataattataaattggtaaatccatcaagaagccattaaaattctaaatctgtctgaatcctgtattagtctgttttcaccctgctgaaacagacatacctgagactgggaaatttacaaaaaaagaggtttaatggacttacgattccataagctgggggggcctctcaaccatggcagaaggaggagcaagtcacatcttaacgtggatggtggcaggcaaagagagagagcttgtgcaggggaactcctctttataaaaccatcagatctcatgagacttactcactatcataagaacagcatagagaagacctgccctcctgattcaattaccaaccaccgggtacctcccacaacctgtgagaattcaagatgggatttggttggggacacagccaaaccatatcactctgcccctggcccctcacaaatatcatgtcctcacatttcaaaaccaatcatgcctttccagcagtcccccatagtctcaactcatctcaacattaactcaaaagttcacagtccaaagtcttatctgagacaaggtaagacccttcaacctatgagcctgtaagaccaaaagaatgatagttacttcctaggcccaattgtgggtacaggcattgggttaatacagctgttccaaatgggagaaattggccaaaacaaagggactacagaccccagacaagtctgaaatccaggagggcagttaaacctaaagttccaaaatggtctcctttgactccatgtctcatatccaggtcgcactgattcaagaagtgagtttctgtggacttgactaactctgtccctgtaggtttgcagagtacagcctccctcctggctgcttgcaagggctggcgttgagcatctgtggcttttccaggtgaacggtgtaagttgtcagtggatctaccattctgggatctggaggacagtgcccctcttctcacagctccactaagcagtgccccagtaggggctcagtgtggtggctccaaccccacatttcccttcggcactgccctagcagtgctccatggcaccccacccctgcagcaaacttcttgcctgggcatccaggtgtttccatacatcctctgaaatctaggcgaaggtttcccaaccccaattcttgacttctgtgcacctgcaggctcaataccacgtggaagctgccaaggcttggggcctctgaagccacagcctgagctctacattggccccttttggccatggctggaagagctgggacacaggccaacaagtccttagtctgcacacagcatgaaggccctgggcctggatcacaaaaccactttttcctcccaggcctctgggcctgtgatgggaggggcagccatgaagacctctgacatgccctggagacattttccccattgtcttgaggattaacaacattgggctcctcattacttttttaaatttctgctgctggcctgaatttctcctcagaaatgggatttccttttctatcacattggcaggctgcaaattgtctggacatttatgctctgcttatcttatgtaactgaatgcctttaaaagcacctgagtcatttcttgaatgctttgctgcttagaactttctcccaccagataccctaaatcatctctctcaaattcaaagttccaccaatctgtagggcaggagcaaaatgtcaccaatctctttgctaaaacataacaagaataacctttgctccagctcccaacaagttcctcatcttcatctgagaccacctcagcctggatttcattgtccatatcattatcagcattttggtcaaagccatttaacaactctttagggagtttcaaactttcccacattttcctgtcttcttctgagccctccaaactgttccaacctctgcctgttacccagctccaaagtcatttccacatttttgggtatcttttcaatagcggcccactctcctggtgccaattgactgtatttgcccattttcatgcttctaataaagacatatccgagactgggcaatttaccaaaaaaaagaggtttaattaagttacacttccatatggctggggaggcctcacggccatggcagaaggcaaaaagtagcaagacacaacttacgtggatggcaaaaggcaaagagagagagcttgtgcagaactcctcttcataaaaccatcagatctcaagagacttattccctatcatgggacaaacacaggaaagacttgccctgagtattatgaacaatgtcacatcggtggtgatattgggagcaatttcatcctctccaccacagggtactaggaacaatatcacaaaagaggagtaaatcacccctgatatggagaataatattatcttctccaccacagggtattacaaacaatattacagagggggtacactgcatgtgatattaggagttatatcatcctctccctgcctgggtattacgaacaacaacatcatgctgggccagggtacaatgccaagatattgggagtaatatcatcctggcagccctgtgtattacaaacaatatcatggcagggagtacgccacctgcaatactaggagtaagatcatcctctccctcccagatattacaaaaaatgtcacaagagggtgtacaccccccacaatattgggagtaatatcatactctcccctcctggatattacaaacaataggacaggggcgtgtatacacaaaaagtttatgatattgaaagtaatatcatctccaatcacccctggatattatgaacaatatcacagggaggtgtacactccctgagatattgggaataatatcatcccctcctcccctggatattaggaacaatgtcacaggggtatgtacaaccccgtggtattgggcgtaatatcatcctctccccacctggatattatgaacgatattacaggggggtgtacacaaaaggtgtttacgatgtttaaagtaatatcatctcaaatccccccggatattaaaaacaatatcacagggggattttacaccccccactatattgggagtaatatcatcctctcccctccaaatgttacaaacaatatcaaaagggggtgtacattccccacaatattggaagtaatgtcatctccccccgattattaccaagaatatcacagggggggcacaccccccacgatattgggcataatatcatcctctcccctctctggatattatgaacaatatcacatggtggtgtacactccccgcaatattgggagtattatcatcctctccccctctgaatattacgaacaatatcacaggcgggtgtacacacaaggtgtcaacgatattgaaactaacatcacctccaatccccccctggatattacaaacaatatcacaggggggtgtacactcccggcgatattgggagtaacatcatcctctctcccacttcatattacgacaatatcacagtgggttgtacaccccccgcaaaattgggagtaatatcatcctctgcccccctggatattatgaaaaatatcacagggacgtgtacacttcccgagatgttgggagtaatattatcctttcccccactggatattaggaacaatatcacaggggggtgtacacacaaggtgtttacgatattgaaagtaatatcatctccaaccatccctggatacaatgaacaatatcacagaagggtgtacaccccccgcagtgttatgattaatatcatccttcccccctgaatattaagaaaaatattacagtggggtgaacatccccggcaatattgggagtaatgtcatcctattccccgctggatattgcgaacagtatcacagggggctgtgcatgccccgcgatgttgggagtaatttcctcctgtctctcccaagatgttatgaacaatatcacagaggcgtgcactcccccgcgatactgggagtaatatcatcctcttaactccttaacgaacaatattacaggggtgtgtaaagccaccgagatattgccagtaatatcatcctctcccaccctggatattatggacaataccaaaggagggtgtacacacaagttgcttacgatattgaaagtaatacatctcctctcccccactggacattatgaacaatatcacggggggtgtacaccctccgtgatactgggagtaatatcatactctcctctcccggatattacgaacaatatcacaggggggtgtacacacaacgtgtttacgatatcgaaagtaatatcatctcctctctctccctggatattatgaacaatatcgtggggtgggggggtgtacacacaacgtgtttacgatatttaaagtaacgtcatcctctcccccccaccccgaatattacgaacaatatcacaggggggtgtacacacaatgtgtttacgattttggaagtaataccatcttcccttcccccacggatattacgaacaatatcacaagggggcgtgtacagcccgggcgatattgggagtaatatcgtcctctcccctcctggatattatgaacaatatcacaagttgggggtgtacactccccacgatattgggagtaatatcttcctctctccctggatattacgaacaatatcacaagggggttgtacactccccgcaatactgggggtaatggcgtcctctccaaccctggatattacgaacaatatcaaaataaggggtgtacaccccccacgatattgggagtaatattgtcgtctccccccaggatattatgaataatatcacaagaggggtgtacaccccccacgatattgggaataatatagtcctatccacccccctgccggatattatgaagaatctcacaagggagggtgtaaaccccccacgatattggtagtaacgtcatcctgttttccccctggatattaagaacaataacacaaagaggggtgtacacctcccgcaatattgggagtactattttcctctccccgctctggatattaccaacaatatcactatcttgactagtggttttgacagatcatcaggccttagaagaaacacatctgaaggattggacacaaagtcactctggaggagatatgactggaccttccaaaaaaggaccagtagaaaaaataaatcctttccaagtgaatatttatctaaaggccattagaagcaggagctcaaaataattaaaataattcaaaacatggacttcatcagttacctttcccagctttcccagggaatctcatgaactgatgtcatgactatccatgcatgggcttaacaatatgaatttcagttaactgggactcatggggatactggcacttctgagcatccacttttccaaggagaataacccaagattgtaccagacatcaaggatcagactaacagctggtgtcaggtgtttttagcaggcctcatccaacatgagaagagcagcagttgttttcctgtatatgcatttgtctttctttcagttatatttctgcatgaaatattatttgaggattttccaagtgctttcatcacagttaagaaattcttccataatatggcattgaatcgggcaaattatttacaacaaaaaagtaaggcaaagggtgcagttcatgatcttatcacctgcacaggtgcagccgtctctatagaaaggagaaaacatattcttagtcaagcaaaactgacacacaaaccctaggtaattgaattgataccctatcagatgtggtgaaggttctgacacgctaatcatgtatgatgctgtaacttccatcaaggaatatatgtatagtgaaagtgagctgtgtactcatagttaattattatgccaactgaacagctggaaacattggtcgctgtggcacccactgaataaaaggagactcagtggcaggtaggcccctttgcgaatgggagacggcataaacctcacctgggtgttcttttggttcccttagtcaaaatcatgaacaaagttgccaactttgaaaaaggcgttttgcaacagtagccttggaatctgttcaacaaggcctggcccagtcacttctctaagatttttacagcctgctaaccagatggaagtccaggtatccacaacctctatgcatactcagtggagcgtatagcaacagaaaactatcaatgagtgcaccagcctctcaatcttaggacacataagttgcctgaatcagccactgaatgtgtttatattgaatggcaactccttgcttgctattaggcactgatggagactgaacatgttaaggcttcagcaccatgtgtgactgtgacactggtcccttagctgtccattctcacttagatacttacaaacaccattagtaaaactgaacaatctgaacagagccatgttatcaaatggaaatggcacattcttgatcaggtttagtcaggaccccacaggatctgtggctccatgaacaaatggggagcttgctagaagggaccaaataacttgtaggtgataatttggctctttatttgcccatgtggagcccaagattcagagatttccatatggcaggagtcactgaaggctgagcaaaatgctaactgacagatccactaggtgtggccaccattcagccagtggatggccacttttttaactgaaacttaacatgggctttctacccagtgggcaaaactacattcagtggtaatggccatgcaggctgtcccaacaacgcaccatgccacatatccactaaatcctcggccattgtcaacagccttgccatctgttcaggaaaatggcaactgagagactggactattaaagaatccccagtgtgaaggaaaggactatggccacagctttccacctgcaggaaaaagaaatatgatgctgaatttgatgctgggactacctaggtaacccttgagtgcaatttatgtcatatttttggatactccatgagacttctcactcacaaaggagcatctttcactgcccaagcaacgtgacaataggcacactctcatggaacacgatgaactttccatgcaccctgcatccacaggccaatgatcctagtgaatgctagatcagtggaatcacacagcaatatgcagaaaggacatctacaaagtctgttaatggggtggtatcccatctgactagagaaatatgtacattaaagatcctgggccacaaaaagggaaatagtgcatgttgagaaacacagagctgggtggaagtaaaggtaggccaggcagacacttatattagtctggacctgtgaaagctatttcagtgttcctaaccattccttttctttttttcctttagaatacatgctctggggtggtttgcaatctaggccattacaatgccccagacaggccccctaactctaataggaggattatgtttcctctgggtgcttcctttctacaagatcccacagtgatggataacaagactaagaaatatcacggagctaggggccctcttctggtgccagggacatcttatcctccctttagtgttggtgatattatgaaatatgtccagtttttacagggcagaatctcccttcctggagtggacaatcaggactgaaatatctggatcaagtgacaaaggcaatggattgttcacagagcaaggacagccagaccgcattcctacaccaacacggcccaacccttgtagatgggtaggggacacctgagaccctgggatgggtgagagacgatgcattaacctgtgaggctgcattttgacaagaatgaggcagcaaaggcctagaagcacaatgtctttgttagcttcttttaggtcaccagggtgatctttcaaaatagtgaatctcccattcttgacctcattctgtcattaactagaggttccctttcattctaccaagggtaaattacaccaacattcctaatactaaggtgtacatcaaaaggacccaagcactggcccacaaagtgagaatctgacacctgccacatgggaggaaactggaggacccctgtttaacttaattgcctctggcgaatgtcatgaccacaattaaaaaaaacattggtggactaatattttgatgcaccatacttttttgattgcatagatgagaaacatcccaatggcaatgataaaaacaaggactggactaatgctagccctctgtctacagacaatattgtatgagcaaaactttgctcatgcaactctactatcagtgagacttggctaatgaacgcaccaataccagcataaccatgacagagtgattgaagaaaaatgggaaaaggggggctgtatgcacccaagggctacatctttctctgtaagcggtttgggagtgaccaaaatgcaggatatgtgatgccatctctggatatctgtggaatagtgagatcctgcatgttgggcatgctggggttgtctctggatattgctccttggaattaggtaaatcatagagcctgaagcccaaagctgtacctcagacttactagggacctaccagaaggtacaacagatgataggtttatgtcttttatgatatttttggtactatgtataggagtcagtgctcatgaaaaaaagtgaaatgataaggaacttgtccctgaccatggcagatattgctcctcctccatagccactgccttggtaacccagcagacatcccttaactccatcgggatggatgtttaagataacagtgttgctctagacctttaaaaaatcccaactgggaggaatgtatacaatttccaataccccctgctatacctggataaacacctcaggtatcctagaaattcaagtagaggagatctggaaacaagctcataattgcagaaaatggattctgcagattcagaaaatcccacctgaaggattcttctttcacccctttagcaacttcttctgtggatcatgggatcctgggctacataactgcttcaggtgggcctgatcattctgcctctggtagtagttttcattggcccagtgaaatcttttctggctctgtctcaatgatgttgctttgagattgtgtcagtcaaggtgcttcatccgtctgacaagacacacctgtgcctccagttcacggtggttggtaggcgtataaaatggaatagctttctacggaggatgtctgtgttgggggacgacttcactccagtcctctgatggtcctggactcacttgattttccccactctctttcttacacttctcaataataattgtagaatgtgctggaaatgtaacattctgaaatagcgagggacaggtcagaacagactggcttctgatccagctccctctagtactgtcctcctgtacttaagtcctccagtactttagctccatgtgtcctgtgacaccagggtttaaaacccagagcatcttctttctggggttccttagctctggtccaagaggggtacacacagtcaagattccatcagccccacttacctgtgcctcagggtaaagacccacaataaatcctcagcttctgccgtgccttgctggtcacctgtaaatactaaactagattcttgtaacttgttgtgtatgattgttctgtctccctggactctgacaggttggtaaccagggcacagcaaacctgcttcacagcagtcactgtcatagagacagaacttgattacaggttgccagggactgggagcaggggaaacggggagggggttgtcatttaatggctatggagtttcagttctagaagatggaaagagttctggagatggatattattgatgctagcccaacaatgtgactatacttaatgccattgtcctgtacacttgaaaatggctaagatgggcaattttatgttctctatacttaccatagtttaaaaacttcacatctttattatgatattattggatcagaaggcatcgttctattttctaattttctcagcaaatgttaataaataatcacttagagatgccattgttcacaccacatcttaacaaacagtgttttttttctagagatgagggagtctccctatgttttccaagctggtcttgaactcctagatttctgctaccctccctacttgatcttgcaaacatctaggataacggggataagtccccgcacctggtcttaactatcagtttaccaggaggtttaacagggaacttccttgaaaatgtgtattccattgcagccacctctaaggccagacaatctactaagctatatttctgcacccaagtgcactgctccctctgtgatgccacatgccctcagcatgaagtcccataaggagaacaaggcaaggaggcaaccaaatgttctgagtggaaattattgtgaagggctggcattagaagagcatcagtattgcagtgctacttgactagcaaaacactctctggcttatgttgctggatattttttttcctcaaacttttgctaatactgaatactagggttgagatgagaaccttactatgctaagtctagttaaatgccatttcattgaagatatattgctttatggaatataataagtattgaaaatacttattactactccaacactccctttatatatcatgttaccatcctaaatattatggcttgataaaagtgtttgatagggaactaggacagtattgattctgttctcaatgtcctgtaacacatcaattccccaaattgacaagaaaatgggaagaaaaacatagcttaataatcactagctattctggttactgttgagtgacaattaggtgaaatcttaaaaaaaaaattgaaatattttggagggtgtggagctataataagttattggtggacatataaaatattatagccactttcggtaaagtcggacagagtattaaacacttactgataaacacagcaactacacgccttggtattagcccaaaagaaatgaagacatatgttcatgcaaagtcttgttcaagaacattcacagcaactttatccataatagcccaaaatggaaacaacccacacggcaatcaatagatgaagggatccatcataaaattactgaacagttaaataatactcaaaaataaagaggagcacataattagaacacaggacatctgaatgaatctgagaaagagtcatgctgcacaaaagtcaccagacacaaaagagcgcatcctatgtttcatttatgtgaaactcttacaaggaaaatgaaatctgtactgacaggaagcagatcaaaattccctgatctgtgaggcagaaagcaagttgattccaaaagagtgggtcaaaatgttttggagctatagaaatgttctatgtctggattttggatgtggttctaaagatgtatttatttgtgacagttcattgacaatgtgttttattgtaatctttttttttttttttacagtgaacttagttaacagtgagcaaagcaagtgtaaggccaattgggtagtgttgtcttcacatcttctgtcttgcagtgtactgaaaattgtatgagccagaatatctgagagataatctctgctttgaaactgaagaactgtgtatctcatggcaagatttctcttttccaagtactttggatttttcttctctagaatgagaatttaaatacacttcacagattaagtcaaagtgaataaaatacctaggaatccaacttacaagggaggtgaaggacctcttcaaggagaactacaagccactgctcaacgaagtaaaagaggacacaaaacacatagaagaacattccgtgctcatggataggaagaatcaatatagtgaaaatggccatactgcccaaggtaatttatagattcaatgccatccccatcaagctaccaataactttcttcacagaattggaaaaaactactttaaagttcatatggaatcaaaaaagagcccgcattgccaagacaatcctaagcaaaaaaaaacaaagctggaggtatcacactacctgacttcaaactatactacaaggctacagtaaccaaaacagcatggtactggtaccaaaacagagattcaaaccagtggaacagaacagaggcctcagaattaacaccacacatctacagccatctgatctttgacaaacctgacaaaaacaagaaatggggaagtattccctatttaataaatcgtgctggaaaaactggctagccatatgtagaaagctgaaactggatcccttacttacaccttatacaaaatttaattcaaaatggattaaagacttaaatgttagatctaaaaccataaaaaccctagaagaacacctaggcaataccattcaggacgtaggcatgggcaaggacttcatgactaaaacaccaaagcaatggcaacaaaagccaacatagacaaatgggatctaattaaactaaagagcttctgcatgacaaaagaaactaccatcagagtgaacaggtaatctacagaataggagaaaatttttccaatctacctatctgacaaagggctaatatccagaatctacaaagaactcaaacaaatttacaagaaaaaaaccaaacaaccccctcaaaaattgggcaaaggatgtgaacagacacgtctcaaaagaagacatttatgcagccaacagacacatgaaaaatgctcatcatcactggtcataagagaaatgcaaatcaaaaccacagtgagatatcatctcacgtcagttagaatagcaatcattaagaagtcaggaaacaatagatgctggcgaggatgtggaaaaataggaaagcttttacactggtggtgggagtgtaaattagttcaaccattgtggaagacagtgtggcaattccttaaggatcaagaactggaaataccacttgacccagcaatcccattactgggtacctacccaaagaattataaatcatggtactatgcacacatatgtttatcatgccactattcacaatagcaagacttggaaccaacccaaatgtccatcaatgatataatggattaagaaaatgtggcacatatacaccaaggaatactatgcagccataaaaaggatgatttcatgtcctttgcagggacatggataaagctggaaaccatcattctcagtaacctatcacaaggaaaagaaaccaaacacctcatgttctcactcataggtgggaattgaacaacgagaacatttggacacagggtgaggaacatcacacactggggcctgtcatggggtcgggggcagtgggagggatagcattaggagaaatacctaatgtaaatgatgagttgatgggtgcagcaaaccaacatggcacatatatccctatgtatcaagcctgcacgttgtgcacttgtaccctagaacttaaagtataataaaaaaatatatattttgagactcatagcaattgcccttgttctgcaaacatttctagaggtagcaggccagtggtgctcacagaagtgtctagcatgcagtatctgttctattgttcatgaaaattgtctcacatagtctagcagtgggcagcagcaattgggtgttgacatcatttccctgagtcttgtttaatagactccttaataaatcattttcctactattaaatataaattttgcggatatttagagataattggcttatgataattgcaattaaggaaccttgaggacatgttagaaatcacaaagattaggatattttgcaaatgttatgcttccaatagctaggttaccctaaaacctctcttacaaagtatgcttcccaagatgttcccaggggtcacaggactagtcaatgccagtaagtacaggacagatttcacactcagtacaagtacctgatatttgaggaaactaaagatgccagaacaccctagcagaaccctctccccagtgaatcacacaattgtataatctacctccacagagagcaagcggaacctagacttgcttctaatccatatgatatgtcataggttatgagatgtctttccaatgattgtattctataagcctctgtcatagcagactggaaagagacactctctgaaaccttctgctgaccatgaacaagcaaccagccatgtgggcattgcctgtgtgagcatcacatggcagggaattgtccacagcctcttggacctaagagcagccttgagccaagagccagttagaaattgaagccctgagtcatagaaatgctaaggaatgagctctgcaactacctgaaagagctctaaagtatctatgttctcaggggactcacaggtgagaatgaagcccaatctacactgtggcacagtcttgtgaaatccaatggccaggacccgacaaagccatgtgccaactgctgactcagaaattgagagatgataaatgggtgtagtcttaagctgataaatttgtggtaatttgttacatggccataacaaacttagcacacattttaagaacaaatagtagaccgaagagcagccatgccactgacattgactgtagatgggcacaggcttattctcattgtgaccttagggtttccaagcactgtgagagagaggaaagcttcgatgtgcaagccctttccaagactccacttgtgtcacatctgctattatcctattggcctgagcaagacacatgggcaacacctgcatccatttagaatgaggccaaccaaaggatgagtacagggaagggatttattgtggctaattgtgcaagtagtttatccataaattttttatcattatttgctgagaaataccctgacaaaaagaaacctctttaaaaggcttaaaggttttaggttgtaggttcattcattgtagcgttctgctttatatccaagtataaataattgagaactccttcaaattgttatttccatgatggtttattttccccatacctttacaggtaattttggtcctgcaatgtgctagccaagtttaatgtgcagagctgaccatttgcacaatgtgactgacacgccactgcaccttgaatgtggaccttgacttgtggtgatctatgagaatctgcttctcaaaagaatgtatttgtcacccctttgatctttatcctgtctgaatacacacacttctctattgttccatggctactctgtatgttgtctctattaactcactcttgccataagtgactaagagcacctaacacagaaataataaatacaaccagttctgaaaattaaaaatagttaaatagcatagggacattatagaaaaaaatgtataactatcttaagtataaagaaaatgaagtcttcgtattttgcaaagaagctgtgtgaacgctgtgtctgcaggtttcagccccagggtgggcccctgcctttcctgtgactgagcatattgcctttctcacacctgcagtcatccagcgaagtgacaggatgggctgagctgagctgtactgttgggccaccctggggagatcttggttatataagatgcatttcagaggataacaataactgctaacagcaataaatgacagcagttcagctttgttcatgtagaatttctcccaaacaacccacaatgaatagacttgaaccccagagttgatctgggaacaaacctaatacagattggggaataggacccatcttcctgacccatgtaaaccgataccaaaagttgtccaacctgcacatcaaaccagcttccagataggttaaagaagtcacatcagaccatccagtcgcaaatgaaccacagggtaactgcagacacaagagcggactcagcagagatcagtccagccagcccagaatggaagaaccacagagctgaccctcagaattataaggagctgtacagtcagctctctatccatgggaactgcatccatggattcaactaatcctggatcaaaaatattttgaaaaaaaaatccacaaaattccaaaaagcaaagcttgactttgccatgtgctgagtaacacttggatgaatctacacaagttaagtcatgtgtagacatcgtactaggtactataaggaggctagagatggtgtgaaatgtacgggaggatatgtgtaggttatatgcaaatattgtgcattttacataaaggttttgagtctccaaaaattggaatatctgcagggtgccctggaaactatttcccatggatactgagggaggactgcacatactcattttatggcattttgtttggagctggtttgttttcaaagaagagttaataatacaacctgtttttgtgaacaggagccaatagagttaagtgatagtgtagtcccatttattgcaatttttttgtgactgcaaagtctatttgcttgttttttaaaaaagataagaatactcttacctgattatcatggactttggatgtcttccttatctccccagcaaaatacaaactatgaagagcagcacactgactatgaagagctgactatgaagagcagcacactgctattcaaacttctcattactcagaataatccatgttttacattcagtgggttgttttcaacgtgtataggttatgagtgttgattatgtcttggagagtttcttactaacttttcattattcattcattcaataaagtgttaattgagcaactatgctggaccaggaacgtatctaggctgcacccctgagaaagtcagtgtctgactctcatttacctatatcttttctggtgaaaaaaaggccatgtctaattaaacataaatcaacaaaaagattctagaaaaagttaagggtcataaaggaaaaaaatggcaagggaagaggaagtggttaatgaggaaaaggagtcagttagttagggaggtagaggctactttttctgaggaggtgactgacctggatgaggagaacaactgacctgaagagaagtttctgaagggcactgaggttcatgacaatcaaggcgcttagaaggaatacagtatgaacgtgtgaaggacagagaaaggcactatgaggagagtgacttaaccaaccgaggtaaaaaagagaaagttcgtgagggggcaggtcagagccattttctctcagtgtcttaaagatcaccacatgtgactgatgtgaaattaataaggccttcattttctgtttggggagcaaatgctttgtaagtacagcaggacattctgggaatttttttaaccaaagtacccccatggtcatatttattttttagcaaagtaatgactcgaattgggctgtgagaagcagaagagatgcttatctgggcaaagtggatcctggcataaactagttttggggcagtgaagattgttggagacataggcagatgataccatatttttaaatcaatgtcatttacactccttggtgtgagaagagtcagattaggagtgacctggcagctttggccttaatctattagatagattctgacttactgatgttaaatgtattagcggtcaagaaagttgagataaaatgaaaggagtttgttatttttgctcaattctagattgagacaccaatgaacatgcagattaagtgggcaggtttgcaagtgagtggagtttgagctcagagaaaagaaaatacgcataggtattcagcagcacttacagggtaatttatggtattaaaaccacgtgtatgcatatgcatctgcacatatttatgcatgtgtatgcacgtagataaacatatgcatatgagtatttttcagaaaataaaagggataaaaccaataatctcagcttccaccttatgaaactacataaagaggagcaatttatatctgaagtagaacatgagcaaaataaataataaatattagggcagaaatcaataaaactgcaaacagaaaaagtgacactgaacaccaggcaagccaaaggctggttctttggaaagaacaatattgtatagttcccatatatttgaaaatttgggggttacattttcaatattgatttctagtttgatccctccatggtcagagaacacattcactgtgattttaattattgcaaatatgttgagaggttatgtgggcaggatatgtcctatcttggtatatgttgtgggcacttggaagaaaaaaatgtgaacttctattgttatgggttggagtgttctataaatgtcagttagatctcgtgggttgatgatattgttgagtcctaaatccttgctgattttctgtccagttgtcctatcgaagattaaaaaggggtttttgaagtctctgtgtgcaattgttttgttagtttctgccacatgcactatatcgctctgttgcttggtgtctacgcacttagaactgctctgtcttctttccaaaatgactttcttcattatgtaatgtacctttctgcccctggtaacattctttggctctgtagtctactttatctgatattagtatttgctactgattctttttattaatgtttgcatagtataccattttccttccttttatattcaatctacttatactgttatatttgatgtgagtgtcttgtagataacatacagttgggacatttctttttattcatcaattgttgtctttttcaaagtttcataatttgcatatttaatatattgatattgatatattaaaatttaagtctgcactctacttttttgctatatctttttttgcttctctgttttctttttgctgccttcttttgggttacttgaacatcttcacaatttcattttaattttacctaattttggggtatctctttttataatgattttcaaattggttgtcatggtatttcctttatatgcatagcttctcacagtatgttggcatcaatatattaccatttaaaataaatatagaattttaccttttttatgtcatgtttcctcccccattgtaaatagattgttttttaaaagtaatttatctgcatatattaggaacaaaacagtattacaactttgatacaactatcacacatgatttagcaatgcattatatccatctatcttctcatttttgtagccttttgtccctaacattatttaacatcctctctttatctttagttttatcttcctagggctcattttgcctatgtttaaagtggatctgctggcagcaaatactcttagtttttctacaactgaggacttctcaatttgtccttcatttctaaataataattttactggacataggattttagggcagcagatcttttctttaaatactagaaaatatgtcataattgacaccagataacaaggtggaaatatttccaagaacagaggacaaccatgctctcagtgaggtgaaagacatctcttccccttgcattagtttccaatgctgctgtttaaatcaccacagtcttattggcttcacacaaataaaatatagtaccccgtgtcagaagtctcactgagctaatgttaaggtgtcagtagggctgtaatctgtcacacatgtgtgtgtgaagagacaaccaagcaggctttgtgtgaacaataaagctttttaatcacctgtgtgcaggctgactgagtccgaataaggagtcagcaaagggagatagtggtggggcagttttataggatttgggtagggtagtggaaaattacagttaaagggggttgttctcttgtgggcagggtcaggggtcacaaggtgctttgtgggggagctcctgagattcattttccaggagaaggaatgtcacaaggttaattgatcagttagggtggggcaggaacaaatcacaatggtggaatatcatcggttaaggcaggaactggctattttcacttcttttgttgttcttcagttgcttcaggtcatctggatgcatacatgcaggtcacaggggatatgatggcttaacttgggctcagagacctgacattcctatcttcttatattaataagaaaaaacaaaatactggtgaagtgttggggtggcaaaaatttttggtggtggtatggagagagaatgggcattgtttctcagggctgcttcgagtgggattaggggtggcatgggaacatagtgtagaagatattaaactgaagaaagattttcgggtaaagggtggtattgtggggttgttataaggagcatttgccatatagaatgattggtgatggtctggatgcggttttgtatgaattgagaaactaaacggaagacacaaggtctgaataagagaaggagaaaaacaggtattaaaggactaagaattgggaggacccaggacatccaattagagagtgcccaaggaggttcagcataattatttgcttggttggtgagtttttgggctctatccttgagtttttttatgttgtcatataccaggccagattgatttaggtaaaaacaatactcttcatttaaaaatacacagagtcctcctttttcagcagtaagtcgaggccttggcagttttggaggacaaccacagctaaagattcaacctgggcctggacgactgataaagtttgtgatatgtctgtgatgctagcagagaagtcattagaaaggctaaggaaggttgtgacagaggttgaaatgcctgctattccagttccgagagcaatagtggaggcagaaattcctaaactgacaagtaagggaattagtggaataacacttttttatcgtgtcggtttcatgaggggaacaggaagctgtttggtcccatttgcaaattgaatctagggacttaggaaaactagtgtgcatgtgcctgtccaattagcagatagacacatgtaggtagagaatccacagaggaagaagagaccttgtgcaaggcaataccggagctgcaaagtgaaaagatgagaaggagtactaaaagaggtgtattgtacccagactcctagggatccagctagcgcggcagccatcagaggttgtaatggggactgatggggtaaccgcatagaggggaaggttcgattttcatggtgtaagagaaagtgtcgagtgtctatgagcaagctttcactgttatttacggggctgggtataagcaaacaagaagagggcctgggaggagagtctgaagagcaaggggaaggcagcaaaggatggagtgaaatacagggtaatgtcttcctaagcaataataactgctaatgtttttaagtttgtcagtactgatagagggcttatctgtaatatggagctggaaagccacaattgtttcagtggtatgtgtagctgggctttggagatcaagagtgaaggaacatcgagaagatgcaaggttacccaggggaattccagtgggtctttgccgagagatacataaaggagcagccacaggaatagcagcttgtgttgtgaggggtctaaatatggggggagtagagttgatataaggagaaaggttttttaagtaagtgcgaagaagggcagcagctttctgatgtgaaatgtctggggaggtcttgctggacctgtctagaaagtaaagaagttcttcaggagggtaaaggtgagggctgttaaaggaagttcggagatgtacggagacaggagatgttgcccagtaggtatgtaaggcagggacagctttgtaagcgcaggaagaaagggaaatgcaaagccagcaattgttcgctaaggagggattagaaatggcttggagagagtgagtgagactgatagtgtagtggagatagttggggagagggagagggtggcataagaatgggaatgagaataagagtgagtataaaaataaagaataggacttcatcatggtgaaaatattggagtgtgccctgccagcaaagatcatctatccactccaagaggaagtcaagagtggtggtttggcaatagggccaggagatatcagctgtgatggtttggagaaacagtgtaaaccagcagtataaacaagagcagggcatttatgagtagttgagaatggtgaataggagtatgactagacagaagatagtagggatgacaagttttggggcacagtccaagtagtgggggtgactgtgtaaagccctgttgcaaaaagtagagtaaggatgaatagacctaatagaatgaaggaacatattaggttcataagggttattactgttttcagaaatgtgagtgagtttaagggaagtagtggagagtacttgcaacttccaggaggaagaggagagatcaggcttgctgtccaatggacacagctttattctggaatggtgaacccaatggggagggtcctgcagatggacagcagttggggtgctatagatgactaggtagggtccagtccatcgaggctgtagagtttgagggctcagactcttaacaagaactgatcattcagctagggtgtcttcatatggctgggaatctggagtaggaaagagaagattagcagtcgggcgaatttcctgtctagcctgctggaggactggaagatagttgtccagagggctggtgtctggaacaaggttggggccaagcaagaaagtaagtccatataaaagttgaaatggactgtaccctgtagcatcttgaagtcaggctctacttctgagaagggcaagtggtagaaatactgtccagtcccttttaagttggaagctgagcttggtgaggtgtgtttttaaaagaccattactcctttctacctttcctgaagactgaggatggtagggggtatgaagtttccactgaatatcaagagcttgagagacagcttggaggatttgactaataaaagccaaaccattgtcagattgaatagaagtagggaggccaaatcagggaattatgtctgttagaagggaagaaatgactgcagtagccttttcagagatagtgggaaatgcctcaacccacccagtgaaggtgtcaatccaaaccaggagatatttaaatttacagatatggggcatatgagtgaagtcaatctgccaatcttgtgttggagtaaatccatgagcctgatgcgtaggaaaaggaggagggctgagaaagccttgggggctggtggcatggtagacgagcattgagaggtgactgtcttaaggatggatttccatgaagagaaggagatgaggggctgcaggaggcgagccagaggcttgtatcccacatggaagtggtcatgaaggaaagaaagcatggactgagcttgtgaggcaggaagaatgaattttccatgatttaagaagcactttccctgagttggaaaagactagtagagcaggctttcaaaagagtaggtggtagtgatagataaggaagaaaaatactggtcctctggagtgggagctggaatattagcgggtgtggaggcattggctatttcttttgctgtcctgtcggcataggcatttccttttgcaataagatgagtaggtttctggtgtcctttacaatgaatgactccaggcttggccagcaggagagcagccttaaggaggacctttattagggaggcatagataatggaagaggtttgtgtggtaaggaagcctcttttagcccagatggcagcatggttatggaagatgtggaaagcatatttggagtcagtataaatgttaatgtgcattcccttagcgagagagagcacatgagttaaagcaatcagtttggcttgttgggaagtggtggagggaggaagtgcagcagtttcaataatagagatgtgggacatgacagcatatccagcttacctggtgaaaattgattgggtggtctggattttgaattcgaagaatagaaatacgaggaaaggaggaagatcctatgtgtattagggaaatgcagtcacgtggttcaggacttgtgttggttactaactgagaagctgggttgaaatcgtgcccatggccaatagttactgttggggtttcaataaaagatgaatagagctggaggagtcgaggggcagacagtaagtgtgaaaggtgtgaggaggatattaatgcttgaaggttgtgagaactgtagagggtaagtggagcatagcttgtgattttgagggcttccagaagtattacagcagcagctgctgctgcacgcaaatatgagggctgcaccagaattgtgaggtcaagttgttttgatagaaaggcaacaggtcatgggcctggctcctgtgtgaggactccagcagcgcagccttgtatttcagctgtgtgtaaggaaaaagcatgggacgagttggggagtgctagtgtgggagctgtctccagggcctttttgagagagcaaaaagaacaatgggcaaaaaacttagggtctatgggatcagttaagttaccttttgtgagcttgtaaagtggttttgttaggatagcaaagcctggtatccagagtcggaaatatccaacaatgcctaagaaggaaaggagttgttgttttgtggtggggattcgggtctgggagattaactgagcacagtctgcaggaagggcatgtgtatgctgatggaggattataccgagataggtaacactaggggaagaaatttgtgccttggagggggatactcggtacccctttaaatagagatgttgaagaagcagggtagtgtcctgctgggaagattggtaagagggactgcaaagaagaagatcatcaaaatattgaataaggtgggaggcagacaggtgaaaagaaagcagatcatgagaaagggcctggccaaagtagtgtgggctgttcctgaagccttggggcagaacagtccaggtgagttgttgggattggtgggtgtcacggtcagtccaagtaaaggcaaaaagaggctgagaggagggatacaaggggatagtaaagaaggtgactttgaggtcaataacaaaatagtgagttgtggaagggggtattgaagataggagggtgtagaggtttggcactataaggtggatgggaaagacgatttgattaataaggcaaagatcctgaaccaacctgtaagatttgtctggttcctggatgggtaggataggggagttgtaatgtagcaggatgagccatggacaaaacctctcagacaccgagttgtagaaggaagggctttattcagctgggagcatcggcaagctactgtcttaaaatcggagctccttgagtgcacaatttctgtccattttaagggctcacaacactaaagattttacatgaaagggtcgtgattgattgagcaatctaggggttatgtaacagggtcttcatgcactggtagtcagagtcaaacagaacagaacagggagtttcacaatgttcttcatacaatgcttggaatctatggataacattggttgctaagtcatgagatgatttttaactactaggtttaggccaggcaggcccaggcctggcgccgggctgcctgtctctgatttcacttccttgatttttactcttaaaacaggtactgagtataaaacaatataaaacaatatgagagggtctctctcttccctcagtaaggagaatttgtaggctttaagaggccatgttgtaacaggtgggtgataacaggctctagtggtaacagtgattaggttttaacgggatggtaaggggtgcatgatcagttgccaaggaaggagtagaggtatcccatacttgtggattaaggcagggagacacaggggaggatgcaaaggaggctttgaagtgaggaaaagggtggcaatgaggtgtggctgtagcccaggaatagtcagggaagtggatagttttgttaaaacgtctcgacctaataaggaaactgggcaggtaaggataactaaaaaggagtgcataaaagaatgttgtccaagttcgcaacagagttggggagttttaagagatttagaagcctggccgtcaatacccacaacagttatggcggcaagggaaacaggtcgttgaaaagaaggtaatgtggagtgggtagactccacattgattaagaaggggatggacttactctccactgtaagagttacccaaagtgtctgtgatggtccaggaggcttccaaggcgattgggcagcatcagtcttcagcagctaagctgagaagatctgggaaggagtcagtcagagagccttgggccagagttccagtggctctgggagtggctgccaggagagttggacagtccaatttccagtggggtcctgcacagatgggacacggcttaggaggaatcccaggctgtgggcattcctcggtccagtggccagatttccagcacttgaagcaagatcccgggggaggaggtcctggaggaatgccgggctgctgcggtttaggcattttaaaattttgtgacctagtgtaagcaaaacactatctgaggcaggtctcaatcaatttacaggttattttgccaaatatatggcttatggcctgtgacacagccttaggaggtcctgcaaacatatgcctaaggtggttggattttacgttggttttatacactttaggagacacagaaattacaggcaaagacataaatcagtacatataagatacacataagtttgtcctggaaaggtgggatagcttgaagcaggggtttccaggtcataggtggattcaaagctttcctgattggcaactggttgaaagagttaagctctgcctaaagagttgaattcatcataaagaaatgcttgagtctagaaaatggggggttcttgtcatgtagatgaatcctatgggtagtaaataaagtagatggtgaatgttgattatcagaccttagaaaaaaatgtcagactctttggaaaagacttagtaaggggaggagattctctatagaatgcaattttcccccacaacaggtagctttgcagggccacttcagaatatgtcaaagaaatatttttaggataaaatatttttattttctccagggcctattatctgtcacattggagtatggtatcttattgctaaaaagtatctgtttcatcagtccagagatctctgttgtaatgataatgctggtcagttgtgtctgaactccaaagggaggagagtataatgaggcacatctaaacctgccagtcatggcctaatctagttttccaaatttctttgaagtgctttctgtcaaaagaggagtccattcagcaggttggtgacctacaacttaatttttggttttaacacacagaaaaacaaaatcactgcacaaattcaatctgaaatagattggtaaagaaaaattaagtgcttcctgaatattcctacatgtcaaagaaaaagaaattattagaattcagatgagaaatacccctcatacaaaagattaacgattttttttttttttttttttttactgtcttagtttgggtccacctgcaataaggattcctgtttaggcagcaaatttacgctgggagaaaaggaggaaagtgaggaagggaacagaagatgaattgtaaaagacgcatcaacaacccacctgactcaggagaactgaagatcaaccacctgtggaaacatggactaaattcctccgggctgttccacctgagagatgaggaagctgaagtatgtatacacctcatcctgtcctcactgattgtgagctgtctctcttgttctatttcaagctgctgtaacagattccttttcactgagtaattcataaagaacacaaatttattttcttacacttctggagaatgggaaatttaagttcaaggcatgggcaggttaaggtctgctttctttgctttcaagatgatgcctggagtttggggtccttcaaaggaaggaaggccatgtcttaacatgacagacaagcagaagagagagagatcccagccccacaattgctgtttatactggcattaatgtattccactagagggcaccacactcatgatctaaacacatcccaataggccccaattggcaataccattacactgagaattaactttacaacagatggattctggaggacacagtgaaaccatagcactttcctaagagatacacattccaggtcatttggtcagcaatgcatgcaggcagagttctctgcccaagactgtaaagaacataagacatgtatattgccattggaagtgagcagaggtacagcaaagagaaagccctagaatacagatagagactcctatattcatcctggtacagttaacccttgaataaattgggtttgaaatttgcagatccacttgtattttcttctgtgtgtgtcacctgtaagcaagtacttaataagtagtaaatatattttctcatttttataatttacttaattacatttttttctttagcatagtttattggaataatagagtatatgatataaataacttaaaaaagtgttaatcaactatttattttatcattaaggctagcagtcaaaagtaagctattagtacttaagttagaaatgcaaaagttctacacaggttttcatctgcacctgtggtcagtgccccaacctccacattgttcaggggtcaactgctctttcagtctgtagctgcatctctctggaacaggatcttggtaggtgagttgtaagtaaaggaatccagaaaataacatctcaaactatgctgcattcgtatgaggattacataaaaccaaaggcatttagaaagcagcaaatgcacaaaaagccttctcctaaacatcgcttatctgccaaaaagcagattctccagaaggaaaccaattgtcaaaaaacttcttcctgagaatttttatatcagggaagattaacacaaaacaggaatcaaaaatagaagagactgggaactgatgctttatccagacaggctattacctgttcttttgaagatgcacttctgttctcatctattctctccagattgcctacacttccgaattccgtcttcgctggaaaggaaatatgaactactggatcttattgagttatttgggtaatcaccctgctatgatatcctgctgcactttaaatgaattttgtttgccttttctcttattaatcttccttttgtcagtttattttcagcaaacatttagaggacaaatggagttttcttcctttctcccaatataagcaagttcccttaaaattcaggcggcttacaaagcagcaagaaggtttgtgcacgggctatggcactgtgatttggctcccctactcaggcatcagtaaaattttgtggagccctaggctgcagcccactgatgctaatatagttggatccacttcccctgctactgagctaggctgggacagttttgggcacattagatatgtgcgatataatgattgcaaatcatttccagttttgtctggatcaaactgctttctccatgtacataggcatcatctctgtggatctgtagtaaattgcttgatcttatagtggtaagaacaatggcataacaccattaccgaatactgacatgtatatatagcatcatgtcaataaattttatttttgattttttttagaaaggaacaatgttaaaatcacagaaatgttccaagtatagggcaaagtaaccccttccctaaccgggatcatatgagagtcttttggagacctgataatcataccgtctaacattttattatatatttcctacaaacaagaatattctcctaaataatccccatacaccaatgaaatacattactccatcaactcctgaggaatatttcaaattgtcaaaaaaaacctaaaaaatgtctctcataataaaatagttcccagtagaaacacattctctggagacaaatttgtgctaccctggtcttacctgggacacctggggacactgaactggtgctgagttactgagatgagccagccctgcagctgtgcccagcctgcccatcctctgctcatttgcatattcccagaacacaacctcctgccctgaagacttcttaataggctggtcacacttcttgcaggagtcagacccactcaggacacagcatggacatgagggtccccgctcagctcctggggcttctgctgctctggctcccaggtaaggaaggagaacactagcagtttactcagcccagggggctcagtacagcctggctattcagggaaattctcttactacatgattaattgtgtggaccatttgtgtttatgcttccaatctcaggtgccagatgtgccatccagttgacccagtctccatcctccctgtctgcatctgtaggagacagagtcaccatcacttgccgggcaagtcagggcattagcagtgctttagcctgatatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaataattaccctcacatagtgttacaaacccgaacataaacccccagggaagcagatgtgtgagactgggccgccccagctgcttctcctgatgcctccattggctgagagtgttcctcagatgcagccacactctgatggtgttggtagaggaggatatgagatcacctctgcatcccaatttctttttcttttctcagccccagctgcacagacattacaatgcctctgctgatttaataaagatagagatcatgacacctgaagagtctagtttatggctttggttagaattcatataacagagaagaagccattatagatattctaagcaggaatagtcttaatagatagaattagagtctaaagtattgaagtctaaataaaatgtacagataaatttaatgttttatttgctaagaaatttttgccaaatggggcatacaggaaaactcaatggtcttcaatatgttggaagagcaaagagttttattaaaagggaaattattacctattgttctttgagaaattttgttggctgtagtaagggttgggagctggcaagctcagactggtaagcagtggtggtcaaactgaatcctagaattatattaagttatctcagaagttgtgggtaaatttgctttcaggttacaataagccaaagcagtgaagcttgcagagaattttgttactgaaatgccagggattcagtatagatcctgcggctcaccacacagaaagccaatcactaagacaacaagtgttgtcaaagaacaggctttaatcaggtgctgcagccgaggagacgggacaccattctcaaatgtatctccctgacaaaataaattaggcgtttatatagcagggaagaaatgtggaaaacaggaattagagaggggtaaggaagataatttagtcaacaggaagctggaggtcagttaggcaatcataatgggtgaagggtctgatgtctcactgtccccattcagtgatatataactttcagctccttgatagtatctagaggcctgatggttggtttcctgaaaaaagaactcagattaacaaatgtaactaccttgagttttaagactgggggagtcagtttctatgtttattcaaaaaatcataaacattagttccatgggataatagggtctatttcaattgcattcttcagacaatattttgcaccctgagtggttttccctcctggtttcttggctctgttgggtatgtcaagaatgaccgaattcctatgattaacttttacactacaacctttcaaagccaaggatatagtagtcaggcaggttgacagtagaagcaggattctctggtactccctcagaaaatagaatgcatctgccactgaagtatgggctatctaaccatgtggtcctcagtcctgtctgaaagcttaagggtggggttgcagctgctctcagcttcctatagcatctttcaggtttttcccaggcacatgtgttgacaaggaagaaaacggtgggaatcaccatgtttgggtgaatccagtttctaatggctatgatttgcataggaaagcttcccagcctggctctaagagccagggctttctggctagacaagaagtgtttctagagctgctttaaaggaaacaaaaccttcccaaggaccccttttcctatctgcctaaaataatttcttaaaaactcctataacacttgggttccagagatgaggacatggacatcctttggggtgggacattattcattccaccgaccataaacatattccccaaaattgtccttctctaaagtaaaatttaaaaaatcacgaagtatttttatgaatcaagggaggtggacaaaatcttagactcaggttcctctaacttgtgagttttatctgttggggtatgctcactccactgtctctaatgtagatttattgatgtgtagatagttttagaggatttttaaattttgtgacccagtataaacaaaacagtatctgagacaggtctcaatcaatttacagggttattctgccaaagataaggcttatggcctgtgacacagccttagaaggtcctgtaaacatgtgcccaaggcggttggattacacattggttttaagcactttagggaaacacagaaatacagggaaagacataaatcaatacatataagatatacattagtttgtcctggaaaggtgggatagcttgaagcaggggcttccaggtcataggtgaattcaaagctttccttactggctactggttgaaagagttaaggtctgtctaaagagttgaattcatcataaagaaatgcttgagtgtagaaaaggggatgtggaagccaaggttcttgtcatgtagatgaatcctatcagtagcagataaagtacaaggtgaatgttgcttatcagagctttaaaaaatgtcagactttaaaaaagacttagtaaggggaggagattctctatagaatgcaaatttcccccacaactggcagctttgcagaaccacttcagaatatgatgaagaaatatttttaaggtaaaatatttagattttcttcagggcctattatctgtcatgttggaatatggtatcttaatgctacaaagcgtctgttttgtcagcccaaagatctctgttgtaatgacaatgttggtcagttgtgtctgaactccaaagtataatgaggcacatctaaacccacctgccagtcatggcctaacctagtttttcaaatttctttgaagtgctctttacaaaagaggagtccattcagcaggttggtggcttacaacttaatttttggttttaacacacagaaaaacaaaatcagttcacaaattgaatgtaaaacagattggtaaaaaaaaaaaaaaaaattaagtgcctcctgaatattcctacatgtcaaagaaaaagaaattatcagaattcagatgagaaatacccctcttacaaaagattaacaatttttttttttaactatcttagtttgggtccaccctcaatgaggatccctgtttaggcagcaaatttacactgggaggaaaggaggaaagtgaggaagagaacagaagatgaatggaaaaagacacatcaacaacctacctgactcaggataaccaaagatcaaccacatgtggaaacatggactaagttcctctgggctattccacctgagagatgaggaagctggggtatgtatacacctcatcgtgtcctcactgattgtgcgctgtctctcttgttctatttcaagctgctataacagattcattgtcactatgtaattcataaggaacagaaatttattttcttacagttctggagaatgggaaattaaagatcaagacatgggcaggttaaggtctgctttctccactttcaagatgatgcctggagttagaaatgcaaaagttctacacaggttttcatctgcacccatggtcagtgcccaaacctccatgttgttcaagggtcaactgctcattcaatctgtagctgcatctctctggaacaggatcttggcaggtgggttgcaagtaaaggaatccagaaaataacatctcaaactacgctgcactggtatgatgattatgtaaaaccaaagacatttagaaagcaccaaatgcacaaaaagacttttcctaaatgtcccttatctgcataatagcagattctccagaaggaaaccaattgtcaaaaaaattcttcctgagaatttttacatcagggaatattaacacaaaagaggaatctaaaatacaagagactgaagttgatgctttatccagacaggctatgacctgttcttttgaggatgcacttctgttctcatctattctttccaggttgcctacacttctcaattccctcttccttagaaaagaaatataaacaactgtatcccattgagttatctgggtaatcaccctgctatgatattctgctgcacttcaaatgaattttgtttgtcttttctcttattaatctttcttttgtccattcattttcagcaaatatttagaggacaaatggagctttcttcctttctcccaatataagcaagttcccttaaaattcaggcagcttaaaaaacagcaggaaggtttgtgcacagcctgcagcactgtgatttggctcccctagtcaggcatcagtaaaattttgtggagtcctaggtggcagcccactgatgctgatgtagttggatccactttccctgctactgagtcaggctgggacatttttgggcacattagagatatgagatataacgagtgcaaatccctgtccagtttcatctggatccaagtgatttctccatgtacataggcaactgcttgataagagattcagtgtctctttcctaaagcagttaacagggaggctgttgcctgggtcaggatgatttccccaatcactgataaaaagtaaaagaggaaagtgtcattgatggtgcatggcagggacatgctccatgcagtggtcaccctcagtaagagagatgaactttgggaaataatactgaatggcagaaaagaaggtagactatgaaggtgcccaaaacaagaataaggtgcaacccatttagtgtctgagtactatagagacctgtcgctcttgataattgtggatctgtgactgctgcatgcatcgagaaaacacggtatcatctttgtgtatctatagtacatagtttgatctcatactggtaagaacaatggcataacaccattacctgatacttacaaatgtatgtaccatcatgtcaataaattttatttttaatttttttacataggaacaatgttaaactcacagaaatgttgcatgtatacgacaaatacccccttccctagccggaatcatataagagtcttttgaagacttgagaattgtaccgtctaacattttactatgtgtttcctacaaacaacaatattctcctaaataatccccatacaccaatgaaatacattagtccatcaactcctgaggaatatttcaaatcgtcaaaaagaaaccaaaaaatgttactcacaacaaaatagttcccagtagaaacacattctctgcagacaaatttgtgctaccctggtcttacctgggacacctggggacactgagctggtgctgagttactgagatgagccagccctgcagctgcgcccagcctgccccatcccctgctcatttgcatgttcccagagcacagtctcctgacctgaagacttattaacaggctgatcacaccctgtgcaggagtcagacccagtcaggacacagcatggacatgagggtccccgctcagctcctggggctcctgctgctctggttcccaggtaagaaaggagaacactaggattatactcggtcagtgtgctgagtactgctttactattcagggaacttctcttacagcatgattaattgtgtggacatttgtttttatgtttccaatctcaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctcccacagtgttaccaacccgaacataaacccccagggaagcagatgtgtgaagctgggctgccccagctgctcctcctgatgcctccattggctgagagtgttgctcagatgcagccacactctgatggtgttggtagaggggtacgtgaaatcgcctctgcaccctaattcttttctctttctcagccccaactgcacagacatagcaatgcatctcctgatttgataaatacagagatcatgacacttgaggagtctagtttatggcttcagcttgaattcatataacacagaagaagccactatagatattctaagcaggaattgtcttaatacagagaattaaagtaaactactaaagtcaaaataaaatgtagagatgaatctctaaatttaagttttatttgcaaagaaatatttgccaggtggggcatacaggaaaactcagtggtcttcaagatattggaagaacgaagagaaaattagcattttatgaaaaagggaaaatgttacctgtggctctttgagaaagttcattggcactaggaagggttgggagctggcaagctcagactggtaagcagtggtggacaaaatgaatcctagaattatatcaagttatctcagaagttgtggacaaatttgatttcaggttacaataagccaaagcagtgaaggttgcagagaattttgttactgaaatgccagggattcagtgaagactctgcagcttaccccacagaaagccaatcactaagacaacaagcattgccaaggaacaggctttaatcaggtgctgcagcctaggagatgtgataccattctcaaatgtatctccctgaccaactgaaattaggagtttatatagcagggaagaaatgtgggaaaacaggaattagggaggggtaaggaagataatttggtcaacaggaagcaggaggtcagtgaggcaatcataatgggtgaaggttctgatgtctcactgtcccgattcagtgatatgtaagtttcagctccttgatagtatctgggaggcctgttcattggtttactgaaaaaacaaacaaacaaaaaaaaactcagataagacagatgtaactatcttgagttttaagactgggggagtcaatttctatgtttatacaaaaaaacataaacattagttccatgggataatagggcctatttcaattgcattctagaaacaatattttgcaccctgagtgcctttccccactggtttctttgctctgttgggtatgacaagaatgaccaaattcctaagattaagttttccactacaacctttcaaagccaaggatatagtagtcatgaaagctgatattagaagcaggaatctctgatcctccctcaggcaacagaatgcatcttcctctgaagtatgggctttctaaccatatggtcctcagtcctgtctggaagcttaggggtgggggtgctgatgctctcagcttcctacagcatcttttcaggtgtttctctagtcctcatgtctgtccctgtgtctgtcttaggtaccaatggagaatattgagtcatccttttcggacttccaaatctcatgggaggacttcttattgggcaactctataagaaacaagagagacaaaatgagaatttatgtaagttaaaatgattttcccccatgaggccatttaaataaattatatttaaagccacatgttgaaaacgcatccagctttattttcttattaatgcaaatttacatttgcaaatattttcaatattgtaaaggttgaaaacataattatttgtccatggaatgatcaaacacctctataattaaatggagtaaacattttcttaaaaatttgtactcactgaaataaagcaatatatttgaaatgtgtgaagctatgttagaaattattggacttaaactcaactgtgcagtttggtttgggatgctgttcactcttgtgacctgccagaagaatcttgagtcatgggtagtcactgctgttcagccttgtcctcagacagttgatatgtgtaggctgaagacaagctcagtgccatgcagagaaaccactcacctgaacccttccttgatcagccagattactgtgaacgtgagcatctatgaacatgaaaacaaatgtttactattttctgtcactgagttgtgtatttagccagttaccaatcattaatgcataaaagcttcctgatacagtatttacacctctacctatatatacacacatgtattttttcttaaattagtggcataaatgtaaatatttagtaatcaaattataaacttagaaaattaatgacaaaattaaaactaatatttcaataaaaaattaaaatttaccatatttatgggaaaatgtgcatacatgtatgtaagatacatacaagtcaatatattatttgataaaatgttggctatatatatagtactcatacttaagtgtgttaattctattatatatgcaatatatgcctatttgtaaaattattatctaaattgaatacatttaaataatttttgttacattccataaaaaattgtattctggaccacacatagttcatactcttgctatggaaaatttatttgtagcctttatttttaaaactctaccaaatgattgtccttgtccgaaaatattttccaacccagtagagctccaagggtaggactagaagaaattttgactaatgttgaatattaatcattgcatcctatgaaagtctccattatgttcatgcccacaatgatgatatgccaaatagagttctcacaacaatggatgctggatggagtcacatcagtgccattgtcaaggaagccctggaaatgtaaaaatcaaaacagtgggtaaactgcaaggcctatgtctgatgatcacattgcaaagagaataacattttaataatattggctgttggttttgacagatcatcaggccttaaaagaaatgcaacaggatgattacagacaaagtcattgtggaagagctatgactagatgtttttaaaatgagccataatccaaaaaaaaaaatgctttccaagtggatgctaatcgaaatgccattaatgagcaggggcttttaataatgagaatgattcaacacatggacttcagtcagtcatctttcccagctttccctgggagtctcatgaaccaatgttatggaggtctctgtggggactcaataatttgagtttcccccaaccgagatttagagtgctactggctcttctgaacacctaatttgccaagaagaatgacccctcctgaacccttcacattgtatcacacatcagggctcagactaacatctgatgtcaggtgattctactgtcactgggtgcaccagactcagattttggacacaaaatttcctgaagcagccaacagttgtgcctcttttgaatggcagctccttgcttgctgtaggaaactgataggggctgagtatctcagagctagagcaccaggcaggatgctgcgaccttaactaaccattctcactttggtacctacaaacacaatcaataaaactggacaggcccaacagatccaaatcattaagtggaaatgatacagtcagaatcagccctaaccaggatcccacaggacccatgtgccccatgaataaatggcaagcttgctagaagggaacaaatggcccataggggacaatttagcttctcctttggccacatagagccaaagattcagagacatgcctgtgtcagtatggcatggggccctgatgattgtacaaaacacatgccagtggatccactgggtgcagccaccatccagccaggggatggcatcttttgactgacactgaacatggtcattctgcccaatgggacaaactacatgaaatgatagtagccatgcaggctgcccccaacactatattttgctccatttccactaaatcatgggccattgccaacagcccagctgtctggtcaggaaaatagcaactgagtgactgaactattaaaggatctcatgagtggagaaaaggactatggcaatagcttgcttcctggacagctaaatatatgtcactctattagatgctggggctaccatggccacccttgagaggaatttatgtcatgtttttggatattccatgagacttcactctgaccaagaaacagcctcactgcccaatcaacataacaatgggcacactctcatggaaacaaatggactttccatgcaattaccaacacccaacactggctgctgtacctggataaacacctcagatatcctagaaatacaagtaggggtgatcataaagcaggctcactggctgcagacaataggacatcaaaagatccccctttcacctcttaacatcttagtcactgcttggggagttttatcctcctaccagtggtactagcttttcatggcccagtgaaatgtactctcactatggcttcataatctgcattgagattgtgtaagtcaaggtgcttcatcaatctgaaaagataaacctctgcctccagttcaggggaagttggtgggcatatgaagtatgctagctttgctaagggggatgagataactgcaagaccgttctgcaatgaccctggactgacttagttctctccactttcttgcttattttaagagttctcaagtacaattgcagaacgtgctggaattgtaacatcctgagatagacaggaactgagcagaacaacctacctgtcctctataccagtttcccatagaatagaatgtccattagcacttcagccctgtgtgtctttttaccccaggatacaaaacccagagtggctgctttcctgagttcctgcactgtggtgtatgtggggtacacatagtcaactccatcagctccacatagctttcctgtgccttgggggactgacccataatgagtccaagaattttgtgttcccttgctgcttatctgtaataataaacccacttcatgtaacttgctgtggggggtgttctcttcccccacgctcaagtacgttggtaaccagtgcacagcgaagttgcttcaaacatgtcattgacataaagacagaactgcaatggaggttgctggaggtagggatagagaaaatgggtggagtattgtttaaggggtatacatattaatttttataagatgaaaagatttttactgattatgtcagtaataatggcagaacatgtgaatatacttaatgccacttctctgcactctcaagtatggttaagatagacaatcttatattctctgtatttactatagttaaataactaacgtctttattatagtattgttagctcagaagacattgttttattttctacttttctgagcaaatgttcataaataatcactttgtgatgacattgttcacaaattgtgtgtgtgtgtgtgtgtgtgtgtgtgttgtagacatggggtctccctatgttgcccaggcttgcatcaaattcttggccttacatgatcctgatcctttctccttggtcactgaaagtgctgagattacaggtgtgagcccgagcacctggccagaagaaacagtttataagacatttcatagggaacttcttcaaaacgtatatttcattgcagccacctccaaagccaatctcctaagccatgtttctgtacacaagtgcacttctccctctgtgatgtcacatcccctcagcatgaagtcacacagacacataggagaacaaggcaaggagtcaacccaactttatgagtggaaatcactgcaaagatctggcattaatagggtttaggtgttgcagcacttctccactagcaaaacactctgatttgtcttcctggattgttttctcaaaggtttcctaatatttaatgctaaagctgagattagaagctttttatcctgagtctaattgaatgctatttcactcaaaatgtattgccttatggagtatgataataaatattgaataatgcctgttactactaccagcagtccctttagatctcctcttatcatcctaaatatcatgacttaggaaaagtgtttgaaagggggtttagacaatattgatcctgttttcaatatcctaatacaagtcaagcacccataaaagtcaagagaattgtaaggaaaacatgacttaatgatgattagccattctggtcactgttgagtgaagattaagaaaaattcttaaaaacaagtagctgaaacattgagaacactcatcaattctgggctgagatgtaaaatggtacaactactttggaaaacagtttggtggagtattaaacacttgctgtaagacccagtaactgcactcctgggtatttgcctaaaagaaataaagaaatattcatgcaaagccatgtataataccattcttggtagctttatccataatagcccaaagtggaaacaacccacatatctatcagcaggtggtgggatacattgtgaaattactacacagttaaatagtacccaaaagtgaagagtaacacatcatgaggacacagggcgacatgaatgagcctaggaaacaattatgctgcatgaaagtcaccagccacaaaagaacacgtgctatattccatttatgtaaaattcttaaaaagaaagtgaaatctatactaacaataagctgaccaaggatggtctgttctgtgaggtggaaagcaagttgattcctgaagagcaggacaaaactttttggagttatagaaatgttgtgtgtattgattttggaggcatttacacgagtgtacttgttcaacagtacatttaaaatcagagtatttgattggaatcattttttttcaataaaattggttaatagtgaatagtgagtaattgcaaatccaattaagtaatgttgtcttcacatcttttattcttgcagtgtactgaaagctacatgagccaaaagttatttctggtagataatctcagcctgacactaaagaactgtgtatcttctagcaagagctcacttttctaggtatttttggatttttccaagaatttaaatgtgtttcataggttaaatcaaaatggtaggcttttaatacacatttcttatttatatcaactaaaagtctaagtaataaaaagttattaaaaattggaaaatatttaaatgcgaggaaatattttttaagttagggaaagagatccaacataccttatagttcatataaatttttcagaaattaaaattacctatcaagagttcttatcgtaaaaactgtaacactttttacaacgtgtgttcactaaatgtgtagatacacagatggattccatttttattttttcttatgatttttgtgtctatgttcataagagataccagcctttaatatcctttttttgttatgtcctcattaatttttggactggaggacattatgacctcctataataattctgagtattttttttattcccttgaaagtttgtgtaattttgataagtaccatgtcactaaccaccaaataaaatttggagttttttctgggtaacttgttattacagatttcttgttacttttgaggtaagaggtaggcagcacttcactctggaccagatgtgaggctggccaaaacaggaataggattctgaaaacacctctccgtaagacatacccaccagtaccatgacagtttaccattgccatagcaacatccagaagtcgcagcgccttgccatggcaacacctggaaattgctgccctgccatggcaacaccgggaagttggggcaacacgacccattttcgagctatttctcgataacccaccccttaattatcacatgattaaaagtgggtataaatgtgactgtaaaactgcacctggctgctactcttggccctctgcctatgaattatgcctgctccacaggcttagtcacagagctgtaacactgctgccccatcaataaagctgttttattcaatcaccggcttactctaacgttctttcccgagcaaatccaagaacttgccttgcatcaggattaagccagccactcaactctagagatggtgagaggcagcgtctgatgtggcagtgagacagcagaaacagcagagaaagcaagacaacaagagacagcaagagatgggattttgtgagaagatggacatagcggtcagcaatgagcaggacagctattggagaattgggaagacagagatcagtgagagagggtgagacggtgatcagtgctacagcgatcaaagctacagagttgctaacattgcagagctgttaacactagccaaaggctgttttaagagccatcatctttcctgacaggcggtggagccctggggatgggcaagtggccacagagccactgcttcatgcaggccagccgctccgtgctccagttccccgtaggagcccaacccacccaagctggggagcctggagagattttcacgcaggccccacgttagagactgcttggcaccattttggctcctgcacacctgtaagtgtcccctctgcccacctgacctatattggatgatccagggaataaggcctttgactcgatagtccatttgaagtcctccatagcacacctgactacatcctccttggtccttctcttagtcatttctcctctaatgccattttatttatccatcagccattttatcttattttctgccctgatatatgtgtttgctttgcagttttggctttggctccctgctaattgtgtttgtgcaattgtttaaggcaggacacttggatgtaagaattctcctgttctgttggccgtaagaagccagagtcacattgttctgtggtcccaatcaggcctttggggctcactgttggccacccaactgaggctccaggattttctgcactggtcagcccctggatattccagggtttcctggcatttggtgtggggacactcataggctgatactcgggtactctgggttttcagcatttagtatttttggccactccctggatgctccagggttttcagcattgacattcctcctaggattgtggattggaggcttaccttatgagaatcttggtttgccttttcttgttttctgccctaaagttaccatttttcataatggcattttgttttcttgttgtcactttatttatgttttttcttctacactttactaaatgaaaatactgctttaaggccgggcacagtggctcacacctgtaatcccagcactttcggaggctgaggtgggcagatcgtttgaggtcaggagttcaagaccagcctggccaacatggtgaaaccatgtctctactaaaaatgcaaaaaaaaaagggccataagtggtggtacacgcctctaatcccagctacttgggaggctgagtcacaagaattgcttgaacccaggaggtgaagattgcaccacttttgtcaagttagttgccaaaaagttactcatttagcctctctttattttttttactctaataggctgtgtaatgactttctcatttccatttacaatattatgttttgtgtcctttttctttccctcttcctatacacccttcatcaagtagtcacgagtttcaattcaattctttcttggtggtagtatggctcatgagaaatgcagactcttctgggtttaaggccattcgttatttttatatgtaataccgtggaacgtattgtgacataatcctctgcttcacaaactgatcactgtcaaacatcatctcccaaacaatacagaatttttctgttcctcactggtataattcacataggagtagaaatctcaagtttaaattgtggatttgcaccttaccacttgctgtattcaagaagatgaataatagtaatacatcagtagggccggggcagtggctcatgtttgcaatcccagaactttgggagaccgaggcgcgcagatcaccagaggtcaggaattcgagaccagcctgaccaacacggcaaaactccgtccctactaaaaatacaaaatttagccaggtgtgatggcacacacctgtaatcccagctgcttgggaggctgagggaggagaatcgcttgaacctgggaaacggagtgagccaagatcatgcaactgcactccagcctgggtgacagagcaagactccatctcaacaacaacaacaacaaaatcagtagctttgaatgtttttatatttatttatttatttatttatttatttatttatttttgagacagagtctcgctctgtcgcccaggctggagtgcagtggcgcgatctcgctcactgcaagctctgcctcccgggttcatgccattctcctgcctcagcctcccaagtagctgggactacaggtgcccgccagcacgcccagctaattttttgtatttttagtagagacggtgtttcaccttgttagccgggatggtctcgatagctttgaattttaaacatctatttgacaagaaatttacagttccttctctctaaaataatgtaatgattctctcaggagtgagcctggtttgatgcctctctccccaacacgatagaagtgtggcacaaatctttgaaaaattcagtttccccgtggcaacaacaactacctgggactgaaaacttcttccctcgctctagtcctttcttctacacccacttccacctcatctgtgactcatacaatacttgtcaggaaagattctggaaaaagcaaagagacttccttagaggtgtcagagattcctgtaccagcatctgtccatctctagagggggttgtgagtatgaggaagagcagagcttgtcaatcttctacttgctttcactcccactgtatttcctaacaacagcaaccagagcaacagccatatcatcacaggacgaacctctcctacttccaaggcttttatttcagtaaatctgctctacctctatctcaggcagctagaagttttgatactcatacaaatactactgcagctttctgttcataattggaaaagtagacaagactcagtgtaatgcaggcattccttatgccagtcagcattcagtttttggatcatcattgcacacatatacccaccatgtgtctaatatatatgtaaaaatccatgaagcaagagtcataatagctagcatttgatattgtattgtattttcctcttatatcatcttctccttttcgtccttaaaaaaaatctgttcaagtcagtctaaattaattattggatgataagtagataaaatcttttatttgataacacattgacccaatgaatatgtttctttgcaagacatagtcctcacttccaagataacaagcctgacaaaattatactggagcaagtccacaagtaatgatggtagcttttccttattgtcagtcctggggcaaaaataagacaaaagataacaaggtagactaaagattatgtaagaaagaaggaaagcagcaggacatgggaaactttcataggataacattttgataatggatgatgagaattaatgcgttagacagagatgggcgggaatgattgaaggtctgagcattttagcacagattaagaccaaatcattaggattttaagagttgtgtacagttagtgaagaaaaagccctagaatttaatttgactgttgataaaacattcttggattagattgaagactcttttctgtgccaagtaagtatatttatgataatgatgatgactgtagtgctaaatatttaatcaataaaaacaaaaataattgccgcatacataatgtcctgagtactactgtaaatgttttatcttattttctttaaactgtctacagcactgtaaggtaggcaccagtattgtcacagttacacagatatggaaactgagacacagggaagttaagttagttggtcaatttcaagcaatcggcaagccatggagcatctatgtcagggctgccaggacatgtgactgtaaacagaagttttaactttttaactcaaagagggtatgtgtctgggttaatggaaagtttcaggaccctcagaaaacattactaacaagcaaatgaaaggtgtatctggaagattaagttctaacagactcctcatttccatcgatccaataatgcacttagggagatgactgggcatattgaggataggaagagagaaatgaaaacacagccttttatattgttcttaacaggcttgtgccaaacatcatctgggtgaatttaggtgattgaggagaagaaagacataggaatgaaattctctgagcacaagggagaagttctacactcagactgagccaacagacttttctggcctgacaaccagggtggcgcaggatgctcagtgcagagaggaagaagcaggtggtctctgcagctggaagctcagctcccacccagctgctttgcatgtccctcccagctgccctaccttccagagcccatatcaatgcctgtgtcagagccctggggaggaactgctcagttaggacccagagggaaccatggaagccccagctcagcttctcttcctcctgctactctggctcccaggtgaggggaacatgaggtggttttgcacattagtgaaaactcttgccacctctgctcagcaagaaatataattaaaattcaaagtatatcaacaattttggctctactcaaagacagttggtttgatcttgattacatgagtgcatttctgttttatttccaatttcagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctcccacagtgattccacatgaaacaaaaaccccaacaagaccatcagtgtttactagattattataccagctgcttcctttacagacagctagtggggtggccactcagtgttagcatctcagctctatttggccattttggagttcaagttgtcaagtccaaaattacttatgttagtccattgcatcgtaccatttcaccgtggctattatgttcaactaaatgcattttagaaggcatctctgtttatggcatcacaaagagtttaataaatcttcggtgcaaaaataaacaacaaacacacatttaaatataaagctgaagtatcaaaactatttcagcactctgaaaattggtgaagtataaaataattaaggatgcatattctttatagaaaaaaaaagtaccagtgctttgagtaaggacagaaaatgtctgtagccttttgcctgtgacagcagccttctacccccagctcaatcagcatgaattacagaactgaagttttaccaatatgagcgtagcaaaaaaaactagcagcttgctgccaaagtgggtggacttgagtaaagccaaggagtggaaaaaaaattattcagtgtttccagctaaacatgcagaactccataggaaatgaacagaaaaatctcacagctttacaagtccaagatgatgacctgtttgaggcaagtagtacatctgctgatagtaaatagcagattcctggatgagatagacccatattgctgaaataatctctgcacacattcctagtgacctagaagatatagatatgagtgatgagaacaaggagtttccggtgcaaagtaaaaccagaaggattcaagaactagctgcattttgcatgcagtttgctttttaaactacacacagatgggttgacagaagatagatttataacctctagatatttaagcaaaacgtctcaaatcattggtgaccacttcactatgcagatacatgtgcagttcctataaattcaaactaaatattaatattaagaataaaaggaagcagtgatatcagtggtcaaacaccacgtgagatagatttttcaatatcatgcaatgaacatgcatttaatacatctaatccacttaacattatagctcagcctatcctatcctaaatgtgctgaaaacacttacattagcttacacttgggcgacattatcttacacaaagcttatcttccaataaagtgttgaatgcctcatgtcatttattgaatactatattgaaagagaaaatagaatagttgtataaatactagaatttctatttctacttgaatgcatatcacattcataccatctgaaagtcaaaaagttataactccaagcatcataagtcaggtactatcagtaagttcacccaagtaactaagaagaaaattaaaaaatgatcagaaaaacaaaacaaattccaggcctgacgtggtggctcaagcctgtaatcccagtactttgggaggctgaggcagaaggatcactggatgccaggagttcgagaccaggctgggtgggcaaaatatcttactatttaaaaaaaaaaaaatagcagagagtaatggcatgcccctatagtcccagctactcaggtggatgaagctggagaaccactggaccccaagaggttgaggctgcagcaagctatgatcacaccaccatactccagcctgggtgaaagagtaagaccctatttctaaaaaattaaaattaaaattaaaaaacccataatctaaagagaggtactgtattatcaaaaatgtaaaattgtcagtttaacagctcctgggaaaaaaactagaagaatgaccaatattaaaggaacaaaaataaagcaactacaataatgacaacagaaaatagtcaacgaaagctgattctaacttgccgtaattatcggatttagtaaagactacaaagattttcaaataattatttttaaaactatgatcattgacataaaaaagaaaatattaagaagatttggcaagtagggcctcaagaaaagatatggaaaatataaaaaatgaccaaattggaactctagaaatgaaaagtaaaataatccaatttaaatacgtattagctaggtctaatagcaatttgagatggcagaataatcagttaacttgaaaataaaggaatagaacttattgagtctaaataaaatgtttaaaaaaaaggaggaagacgtcagagatttatagctcagagtgaaggataccaacaaaagtataatgagagtcacaaaggaggagagacagagaaagtggctgaaaaaaaaatccttggagaaataatgacaaaaacttttcaaaagtaataaaaaatattcttagatgaaaaaattcaataaaacccttttagataatataaattaataactgaacacattatattaaaatgttgaaagacagaaaatcttcactgcatcaagaatgaaaggccattcgccatttttaaatgtagtactgtggaaagtattgtgacacaagcctctgcttcacaaactgatcactgtcaaacatcatctcccaaccaatacacagaaacaacatattgttattggctaagttttcattaggaccaatagagattagaagcagtgaaatgacatacttagatgctgaaaggagaaaaaagtcactaggaattctatatccagtgaaaataccttcacatctaaagaaaaagcaaaaaaaaattttctttgataaaaaagtacattcattcatagcagctatgtcttataagacatttgagagaaaatccttcagaatcccaggaaatgacatcagacaggaccttgagtccactggaagaaatgaaggcctcaaacattgtaaggagcaataccaaggctaaaaagagaaaaatacacttaatgctatttatgtgaagttcaagacaggaaaacctaagtgattgtgttagatgtcagaataacagttactatggctgggtgggaggggcgaaaactgacaaagattgtccatgagggaagcacaagagtatgtgaaatattctatcattccacctggacaatgaattacacataaactttattcagttgcacattgaagatttgtgcactttaccctggctactttatcaattaaaataaaacttaaaaaaaacaaacctagactctttcccacttaccagtaatcacagccaagagcccagactaatttgaaatattattattatcaacacttctttaccctatcttgacacttacacttcttattcagctacagtttcacagctccacctctggcccattcttttggaagaccccatagccataggtcaggtaacaactatagaagatgcataaatgacaagattgatgagtatttagcagaaaaaaacttgtatgtatcacagactgtcctatgcagagtgtacaatacatgtgagtagagtccctctagcacagaaaagaagtgtgaactagaccttcagaatatggtccagtttttagagttcatcagatcatcagatgaacacagatcaaggtgtcctctcatctgggtatgagaaagtgaaatgactgcaggttcccaccagatcagtggcccgtggctttagagacatgtacatgaaactcacatttcttcatatccacagtcacttcctggcttcagccataggaatgacggcctggctttccagttatttaggaactctgcacacaggctgtcagttactaaaatgaaaattaaaaacaatgactttggttaaatatgtaacagtagttacattctgtagggaaaaatgagcagagggaatatattttaatatcaaatgaaaagtcacaaccttgtgactcctttcttttcccatatgattcattacgcttgtgctgaaacttcagactatcaaatgagccccatatgttcatccctaaagctttgtccttgtccaacctgaacccacatttgggccatccactggcatccaagtacacttgtgagatgatcactgtccagacaggattgctggggtgactcaacaggcagctccatgctgagtctccccttgaactcccagcatcactaaccctgcaggagtgtccccttgtcctccacagcacccagagcacagcctgccctgccatgatttcactgcccaactcaaaacctcatcatagattccgccggctcagagacaaagtcaggtcccaggcagaggcaggtgtgggggcctaagaaaaaccattttttcatcaattttcctattaggaattcccaggaatttataagctgaatttctgttcatagttaccatcttaaaaaataaaagctatttgtattgtgagaaacatgaaacatggaaaataattaaatctcacaagagcaccatctagtcagagactccaaattcaactaatccaattctgagctccctgccttatggtccatctccatggtgtctgtgtgctccacccttatcaaatatatgttcaaataattattttaacctataataaaagacttaaaaaggaatttgtaaagacaatgattcaacaaatagaggctctcaaacagagacaaaactatgaaaacagacctactgggaatccgaaaaatgaaaggtacaactcaattgaaaaatgtattagatagactcaacagcaatttaacatgacgcgagagtcagtgatctgaaaaagaagtcaatagaaatgacctcatataaagaagggaaaaattataaagaagaatgaataaaacctcagacattataggtccctgtgaacaataccaacaaatttgtattaggaatcacaaaggagaagacaggaagaggctaaaaactgtgttctcatctttacgcccatgtgtaccccatgtttagctcccgcttataagtgagaacacgtggtatttggttttttgtttctgcattagttcacttaggtaaatgacctccagctgcatccaagtttctgcaggaccatgattttcttcttatttatggctgcataggattccatggtgtatctatacacagtttttttttttatccaatccacggttgatgggcacaatagacactgggaactactagaggggagacaaagggaggaagggcagaggctgaaaaaatacctatggggtacagtgctcactacctgtttaataagttcagtcataccccaaatcccagcatcatgcaaaataactttgtaacatatctgtacatgtatgctctgattttaaaataaaaattgaaaaagaaaaaaatggagaaataatgaaaaacattttttacagtgatgagacaccttaatctatacatgaaagaaactcagtgaaacccttttaggataagcacagtacaattcataactatacacattatagtaccagtgttgaaagacaaagacccagagaatttgaaatgcatcactaaaataccgacttactttatactaagaagcaatattaaaatcattggctaaattttcaccattacaaatggaggtgagaagacagtggaatgatatttttaaatactgagccacaaattctcagccacaaattctatatccagaaaaacaatcgtttaaatataaaagcaaggtagaaatattccttcatacacaaagattaattcattaatagcatatatgccttgtaagagattcaagagaaaattcttcagaataacagagaatgacagcagacagcaactcaaattgacaagaaggaaccaaggcctcaaaaaatgaaaaaagttagaaagaagctacaaaaaatgtttactttacctgatataaagattaagtccaggactaaaacaattatatgtcagaatatcatttacattgattgtgttttgagcagcagtttttgactgggaaggtgcataatgaaagcagcgagagaattggaaaccttctgcgtttctatgtggatcatgatatgaaatgatctggatcttgacattcatttgcacccttaagagttgcaccctttgcactgtgtgttttaccttagataaaataaaataaaataaaataaaataaaataaaataaaataaacaaacctagactcttttaaataaacctaaacaaagaaataagaatcatcaaatatttatgaaagatcaagcttattaaaaagaaacataaaacatgcccgagaaagtcctaaagaactagaagtctagtagaggaaacagcaggaaaatctaaatacgtcccttctgccactcaggcaacacagattttacctctattgatttccttaaaaacataaaatatatttatgtcattttgctcacaagagacgcccccaccttctccttggctctttccaccccactgcacccaccaggggatttgcatactgtcccctagggaggactttccttgtgagtctgagacgaaagctcactctaaccttgccttgactgatcaggactcctcagttcaccttctcacagtgaggctccctgctcagctcctggggctgctaatgctctgggtccctggtaagggcagaagggaaatgagggaggatgatggggtgggagggtgaactctgtggaccccgccacctcccatgtgtgtcctgtcctcgtgttagatgtgtcttgtcctccaggatggggcatgtgatgtctagatctgtgagagtgaggaagattccagaaggagcaaggatatgtaaatattggttctttttaaatctgtatgttttgggaggattaatcaaaatcacacacacaaaaataattgagcaaaacataaataacagacagaaaatgattaaaatgactcacaatgtttgcacataaccttgcacttctctctcattatttcatgatccaatggagatgctgtgatgacccaacctccactctccctgcccatcacccctggagagccagcctccatctcctgcaggtctagtcacagcccccttcacagtaatggatacatctatttcaactggtacctacagaagacaggccagcctccttggctcccaatctatttggtttccaatcacgaccctggagtcccagacaggttcagtggcagtgggttggggacagatttcatgctgaaatcaggaggatggatgctgaggatgttggggtttattgctgccagcaaagtacacattatcctcccacaatggtatagtcttgaacacaaacccccccacttgctgtggcctagctgcccagatgtgctgtttctgtggagagcaggcactgtggattctcttagatgcctaaagaccaagatgttggagaactcagaggacttggtgcagctgagggctcatgaccataaatttcttggctacacctcaggcaccacattttaaggtcccgtcagctgcagcagcctttgcatgacagagtctgcagtatggaggaggtccacgtgccctctgagcaatgagacacaagagaagagaaggctcaatgagagctcattctaatcctctcttccttccctatgttcattcatcaactaaattcattctgcataacaggcacctaattgagactgattactggcaacacaaaactaacacattcttttgatttggtttagcagttaccagagtacatgtacattgataagatctggtgatattaaatcagtttccctcccctcctccacctcccccctccactttttgtaaggccgacccttgaccagaacagcagcaagcactgtattttatcctacttttttcagggagaagccaaataaaactcttcacagtctagattttttaattactagatatgttgtggcaaatgtatgcaaaaataaagacctagttgctaaagtgtttgcacagtctcactcacagcatattgaagtacaaaagtagctttctgaactccaaagctgggtttcaaaaataaggacaaagttcgaaagaataaaggaacatatgtatgttatttaaacagaatttgaatgaatacaagataatatataagctaactttttaccccatgaaaaattacaatgtgaagattttgagcagagggcagcaagtgagagactggtgggttgtgtttgagatatgaacccagatggaagttctcacgtatttcctgggaagaatcacagagttgagaagcgcctgcctggctttcaaggcagtaacaatctcaacagagtcaggttatcaaatggaaatggcacattcttgatcaggcttagtcaggaccccacaggatctgtggctccatgaacaaatggagaggttgttgaagggaccaaatgacttgtaggtgataatttggattttcatttacccatgtcgagcccaagattcagagatttccatatagcaggagtcactgatggctgaggaaaacgcaaactgacaggtccaccaggtgtggccaccattcagccaatggatggccacttttttaactgaaacttagcatgggatttcaacccagtgggtcaaactacattcagtggtaatggccatgcaggctgttccaacatcgtaccatgccacattcccactaaatcatgggccattgccaacagcctcaacatctgttcaggaaaatggcaactgagagactggacttttaaagaatccctggtgtggaggaaaggactatggccacagctttccacctgcaggaaaaagagatacgatgctcaattggatgccgggactaccaaggtcacccttgaaaggaacttacatcatatttttggatacccaatgacacttcacactgaccaaggagcatctttcactgcccaagcaacatgacaataggcacactctcatggaacacgatgaactttccatgcaccctgcatccacaggccaatgaatctagtgaatgctagaacaatggactcacacagcaacatctagaaaggacatctagaaagtctgctaatggggtggtaccccatcttactagagcaatatgggcattaaatatcgcactccagaacaagggaaataatgaatgttaaggaacataatgctgagtggaaacgaaggtagaccaggcagaccctttattagtctggacctgtgaaagctatttcagtgttcctaaccattctttttctttttttcctttagaatgcatgccctggggtgattttcaattcaggccatcatcttaccccagacaggccccctaactctaatatggggattatgtttcctctaaatgcctcttttctacaagatcccacaggatggatgacaagactaagaaatatcagggagctaggggccctcttctggtgccagggccatcttatccttcctttagtattggtgatattatgaaatatgtcaagtttttacagggcataatctcccttcctgcagtggacaatcaggactgaaatgtctgggtcaagtgacaaaggcaatggatttttcacagagcaaggacagccaggccgcattcttacaccaacacagcctaacccttgtagatgggtaggagacacctgagaccctgggatgggtgagagatgatgcactaacctgtcacactgcattttggcaagaatgaggcagcaaaggcctagaagcataacatctttgttagcttcttgcaagtcaccgagtgtaatctttcaaaatactgaatctgccattcttgacctcgttctgtcactaactagaggtttcctttcattctactgaaggcaaatgacaccaacattactgatatcatggtgtacatcaacaggacccgggcactggcctaccaactgaggatgtgatacctaccacatgggagaaaactggaggccccccatttaactaaattgactctgtggcaaatgtcatgaccacaactaaaaaaaacattggtggactgatattttgatgtaccatatttctttgattgcatagataagaaatgccccaatggcaaagacaaaaacaaggagaggactaatgctaccctctgtctatgaacaatattgtctgagcaaaactttgctccttcaactctgccatcagtgagacttggctaatgaacacaccaatacctgcataaccatgactgggtgattaaacaataaaatgggagaaagggggctgtatgcacccaagggctacatatttctctgtgaatggtctgggagtgaacaaaatgcaggatgtgtgatgccatctctggataactgtgggatggtgagattctgcatgttgggcatgctgggcttgtctctggatattactccttggaattaggtgaaccattgagcctgcagcccaaagctgtacctcagacttactagggacctgccagaaggtataacagactatgggtttatgtcttttgtgatatttttggtactatgtataggagtcagtgctcatgtaaaaaagagaaatgataagaaatgtgtccctgaccatggcagatatggctcctcctccatagccactgccttggtagcccagcagacatcccttaactccatcgggatggatgttttagataacagtgttgctctagacttttttaaaatcccaactgggaggattgtatacaatttccaacactttctgttgtacctggacaaacacctcaggtatcctagaaattcaagagaggagatctggaaacaggctcgtaattgaagaaaatggtcccacctgaaggattcttctttcacccctttagcaacttcttctgtggatcattggatcctgggctacataactgcttcaggtgggcctgatcatcctgcctctggtagtagttttcattggcccagtgaaatctattctggctctggctctatgatgttgctttgacattgtgttcgtcgaggggcttcatcagtcaaacaagacacacctctgccaccagttcagggttattagtaggcatataaaatggaatggctttctaacgggggtgtttgggttgggggtgactccagtacagtcctctaatggttctcgactcagttagttctccccactctctttcttacacttctcaagaacaactgtagaatgtgctggaaatgtaacattctgaaatagggagagactggtcagaagagcctgcccctgttccagcttctcctagtactgtcctccagtactttagtcctccagtactttagctccatgtgtcctgtgacaccaggattaaaaacccagagcatcttctttctggggttgctgagttgtggtccaactggggtacacacagtcaagattccatcagacccacatgcctgtgcctcaggggacagacccacaatacatcctaggcttctgcagtcccttgttggccacctataaatactacaccagattcttgtaacttgttgtgtatgattgttctgtctccctggactctgataagttggtaaccagggcacagtgaacctgcttcagagtagtcactgtcatagagacagaacttgaatggaggttgccaggaacttgaagcaggggaaatggggagagggttgtcatttaattgaaatagagtttcagttttagaagatggaaagagttctggagattgctattattgatgatagcacaacaatgtgacttacttaatgccattgccctgtacacttaaaaatggctaagatgggcaatgttatgttctctatatttaccatagttgaaaaacttagcatttttattatgatattgatggattataagacatcattctattttctagttttctgagcaaatgttaataaataatctcttatagatgtcattgttcacaccacatcttaccaaacattcttttttttctacagacagggggatctccttattttttcgaggctggtcttggactcctggctttcagctgtcctccatccttgactttgcaaacatctaggataacgggcataagcccctgcaccttgccttaactaacaatttatcagctttaacagggaacttccttgaaaatgtatattccattgcagccacctctaaggccagacaatcccctaagccatatttctgtacccaagtgcactgctccctctgtgatgtcacatgccctcagaatgaagtcccataaggagaacaaggcaaggaggccaccaaatgatctgagtggaaattattgtgaaggtctggcattaaaagagcatcagtgttgcagtttttcttgactagcaaaacactctctgacttattttcctggatgtttttttttttccttaaacttttcctaatattgaatactagggttgagatgagaacctttctatcctaagtctagttaaacactatttcattgaagacatattgccttatggagtacgataataataaatgttgaaaacacttattactactcccaacacaccttgtatataccttgttaccatcttaaatattatggcttgataaaattatttgaaaaggagcttggatggcattgattctattctcaatatcctgaaacacatcaaccaccaaaattgacaagaaaatagtcagaaaaacatagcttaataatcactagctattctggttactgttgagtgacaattaggtgaaatcttaaaaaaaaaatcaaaacagcagttggagggtgtggagctataataagttattggtggacatgtaaaatgtttcagccactttggaaaaagttgaacagagtattaaacacttactgtaagacccagcaactacacgcctaggaattagcccaaaagaaataaagagatatgttcatacaaagtcttgttcaagaacattcatagcagctttatccgtaatagcccaaagtggaaacaacttacatggcaatcaacaggtgaaaggatccattataaaattaccaaacagttaaataacactcaaaaataaaaaggagcacataactggaacacatgacatctcaatgaatctgagaagcagttatgctgcacaaaattcaccagatgcaaaagagcacatgctatatttcatttatatgaaacccttaaaaagaaattggaatctgcactgacaataagcagatcaagaattccctgatctgtgtggtggaaagcaagtggattccaaaagagtaggtcaaaacttttgggagttatagaaatgttctatgtctggattttggaggtggttctgcagatgtatttatttgtgacagttctttgacagtgtattttattgtaattttttttcagtaaacttagttaacagtgaacaaagtaagtgcaagaccaattgggtaatgttgtctttgcatcttctatctgtagtgtactgaaaattgtatgagccagaatatctgagagaaaatctcagctccgaaacaagaactgtgtagctcttggcaagatctctcttttctaaggagtttggatttttcttctatagaatgagaatttaaatacccttcatagattaaatcaaaatggtaggcttttaatacacattcattattcatttcaactaaaagtctaagcaaaacaaaaagtcatacaaaaataaaaataatatttaaataagatgaaatattcttttaaaagttaggaaaatggaactgtcacatcttccgtttcatatcaattttttagaacttgtaattacatatcaagtgttcttagcataaaaactgtaatacacttaaccatgtgtgttcacaaacatataggtataaaaatgattatattttccttctttccctatttttcagaatatttgtgtttatgttcacaagagataccagcatttaatttctccgtttgttacgtccttgtttgtttttggactggagtatatggtgatctcatatgataagtttgggagtatttattctttttgaatctcttgaaaatttgtgtaattttgataaggtatcaagacaccagtcaggcagatataaaattggaaatttcgttctgggtaaatttataatacaaagttattgttacttctgtcaagctagttgccataaaaatactcagaatatccaccttttgtatttttataatcataggctctgcaatgattttcccctttccatttatagtgctgtgttttggggttttattcttttttctacccctttcatcaacttgtcacaggcttcaattctttctgggagggcatatgtggcacatgagaaatgctggttcttgtggatatgagatcattcactgtttttgtatgtaatactgtggaaagtgctgtgacataaacctcttcttcacgaaattgattactgttcaaacattcttccccaaccaatatggaatttgctgtgtttttaatggtgtaattcacataggcatacaaaccctgaattgaaatagtggatgtgccctctaccacatggtatatttaaagaagttaaataatattaacacgtaatgagtagctttgaattttaaaaatctatttggcaaggaattcacagttccttccatctaaaataacctaatgattcttccagaagtgatcctggtttgatgcttctctccccgtggtgacagaggtttggcacatcatcacacttataaagccccccatttacctgtctacaaccactgtgcaggcatgaacattattttcccttgctctagtcctttttctacaccctagtttcacataatttgagactcaaaacatttctcaggtaagattctggattgagctaacaagatttctccagaggtgtcagagatgcctgtacaatcactgatgcatctctagagggagttgtaagtatgaggaagagaagagcttgtaaatcttcaagctgcttttactcccactgtactaacaacaactactacaatcacaacatccacaacagcacaggacgagcttctacagcttccaatgcatctatctcagtaaatctcctctacctctatctcatgctgctagaatttttgagagtcatgcaagtactgctgtaccctttagttcataatttgaaaagaaggaagcctcagtgcaacataggcagtccttaaaccagtcaccctttagtttctggatcatcattatacacataaacacagcatgtatcataaatatatatatatatatgcacacacacacacacacacacacacacatatatatccatgaggcaatacttaccacagtctgtgttttctgtggtattatattttcctctttttctcttattctggttttttccttaaaaaacctccaactaacttaagcaaattaacaagcaaaaaaaaactattttaaaaagtggacaaagtatatgaccaaacacttttcaaaaaagcatattaacggccaaaaagcgtatgaaaaagtgctcaaaatcactaattattaaaaaaatgcaaatcaaaaccacagtgagataccatcttacaccagttaaaatggccattattaaaaacttaaaaatgacagatgctagtgagtttatggagaaaagagaatgcttatacactgctggtgggaatataaatcagttcagccattataaaaagcagtttggcaattttgcaaagaacttaaaacagaaatatcatttgacccagcaatctctttattggatatatactctaaggaatataaatcattttaccataaagacacatgcatgtgtatgttcatcactgcactattcctaatagcaaagacgtggaagcaacctaaatgcccatcagttgtagattggataaagaaaatgtggtacatatgcaacatggaatacttaatatacagctatgaaaaatgagatcatgtcttttgcaacactgtggatggtgctggaggccattatcctaagcaaactaacacaaagattcaagtttatgctaatcaaggctcctgtagtagaagaagaaaaaaaattgttttaaagtaatcagatttagcattgctagtcagacttttatgctgatggaccatgggaaataattcacaatgacagaaaagggggtagaatatgggggtccccaagcagagaataaaatgaatcccattaaaactcgagcattaaagagacttatagctctggacaatgcaggaactgtggatgtcatatgctttaaggaatcccaatatcatcttctttgtcaatctgcagtaaacctcttcagcttagactggtaataacattggtttagggccattacaaaatgcttttgagaacattttacttgctcatgactaagtgttcttttttacttaaaaaaagatcaatttcatgcttacaaaaatgtagtatgtatgtcacaaagtatcgctcccaactggaacaatttcacagtgtgttgaagacctgatagccccactctctaagactttattaagaattctctacaaacaaggatattctcctacttatgcccaatacggcattgaaatatattattccatctagttctcacaaccacttcgagatttgccaataaatgctcaaaaatgtacttggtaacaaaatatcctttaggaagaaacattctctgcaggcaaatctaggtgccctggtctgacctgggacactggggacactgcccctgtgctgagttactgagataagccagccacgcagctgtatccagcctgccccaccccctgccgatttgcttgttcccagagcaccaccccctgccctaaagacttcttaataggctggtcacacctgtgcaggagtcagtcccagtcaggacacagcatggacatgagggtccccgctcagctcctggggctcctgctgctctggctcccaggtaaggaaggagaacactaggaatttactcagcccagtgtgttccgtacagcctggctcttgagggaagttctcttacaacatgattaattctatggacatttgtgtttatatttccaatctcaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccctcccacagtgttacaaacctgaacataaacccccagggaagcagacatgtgaggccgggctgccccagctgctcctcctgattcctccatcagctgagagtgttcctcagatgcaggcacactctgatggtgttggtagagggggatgtgaagtcacctctgcatcccaatttctttttctttctcagcaccaggtgcacagacataacagttcctctcctgatttaaaaaaggcagggatcatgacacctgaggagtctagtttatggcttcagttggaattcaagtaacagagaagaagccactatagatattctaagcaggaattgtcttgatacagagaaatagagtataaactatggaagtctaaataaaaatatagagatgaatctcaaatttcatgttttatttgctaagaaatatttgctaaatggggcatacagaaaaactcaatggtcttcaatatgttgaaagaacaaagagaagcttagagtttcatgaaaaaaggaaaatgttacctattgctctttgagaaagtttattggctccagaaaattttgggagctggcaagctcagaatggtaagcactgatggacaaactgaatcctagaattatgttaaattattcagaagttggggttgaatttgatttccggttacaagaggccaaagcagtgaagcttgcagagaatcttgttactgaaatgccagggatttggtgtagatcctgctgctcaccacatataaaaccaatcactaagacaacaagtattgccaagaaacaggctttaatcaggtgctgcagctgtggaaatgggaccccattctcaaatgtatctccctgacaaactaaaattagggggttatatagcagggaagaaatgtgggcaaacaggaattagggaggggtaatgaagttaattttgtcaacaggaagcagaaggtcagtgaggcaatcacaatgtgtgaagggtctgacgtctcactgtcctgattcagtgatatgtaagtttcagctctctgatagtatctggaggcctcttggtgggtttcctgaaaaaggaactcagataagacaaatgtaactaacttgagttttaagactggggaagtcaatttctatgtttattcaaaaaaccataaacattacttccatgggataatagggcctatttcaattgcattcttcagacaatattttacaccctgagtgtctttccctcctggtttcttggctctgttgggtatgtcaagaatgacccaattcctacattaacgttcacactgcaacctttcaaggccaaggatatagtagtcatgaaagctgacattagaagcaggattctctggtgctccctcagaaaacagaatccatctgcccctaaagtatgggctatctaaccatgtggtcctcagtcctgtctggaagcttaggggtgggggtgctgatgctctcagcttcctacagcatcttttcaggtgtttctcctgtcctcatccctgtccctgtgtctgtcttaggtaccaatggagaatattgagtcatccttttctgatttccaaatctcatggaaggacctcttattgggcaactctataggacaaaagagaggcaaaaagggatatttatgtaagttaaaatgaattttctcccatgaggccatttaagtatattatatttaaagccacgtgttgaaaacacatccagcttcagtttcttattaatgcaaatttacatttgcaaatattttcaatactgtaagttgaaatcatagttatttgtccatggaatgatcaaacacctctataattaaatggagtgaacattttcttaaaaatttgtactcactgaaataaaggaatatatttaaaatgtgtgaagctatgttagaaattattggacttaaactcagctgtgcagtttggtttgggatgttgttcactcttgtgacctgccagaagaatcttgagtcatgggtagtcactgctgttcagccttgtcctaagacaattaatatgtataggctgaagacaagctcagtgccatgcagagaaaccacttacctgagcccttccttgatcagccagatgattgtgaacatgagcatccatgaacatgaaaacaaatatttactgttatcagtcactgagttgtgtatttagccagttaccaatcattatgcataaaagctccctgatacattatttacacctctacctatatatacacacatgtattttttcttaaattggtggtataaatgtgaatatttagtaatcaaattataaagttattaaaagaaaattaatgacaaaattaaaactaatatttcaataaaaaattaaaatttaccttatttgtggaaaaatatgcataaatgtatgtaagatatgtataaataaatatatacttatttgttaaaatggctacatatatatagtatttatgtttaattgtgtttcttctattatatatgcaatataagcctatttgtaaaattattatctacattgaatacatttaaataatttttgttacattccataaaaaattgtattctggaccacaaatagttcatactcttgctacagaaaatttattggtagcctttatttttaaaactctaccaaatggttgtccttacatgaaaatatttttccaacccagtagagctccaagggtaggactagaagaaattttgactaacgttgaatattaaccattgcatcctgtgaaaatctccattatgttcatgcccacaatgatgatatgccagatagagtcctcacaacaatagatgctggatggagtcacatcagtgccattgtcaaggaagccctggaaatgtaaaaatcctaaccgtgggtaaactgtaaggttacatctgatgatcccattgcaaagagaagaggatttttataatattggcctttggttttaacagatcatcaggtcttaaaagaaacacaacaggatgattgcagacaaagccattctggaagagctatgatgagatgtttcaaaaatgagccacaatccaaaaaaatgctttccaagtgagtattaatcaaaatgccattaatgagcagggggcttttaataatgaggatgattcaacacatggacttcagtcagtcacctttcccagctttcccagggagtatcatgaaccaatgttatggaggtctctggggggctcaataatatgactttcaactaactgagacctacagggctaccggcttttctgaacatctaatttgtcaagaagaacccctaacattgtatgatacatcagggctcagactaacagctggtattaggtgatactagtggacctcatgtaacataaggaaagcactggttattttcctatatatgaatttgccattcttatcggttatgtttctgcataaaatattatttgaggattttccaagtgctttcatcagaatcaggaaattcttccataaaatggctttggatcaagcaagttatttacctcaaaaaagaagagcgaagtgtagcttatgatcttgtcttgtgcacaggtgcaactttccctatagacagggaaaaacctattattagtcaagcaaagctgtcacacaaacccttgtgctgttgaattactatacgatcagaagtggtggaggctctgaaacattaaccgtgatgggtgcttttactcccttaaacagaatatatatatcttgaaaatgagctgtagacttaccattgttaacgccaactgaacagcttgaaatactctatttctgttttctcagggctgtggttttctggttgatggttcttttttttttttaagacggtctctcactctgctgccaggctggagtgcaatggcgccatctcggcttcactgtaacctctgcctcccaggtttaagctattctcctgcctcagcctcccgagtagctgggactacagggggtacaccacctgtagcccagctaatttttgtatttttactacaaacggggtttcaacatgtgggccaggaatggtcttgatctcttgacctcgtgatctgcctgcctctgcctcccaaagtgctgggattacaggcatgagccaccacgcctggcctggttgatgattcttaatccaaagagttgacatgacaattatcccaagaaattggaagaaatgatataagcatgtgaccatttagacttaagacaatactggataagttgtcaacacagggtgttagtttgtttgctggggccataggtctagttcatataaagcaagagcaaatggaattgattttacatatcttagagaggaagtacagaaaatatgcaccctaggggaccttctggaatgtttctatttattgccatttccactggtaaaactcagagaagacgtcaacagtcatcaggtagaagttctagggatcacagtcatgtgaagcattacttgcacttggatcgccagtgaggcaaagggaagatgaaacgcatagtgggatatggaggtggaaacattcatggtcagcttaaacgtggaaaagtgtatttattttttctctttagatttatcactgaatcagttggatctgagaaaagcgattatgactggttaggtagaaaggtgtttattatcatgaattaaatggattgaaaacatttggagaaaccagtggcagcttagggatctccaagtactccctttgctattccctcaccctgcccaccccgtgttttccacagtgaaggaagatactctcattttgatagaaacatggcaagtgaagatactgtgcccacaagactgtgctgcctggctgtgacccagaccaggaaattgagtacatttgagtgagatcaggcacttcccctccctcatctcaatccaaaagcactctgtagtaacacatctgatgggcattcttcaccacctatgggacttaggaagccaaggacatgaggaatagcctttccagactctaccatagagaaattattgccagaaactagagaataaaataaatacggaagaagctggtgacaataacgaaatgagccattcatatatgtatgttaaataatttagtcttttcaatacaccctttctttaaaaaaatcaaagtgctatttttagccacctttataatatagaccacatattaaataatatgtacacagattaatggctcatgagagaagatcattttttcctggatggtgttgggctgaacagattggagattcctcacattttggggagcacagtgctacattggtagcatgatgttctttgtaaagaaaatatttatgttagattgtagcctgttgtggttgatactagtaatgcctggaaattcaagtgtagaaagatgtgtacttatgatagaaagccacaggatggacttgggcagaaataaaccctgcagccttgaaaacagatgaatctatgtgagactgacatgaagatgtaatcaacacaggcaggtatgcagagaaaggggtcagttttctagtagttgatagcagagcggctgtccttctgggggcagtagtgagaagagctgctctcttttctgcaggagacagcttgaatgtggagtctaaggcagcaggagctcctccccagcctgcaccagcagtgccattcttggaattgttctagaggctttgccaggagcatgttccttaagacttttcaacaatttgcaaggaatttaatatccctagtaaatccctttatgcttcacgaatttgacatttgcaacagggaatatacacaatccacagtgacatcattcactgcctcctgtttttcttgctaaatataatgcttttcaggtggacctgccagaggaagccaatgtgaacaacaatccatgtcaccaaaaatgcaagacaaataagctcgggaaagtcactgggttctcacatagctgcactgtcccctggtacaaaatgggagagtgtaaaactcttagctccaccatcagagagatggtggagtgtgaccttctcagtatagtaagtcagtatgtatagacatttaaatactaacacctttaacaccaaaatacaggcaaaggtagaaaagaagataaattggacttcataaaaatttaaaatgggcatcaaaagacataatcaacacagtgaaaatgcaacatgtggaacagaaaaaaatatttttaaatcatatctgataaggggttaataatatctactatacaaaaataatttctacatgtcaacagtaaaaataaaataactgattaaaagtgagaaaagtacatgaatagacatttccctaaagaagattctttagagataattagataactagaataagaaaagatgctcaatgttattaatccttagaaaaataaaaacaaaccccactttgcacatattaggatttttttccaacagaaaatgaccagtcttggtgagaatttagggaactggaactcctgtggacactgtcttggtgatgtaaatggcccacctgctgtgggaaacaagatggcaattcctcaaagaaataaaaatagaaatactatataactcagcaattacacttttggacacatacccaagtaattgaagatattaacttgaggacgtatttgtatacccacattcagaaccgaattgttcatagtagccaaaaggtagaagcaactcaaatgttcacaaaggaaggaattggtaatccatatgtggtatatacatacaaaagcacattactgagggaaattctgacacacgctacaacatggataaaactagaggacactacactaagtgaaataacccagtctcaaaaataccgagttatgatttcactttggtatttgcagaaaagtttccatttagtcatgaatcaacccagtctccttccctttcttgctagtagttttcaggaataactgtagaatgttctggaaatgtagcattctgagctagaacaagattggccaaaatatcctgggctctgtttctgtccctactacaaagaggaattccctcaacactctagcccagtgtgtcatgtgattctaagacataaaacccagggtggactgcattccagggtccctcagctgcagtccttgttgggtatgtatggtctagagtcaatcaggccctgacagctttgtgctctctcatgctgactctctgtaagtagtaatccacttcatgtaactggttgtgcatgggtgttctgtctcactagatttgggtaagttggcaaccagtgcacagcaaaccttcttggcaaaattggtgcagtgagaaggtttgatttgagagaactatggcttatggtgaagttggaggaacaatactctccagtacctggcccaggacagagatatcagcctggagatgcaagggctggacatgcagatggatgtttaatgaggagggaggataaacaggacatttgtcctcctcccattaatatggatcagctggctgactgaattgagacatagaaaaaagaatgtggaaataggaatggggtacacaattttctagttgttagacagttgcatgattgctcattcctgaggcaagagagctcaagacatgggtaatcagatggaccctgagtcacccaagatgacacaagaaagataatctcaatggtccctgaagcatctgataaggaaccaaaatgaacaacaatggccatcacagaaaaggaggctcactctctataaaagagacatggaaaaacacgagggaagtcttatgcagcctggtcggtgtgtttgtttggttaagccacattgcagacccaaatgtctgtctgaatggcacaggtaggaacagggccaaggtctccaccagaggctaccagccctatattcctctcaagataaaaggtgaaaaaaaaaaaaaagaattcagactattctgggatttttgtatgctgcaatccacctgacaatattaccaggtcctccctggaaaaaaataaactgaagacatcagaaggtgtcaagacaaatgaggaccccatggtgagtatgtgcttgtgtgctgatctgcatgtggaccacaccctttgggctatgttgggtgctggtgaccatggttctcactgcagagtgcaatagaggtactgacattttgctgctgtgccacaaaacatcactgctgcctgaggggctatccgcactcatagctaagtattcaagacacgacagtggggcatatccactcctgcctgccacctaagcttcccgtgtcccagagtgttgttcacaaagcaggactgcatattcagtgaagatcggaacactacctagtaaatttaatagttgctacaaaaagattaaaatgtcacaaagcctggtgtcacaatggaacaacccagtttggcagaccaatgatggattgttgaaggctgaatgccaaggccacctgaaaaagaaacctaggaggtatcccaggtatatttaatcattgctggtcctggtggcgtccactaataagatggagacccagaagctagtaggtattttggggtactggggacagtagaaaccttacctgggtgttcttttggtcatgttagtcaaaatcacccttggaatctgttcaacaaggcatgactgaggcacttctttaagaccttcagaggctgcttgctcaatggaaatccaggtgtccactatttctatatatgctgactggagcctgtggcaacagaagccaccagttgtgcctcttttgaatggcaacttcttgctgtaggaaactgataggggctgattatctcatagctagagcatcagggatgacgctgctaccttaactacccattctcactttggtgcctacaaacacaatcaataaaactggacaggcccaacagatccaaattattaaatggaactggtacagtcagaattcgccctaacccagttcccacaggatccatgtgcaaatggatgaatgcccataaacaaatagcaagcttcctagaagggaacaaatgacccataggggacaattttgtttttcctttggccacaatgagccaacgattcagagacatgcctatgtcagtatggcatggggccctgatgattgtacaaaatacatgccagtgggtccactgggtgaggccaccatccagccaggggatggcatcttttgactgacactgaacatggacattctgcccagtgggccaaacttcatgcaatgatagtagccatgcaggctgcccccaacactatattttgctccatttccactaaatcatgggccattgccaacaacccagccatctggtcaggaaaatagcaactgagtggcagaactattaaaggatcccctgtgtagggaaaaggactatggccatagcttgcttcctggacagctaaatgtatgtcactcagttagatgctggggctaccatggtgacctttgaaaggaatttatgtcatgtttttggataccccatgagacttcactctgaccaagaaacaaccgcccaatccgcatgacaatgggcacattcttgaggaacccaacggagactttccacgcaattaccaacacccaatactacctgctgtgcctggataaacacctcgggtattctagaaatacaagtagaggtgatcctaaagcaggcccactggctgcagagaatagggcatctgaaagatccccctttcacttcttaacatcttagtcactgctttggggagtcttaccctcctgccagtgtgtgtgtgaaagattacgtaggtgccgaggaaaagactgcaggcaaaactgtttcagtagaataaagaaaatagttagaataagaatagtcataacacaaattagatatagagatgatcatggacaattatcaatcactattataaacattattaatcattagcttttaatattactctttgtcgcattactaatataacctaggaataacctaagagtatagtgtcaggtactgaagggacattgctagaagtgacctagaaggcaagaggtgagccctctgtcacacctgcataaaggccacttgagggctccttggtcaagcagtaatgccagtgtctaggaagacaccctttacttagcagaccgcgaaagggagtctcctttccttggaggagtcagggaacactctgctcccccagcttcttgtggaaggctggatattatccaggcctgcccacagtcatccggaagcctaaaccattccctgtggtgctgtgcctcaatggtcacactctttgtccacattcatgttcctcccatactccgggttcctctttgacgttcgtagtaggtagcggtagaagaaatactgaaagtcttaaagtctttgatctttcttataagtgcgtagaagaaaatgctgacgtatgctgtcttctctctctctgcttcggctacctaaaagggaagggccccctgtcctatgatcacgtgacttgcttcaccttatcaatcacttggaagatccaccctccttaccctgccccccttgtcttgtatgtaataaatattagtgtgcccagccgtccagagccactaccagtctccacgtcttgatggtagtggtcccccaggccaagctgctttctctttatctctttgtcttgtgtctttctttattacaatctctcatctctgcacatggggagaacccccactaagccccacagggctggaccctacaccagtggtactagcttttcgtggcccagtgaaatgtactctcactatggcttcataatctgcattgaagttgtgttagtcaaggtgcttcatcaatctgaaaagataaacttctgcctccagttcaagggaagttggtgggcatatgaaatatgctagctttgctaagggggatgtctaggtggtggggtaattgcaaaacagttctccaatgaccctggactgacttagttctctccactttcttgcttattttatgagttctcaagaataattgtagaatttgctggaatcgtaacatcctgagatggagaggaactgagcagaacaacctacctgtgctctataccagtttcccatagaataggatgtccgttagcactttagccctgtgtgtcttcttagctcaggatataaaaccctgagtggctgctttcctggattcctgagctgtggtgcatgtggggtacacatagtcaactccatcagctccacatggctttcctgtgccttgagggactgacccataataagtccaagacttttgtggtgttcccttgctgcttatctgtaaataataaacccatttcatgtaacttgctgtgtgggggtgttgtgttccccacactcaagtatgttggtaaccagtgcagagtgaacctgcttcaaatatgtcaatgacatagagacagaactggaatggaggttgctggcggtagggatagaggaaatgggggggagtattgtttaaaggatatagatattaattttattcagatgaaaatggttctggatttagtatcagtaataatagcagagcaatgtgaatatatttaatggcattgcactacactcttagaaatggttaagatagacaatatcatgttctctgtattactatagctaaaaaattgacatctttattatagtattgttagctcagaagacattgctttgttttctaattttctgagcaaatgttcatacataatcactttgtgatgctatttttcacacattttaacaaattgtgtgtgtgtgtgtgtgtgtgtgtgtgtgttttgtagacatggggtctccctgtgttgcccaggctggcatcaaattcttggccttacatggtcctttctcctcggtctctcaaagtgcccaggggctactaagtgtctgaaatcttctcaggggaacaggctgggggacatctctaaattcgcatcccctctgcctgaaatccccttcccacctcctctatgggcacctctagtgtatcttgtgggcatcactgcctggagcatgtcaggatgttttctcccatctcctactctgaattcatgatgcaaattcatcctcacttcagacacgggctggccacgccttgtgtctcttacctgcatgccccggcacgttgctgaacccatagttctgaccccactctatgaatctttgtggaagggtcatggttggcaagttgtggttattggagaccagaaagtaaaatggcaactattgagaagcttgtgcatggggcagacataggccattgtcaacagagtcccagcagctggtgagccatgaaagctgggcagagatcccacatcaccccagtcagaggggaagctgggaatgagccatggaggggcttcatcctgtgacaatgcagcctctgagccatatatgctgctttgtttgacagaaatgaccagaggaggacttgtctatgctgagctctggaaacaaaacgtccctccattcagggcccagacccactatccatttcctgggcatctgctgttctgtgattccgtagacccccctcaggtcactcatgatcctcagcaacgggcagttcacttctctcagcccagggggaacatggaagagggtactgagctttatgaccctcaggtcctggagtgaggagggccatgaggtggtgcacccagtgctcattttcaatgttcatgttaaatttatttaagtttaaaactataccttatactagcaaccaaagttatatctctttatatataaacatgcatcacatatttattcataaatacatagtatatacaaatatataaatacaacttatttcttaaatatgtattcaatatgtaaagttcacaatagaaattcatattacagatacatataattttatgcttatttgtgtagcgtgtgtttcttttctgaccaagcagaatagagtctggctgagtaaagactttaaggacatttgctgactgtccgtttttggctccagcagggtcccagtcattcagcaccagggagggcagagctgacagcagccagcccaggatcccagcaccagccctaaggtctgggtctctgagacttttactcttgccaggctgggggatatatgcttaatgcagctcccctgaatttgtgagcagtttccttccctgaagccctgccaggcagccctgtggccagggcctgtggttcctcccagattctcagccctgtggctcaggagagcagctgcttcctccacagcccagggccagtgcctggcatctctcaggcactgccagcctgaccttagccctgggctaaggaccctattccaaatgtctcctcatttattgcagtatctgaaagtctgtcttgttcttaaactcaaagtccacatttccacaattgctaaagctagcatttgccatctgaaaatttagaaatgtgaattcattgtcactctcagaaactgccctcttccaactctaccagacagagttgcccatatgttctcttctctccacacaactttacttagaattatagtgaaatgtaacatgtggtaaagctcttacctcctgtacagaaaccatcctcttctcctttggtgtctagggcatgagctctagcctgctgggcatggtgaggacagtgagcctctcccagcccgggacaggagcagggattaaggcacatgtgattagctccacaatacaatgtcaggggagtaaaggagggacaggaactctgggtagaatttgatccttcataagaagatggaaggtgaagagctttgcttcaccttctaaaatcaatgactttattttagatttggaagcagggacacatgtttcattgctctgacaccttccacatctcctctttctcttacaatatccctgtcccagtctgtccctctcagattgtgtcctgaaaatctaattttccctcctaatatgaaaacaaactaacaaaaccctcttcctcctatcatgtgctgtgagttctgacccctaaactctgtgatacccagatcgtataagagataatcatgggattttccaaagagaatttctagctaaaaagaatttttgtacgagctcttctctcagaaaaaattttctctgtctcttgtctgacaccagataacaaggtggaaatatttccaagaacagaggacaagcatgctctcagtgagctgaaagacatctcttccccttgcattagtttccaacgctgctgtttaaattgccacagtcttattggcttcacacaacataaatgtattaccctgtagttctggaggtcagaagtctcactgagctaatgctaaggtgtcagtggggctgtaatccttctggaggctccagaggagagaactggattctctgcttcttatcttcaatgtgctcccatatttctggttccatggccccttccttcctcaaacaacatccgtccccattgtcccagctcctctctgactgcaatcctcctcctctattttaaggacctttgtgattgtattgatttcatctggataaccaggaagcttattctcaaagtccttaacttacatctatcaaggtcattttttgctatctatcataaggtagaatccttatgatatggctccaatgactggaggaacaccagggttcttgctgtttcacactgctttggataaaatgccacagaaagatgtggagtggttttaaggagagaaaagtttaatatgtaagaaggaaggaagaataaaacagctaaacagctaccctgtacaaagacagagggacaggggattccaacaaagagaaaactccatctgtggtggaaaagtggctgcttatatgaggagaatgaaggaggtggtgtctgatttgcaaagggctcaagggattggtttgaccaggcatgttattcacatagcctgagcaaaaactggccctcccaccctagcctttcaatatgcacatgtagggcatcataatgttctacacacatggggatatgtgggggcagccatgttgccaggcacatgtaggggcaaggaagaagaaggtaggaatagccatgttagggtggacccagtttctaatggccttcatttgcatatcaaatcttgccagcctggctctaagagccggagctttcctattagacaagaaacatgtctggagttgctttaaaagaaacaaaatcttaccaaggatgccttttcctctctatctgcctaaaataatttcttaataactcctataaaacttgggttccagagacaaggacctggatatcttttggggtggggacattattcattccaccaaaaattaatatattctccaaaattgtccttctttaaagtaaaatttaaaaaataacaaagcatttttatgaagcaagagggcggtacaaaatctgagacttagagtctgacttataaatcctctaacttgtgagttttagctgttggggtatgctcactccactcctttatctcactcctttatctgcttaaaagcagcttctccagaaggaaactgattgtcaagaaaattcttcctgggaaattttatatcagggaagattaacacaaaataggaatcaaaaatagaagagattagaagttgatgctttatccagacaggctattacctgttcttttgaggatgcacttctatcctcatctattctctccaggttgcctacacttcccaattacctcttcgctagaaaggaagtatgaacaactggatctcattgagttatctgagtaatcacaccgctatgatatcccactgcactttaagtgaattttgcttgccttttctcttattagtctttcttttgtcagttcattttcagcaaacatttagaggacaaatggagctttcttcccttctcccaatataagcaagttcccttaaaattcaggtggcttacaaagcagcaggaaggtttgtgcatgggctacagcactgtgatttgtctcccctagtcaggcatcagtaaaattttgtggagtcctaggctgcagcccactgatgctgatgtagttggatccacgtcccctgctactaagccaggctgggacatttttggcacagtagagatgtgagatataatgactgcaaatccatgtccagtttcatctggatccagctgatttctccatgtaagttggcaattgcttgataagggattgtctctttcctaaagatgttaacagggaggatggtgtctgggtcaggatgatgtccctgataaaacgtaaaagaagaaagtggcattgttggtgcatgacagggacatgctccatgcagtggtcaccctcaataagagagaagaactttggaaagtaatactcaatgacagaaaagaaggtagacaatgaaggtgcccaaaacaagaataaggtgaagtgaatttagtctctgggtattaaagagacctgtagctcttgataatggtggatgtgtgagtgctgcatgcattgaggaaactcggtatcatctctctgtatctgtagtaaattgcttgatcttatagtggtaagaacaatggcataacaccattacctaatacttacaaatatgtatagcatcatgtcaataaattttatttttaatatttttagaaaggaacaatgttaaaactcacagaaatgttgaagtataggacaaagtacctccttccctaacccgaatcatatgagagtcttttgaagtcctgagaatcatactgtttaacattttactatgtatttcctacaaacaagatattccaaataatccccatgtgccaatgaaatacattactccgtcgactcctgaggaatatttcaaattttcaaaaaaatacataaaaaatgtttctcataacaaactactctccagtagaaacacattcaccacagacaaatttgtgctaccctggtctttcctgggacacctggggatactgagctggtgctgagttactgagatgagccagccctgcagctgtgcccagtcagccccatcccctgctcaacctcctgccctgaagacttattaataggctggacacacttcatgcaggagtcagaccctgtcaggacacagcatagacatgagggtccccgctcagctcctggggctcctgctgctctggctcccaggtaaggaaggagaacactaggaatttactcagcccagtgtgcttggtacagcctggcccttcagggaagttctcttacaacatgattaattgtatggacatttgtttttatgtttccaatctcaggtgccagatgtgccatccggatgacccagtctccatcctcattctctgcatctacaggagacagagtcaccatcacttgtcgggcgagtcagggtattagcagttatttagcctggtatcagcaaaaaccagggaaagcccctaagctcctgatctatgctgcatccactttgcaaagtggggtcccatcaaggttcagcggcagtggatctgggacagatttcactctcaccatcagctgcctgcagtctgaagattttgcaacttattactgtcaacagtattatagttaccctcccacagtgttacacacccaaacaaaaacccccagggaagcaaatgtgtgaggctgggctgccccagctgctcctcctgatgcctccatcgcctgagagtgttcctcagatgcaaccacactctgatggtgttggtagagggggacctgaaatcacctctgcaacccaattcctttttctttgtaagccccagctgcacagacataacaatgcctctcctgatttaataaaggcagagatcttgacacctaaggagtctagtttagggctttggttggaattcaaataacagagaagaaaccactatagatattctaagcaggaattgtcttaatacagaaaattagagtctaaactactgaagtctaaataaaatgtagagcggaatctctaaatttcatgttttatttgcaaagaaatgtttgccaaattggacacacaggaaaactcagtggtcttcaatatattggaagtacgaagagaaggttagtgttttatgaaaaagggaaaatattaccttttgcattttcagaaagttcactggcactagtaagggttgggagctggcaagctcagactggtaagcagtggtggacaaagtgaattaggattcactaattatatcaattatatcaagttgtctcagaagttgcagttaaatgtgaattcaggttacaagaagccaaagcagtgaaggttgcagagaattttcttactaaaatgccaaggattcattgtacaccctgctgctcaccacgcagaaagccaatctctaaaacaagtattgccaagaaacaggctttaatcaggtactgcagccgaggagatgggacaccatttgcgaatgtatctccctgaccaactaaaattaagactttatataacagggacaaaatgtgggaaaacaggaatttgggaggggtaaggaagataatttggtcaacaggaagcaagaggtcagttatgcaatcataatgggtgaaggttctgatgtctcagtgtccggattcagtgatatgtatgtttcagctccttgatagtatctacgaggcctgatggttggtttactgaaaaaagaactcagataagacaaatgtaactatcttgagttttaagactgggggagtcaatttctgtttattcaaaaaaccataaaccttagttccatgggataacagggcctatttcaattgcattctagaaacaatattttacaccctgagtgcctttccccactgggtgtcttggctcttttgggtataacaagaatgaaccgatgcctatgattaacgttcagactacaacctttcaaagccaaggatatagtagtcaggaaagttgatattagaagcaggattgaatggcgctcactcagaaaacagaatgcatctgcccttgaagtatgggctatctaaccatgtggtcctcagtcctgtctggaagcttaggggtgggagtgttgatgttctcagcttcctgcagcatccttccaggtgtttctccagccctcacctctgttcctgtgtctgccttaggtaccaatggagaatattgagtcatccttttctgatttccaaatcttatgggaggacctcttgttgggcaactttataggacacaagagaggcaaaaagggatatttacataagttaaaatgattttcccccactgaggccattaaaatatatatatacttaaagctacatgttgaaaacacatccagctttattttcttattaatgcaaatttacatttgcaagtattttcagaattgtaaaagttgaaagcataattatttgtccatggaatgatcaaatacctctataattaaatggagtaaacattttcttcaaaatttgtactcattgaaataaaggaatatatttaaaatatgtgaagctatgttagaagttattggacttaaattcaactgtgcagtttgttttgggatgttgttcactcctgtgacctgccataagaatattgtgtcatgtgtagtcactgctgttcagcctcgtcctcagacaattcatatctgtaggctgaagatgagctcagtgccctgcagagaaaccactcagctgagccctttcttgatcagccagatgattgtgaacatgagcatccatgaacacgaaaacaaatgtttactgttatcagccactgagttgtggatttaaccagttaccaatcagtaatgcataaaagcttcctgatacagtatttacacctctacctacacacacgattttttcttaagttggtggtataaatgtgaacatttagtattaaattatgaagttattaagagaaaattaaagacaaaattaaaactagtattcaataaaaaattaaaatttaccttatttatggaaaatgtgcatatatgtatataagatacataaaagttacatatatttatctgataaaatgttggctacaaatatacatgtatagtatttatatttaagtatgtttattatatatgcatatttatacaattatttaaattaaatacatttaaataatttttgttatatgccactaaaaaagggtatgctggctacatatagttcatactcttgctacagaaaatttattttagcctttatttttaaaactctatgaaatgattgtccttatctaaaatatttttccaacccagtagagctccaagggtaggactagagtaaattttgactaatgttgaatattaaccattgcatcctatgaaagtctccattatgttcacacccacagtgatgatttgtcaaatagagttctcacaaatagatgctggatggcgtcacatcattgccattgtcaagaaatccctggaaatgtaaaaatcgtaacagtggttaatctgcaagggttacatctgatgataacattgcaaagagaacagcaatgtaataatattggctgttgcttttgacagatcatcagcccttaaaagaaatgcaacaggatgattgcagacaaagtggttcaggaagaactatgactagacgtttcaaaaatgagccaaaataaaaacatgctttccaagcgaatattaatcgaaatgccgttaatgagtaggaggcttttaataatgaggatgattcaacagatggacttcagtcaatcacctttcccaggtttccaaggtgtctcctgaaccaaggttatggaggtccctgtggggactcaataatatgagtttcaactaactgagacatacagggctactggctcttctgaacacctaatttgtcaagaagaatgacgtctcttgaacccctaacattgcgccacacatcagggctcagactaacagctggtgtcgggtgatactagtagacctcatgtaacgtgaggagggcactggttattttcctatatatgaatttgccttcctttttggttatatttctgcataaaatattatttgaggattttccaagagctttcatcagagtcaggaagttcttctgtaatatagctttggatcaagcaacttattaacctcaaaaaaagtgaagtgaagtgtagctcatgctcttgtcatgtgctttccctatagacagagaaaaacccattattagtcaagcaaagctggcacacaaacccttgtgctattgaattgctgtcctgtcagatatggtggaggctctgaaacagtaactgtatgaatggtgctgtcactcccataaacagaatatttatatcttgaaaatgagctgtagactcatcattgttatgccaaatgaacagcttgaaatactctatttctatttattcagggctgtggttttttggttgacggctcttaatccaaagagttgatgtgaaattattccatgaaattggaagaaatgatatgataagcatgtgaccatttacatttattaaaatactggataaattgtcaagacagggcattagcgtgtgtgctggggccatagatagagtccataaaagcaagagcaaacataattgattttacatattttagagaggaagtacagaaaatatggaacctaggggaccttctggaatgtttctatttattgccatttccactggtaaaactcagagaagatttcaaccgtcatcaggacgaagttctagggatcacagtcatgtgaagcattccctgtacttggatcaccagtgaggcaaagagaagatgaaacgcatagtgggatatggaggtgtaaacaccagggacagcatcctggtcagcttaaacatggagaagtgtagttattttttctctataggtttatcactgaatcagttggatctgagaaaagtcattatgactggttaggcagaaaggtgtttattatcatgaatgaaatggattgaaaacatttggggaaaccagagtggcagctcaggcaactccaagtactccttttgctattacttgaccctccccgcccccacccctatgttttccacagtcaagaaagatactttcattttgatagaaacatggcaagtgatgatattgtgcccagaggactgtgttgcctggctgtgacctagaccaagaaaatgatcacatttgagtgagttcagccatttcccctccctcatctcaatccaaaagcactccgtagtaacacagctgatgggcattcttcaccacatctgggacttaggaagccaaggacatgaggagtagcctttccagactctaccatagagaaagtattgccagaaactagagaataaaataaatatgaaagaagctggtgacaataacgaaatgagtcatgcatatatgcatgttaaataatttaatcttttctttacacccttttgttaaaagaattcgaagtgctatttttaccagtctttatagtttagcccacaaattaataataagtagacagattaacggctcatgagagaagagccttttttcctacatggtgttgggctgaacagattggactttccccacattctggggagcacaatgctacgtggggagcatgatgttctttgtaaaggaaatctttatgtgaggttctagcatgttgctgttgatactagtaatgactagaaattcgagtgtagaaagatgtgtatttatgatagaaagccacagggtggacttgggcagaaatagcccctgaatccatgaaaacagatgaatctacatgagactgaaatgaagatgtaatcaacacaggcaggtctgcagagaaaggggtcaggtctctagtagttgatagcggagcagctgtccttcggggggcagtagtgagaagagctgctctctttcctgcaggagacagcttgaatgtggagtctcaggcagcaggagctcctccccaacctgcgccagcagtgccattcttggaattgttccagaggctttgcctggagcctgttgcttaaggcttttcaacaatttctaaggaatttaatatcctctagtaaatccctttatgcttcacggatttgacatttgtaacagggaatataaacagcttacagtgacatcattcagagcctccttttttcttgctaaatataatgctttccaggtggacttgccagaggaagctgatgtgaacaacaatccatgtcaccaaaaatgcaagacaaataagctcagaaaagccactgggttctcacctagcttcactgtcccctaggacaaaatgggagagtgtaacactcttagctccaccatcagagagagaaggtgaagtgtgacattctcagcgtagtaagtgaatatttacagacatttaaatactaacacctttaacaccaaaatacaggcaaaagaagaaaaaattaaattggactacataaaaatttaaaatgggcatcaagagataaaacctacacagtgaaaatgcaacatgtggaatagaagaaaatatttgaaaatcatatctgataaggggttaataatatctactatacaaaaataagttctacatgtgaacagtaaaaataaaataactggttaaaaatgagaaaagtatatgaatagacatttccctaaagaagatactttagagatatttagataactagcataggaaacgatgctcaatattattaatccttagaaaaataaaaacaaaacccacctgatgcctgttagaatgtttttttccaacagaggatgaccagtcttggtgagaatttagggaactggaactcctgtggacactgtcgtggtgatgtaaatggcccacctgctgtgggaaacaagatggcaattcctcaaaggattaaaaatagaaatactatataattcagcaattccacttttggacatatacccaagtaatggaagacattaaattgaggagatatttgtatatccacatacagaagcaaattattcacagtagctaaatgtagaagcaactcaaatgttcacaaaggagggaactggtaatccaaatgtggtatatacatactattccatattatttagttttaaaaagggaaattctgacacatgctacaacatggatggaactagaggacattacactaagtgaaataacccagtctcaaaaatactgagttttgatttcactgtggtatttgcagaacagtttccatttagtcatgaatcaacccagtctccttccttttcttgattgtagttttcaggaataactgtagaatgttctggaactgtaacattctgagatagggcatgattggccagaacagcctgggttctgtttctgtccctactagaaacaggaattccttcaacactccagcccagtgtgtcatgtgattctaagacataaaacccagggtaggctgcattccagggtccctcagctgcagtccttgtggggtaggcacagtctagtgtcaatcaggccccggcagctttgtgctctctctgactgactctctgtaggtagtaatccacttcatgttactcgttgtgcatgggaattgtgtcccagtagatttgggtaagttggtgaccagtacactgcaaaccttggcaaaattggtgcagtgagataatttgatttgagagaaccatggcttattggtgaagttggaggaacaatactctccagtacctggcccaggacagagacatcagcctggggatgccaggcctggacatgcagatggatgtttaataaggagggaggataaatgggacatggtgagaggcagtgtttgatgtggtggtgagacagcagaaacagtggagaagcaagacagcaagagacagcaagagatggcattttgtgagaagatggacatagcgatcagcaatgggcgagacagctattggagaagtggcaagtcagcgatcagtgagagagggcgagatcggcgctacagcgattaaagctacatagttgctaacattgcagagctgttaacactggccaaaggctgttttaagagccatcatctttcctgacaggcggtggagctgagcagttaggtaagtggccacagagccactgcttcatgcaggccagccgctccatgcaccagttcacccgtgggagttcaacccacccaagctggggagcctggagagatcttcacgcaggcctcatgttagagactgcttggcaccattttggctcctgcacacctgtaagtgtcccatctacccacctgccctatgtcagatggtccaggaaataaggcctttggctaaatagtccatttgaagtcccccatagcacacctgactacatcctcattgatctttctcttagtcatttctcctctaatgacattttatttatccatcagccattttatcttattttctgtcctgatatatgtgtttgctttgcagttttttctttgggtccctactaattatgtttgtgcaattgtttaaggcaggacacttggatgtaagaattctcctgttctgttgactctaagaagccagagtcacattgttctatggccccaaccaggcctttggggctcattgttggccaccccactgaggctccaggattttctgcactggtcagcccctggatactccagggtttcctggcatttggtgtgggacattcataggctgatactcgtgtactctgggttttcagcatttagtactgttggccactccctggaggctccagggtttttagcattgacattcatccgaggattgtggattggagcctcaccctatggaaatcttggtttgccttttcttgttttctgccctaaggttatcattttccataacagccttgtgttttccttctgtcactttatttacactttttcttctacactttacttaataaaaatacagctttaaggctgagcatggtggcccatgcctgtaatcccagcactttgggattacatgcctgtaatcccaaggtgggaggatcatttgaggtcaggagttcaagaccagcctggcaaacatagtaaaaccttgtctctactaaaaatacaaaaattagccaggcacagtggcatgtacctgtaaccctagcaactcaggaggctgaggcaggagaatggctgaaacctgggaggtggaggttgcagtgaaccaagatcacgctattgcactccagcctgggtgacaaagcgagactctatctcaaaaaaaagaaaaaaaaaaaaaaaaaaaaaaaacaagtaaaacaaaaaattttgcctgtgatacgataatgagtttcttttaaaacttctgagattagtgtcttagagatttaactgttgtattttgctgctttcagcttgttctccctttaaaaaggcctgggatcattgctgtctccttttcctttttcatcagctcctgtgacgttttcatctcaacactttgggaggctgagatgggcggatcacttaggccaggagttcgaaatcagccttgccaacatagcaaaaccatatctttactaatattacaaaattagctgggcatggtggtacatgcctgtaatcccagccactcaggaggctgaggcatgaaaatagcttgaaaactggaggcagaggttccagtgagcccagccaagattgtgccactgcactctagcctgggcaacagagcgagactccatctcaaaaaacaacaacaacaacaacaacaacaacaaaatgatcccccaagaatcaataataaccagaataaggagccattatcagatattctttattactcttaattactgttaggcttcaggaagccactagttgggtacagctgcccaggattaaacctgtttcttacaaggtcctacagccacaaaagggggacaccacaacctccatttataaaacagaaaacttaaggttgttgttttgcaaacacatggattaataacatggttccgtaggtggacctaggagcattaatttttccctctcttccaattataattttcttgtttaacatcctagtaaagtttatgtcttctaaatttcatgtaaagatgatacggtctgtcataagtcttccaacccattctgtcttctgaccccacaaatgaatgcatcgtgccattgggccccttagttcaggtaccaaagatttttactcctcaaaggctagggaaggcctgcccccataaagtcagcaggaagcacttacagaaaagggactctgctcttctgcagtccccttaagattaaggaggagtatctaatctctgagggagcaatgagataggaggtaggtgggactcaacccaggaccagattgaagactggctgacacaaggaagagacactggaagcacctgtccataacacatgcccaccagtgccatatcagtttaccattgccatggcaaaacctgaaagttactgcccattttctagctattcctgaataacccactcctttattagcatgtcattaaaagtggggataaatatgactgcaaaactgcccctacgctactgctcttggcacaatgcctatgtggtagctctgtttcacaagaacagacacaaagctgtaacactgccacctcagtaaagctgttttcttctaccaccagcttacgctgcattccttcctgagtgtagccaagaacctgccctgcaccacttttgtcaagttagttgacataaaattactcataatatcctctctttatttttttactcctgtaggctgtgtaatgacttcttcctttccatttatgacattgtgttttgtgtcatttttctttccctcttctttttttttgagacagattcttgttctgtcacccaggctggagtgcagtggtgcaatcttggctcactgcaacctccgactccccagttcatgccattctcctgcctcagcctcccgagtagctgggactccaccacgcccagctaatttttttgtatttttaatagagatggggtttcaccatgttagccaggatggttttgatctcctgacctcgtggtccacccgccttggcctcccaaatctttccctcttctttatacacccttcatcaagtagtcacaggtttcaattcagttctttcttggtggtagtatggctcatgaaaaaagctgattcttctgtgtttgaggccattcaccatgtttatatgtaatactgtaaaaagtcctgtgacataagcctctgcttcacaaactgaccgctgtcaaacatcatctccccaccaacagagaatttttttgttcctcactagtataattcacataggaggagaaatctcaagtttaaagtgtggatttgcactttaccacttggtgtattcaagaagatgaataatattaatacatcagtagggccaggcacagtggctcaatcctacaattccagcactttgggaggccgaggcaggcagatcacctgaggtcaggagtttgagaccagccgggccaacatggcaaaatcccgtctctactaaaaatatgaaaattagctgggtatgttggcacacacctgtaatcccagctacttgggagtctgaggcaggagaattgctttaaatggagagagggaggttgcagcgagccaagattgtgccactgcactccagcctgggtgacagagtgagattctatctccaaaaaaaaaatagtagttttgaattttaaacatctatttgacaagaaattcacagttctttctctcttaaataacgtaataattctttcagtaatgagcctggtttgatgcctctctccccaacatgatacaagtgtcacataaatctatgaaaaattcaatttccctgttcctacaacaactgtctgggatggaaaacttcttcccttgctctagtcctttcttctacacctagtttcacctaatctgtgactcaaaacaatacttgtcaggaaacattctggaaagagcaaaaggcttctaagaggtgtcagagattcctggaccaacatctgtccatctctagagggggttgtgagtatgaggaagagcagagcttgtaaatcttctccttgctttcactcccactgtatttcctaacaacggcaaccacagccacataatatcatagaacaagcatctactacttccaaggctttggtctcagtaaatcttctctacctctatcacagcatctagaaggtttgatactcatacaaatagtgctgtagctttcttttcataactggaaaagtgggcaagactcagtgtaatgcaggcattccttaagctagttatcattcagtttttagattgtcgttgcgcacatatacccagcatatgtctaatatacatgtaaaaatccatgaagcaagcgttatattagcttgtgttttctattgtattaaatttttctcttatatcgtcttctcctttttgtcattaaaaatctgttcaagtcagtctaaattaattattggatcataagtagataaaatcttttatttcataacacattgacccaatgaatatgtttctttgcaagacacaatcctcatttccaagacaacaagcctgaaaaaattatactggagcaagtctacaagaaatgatggtagcttttccttattgtcagtcctggggcaagaataacataaaagataacaaggtagaataaagattacataagaaagaaggacagcaacaggacatggggaccgtttatagggtaacatttaaataatggatgatgagaagtaatgcgttagacagggatggatgggaatgatggaaggtctgagtactttagcacagattaagatcaaatcattaggattttaagagttgtgtacagttactgaagaaaatgccttagaatttaatttgactgtggataaaacattcttggattagatttaagactattttccatgctaagtatatttataatgatgatgactgtagtgctgaatatttaaacaatgaaaacaaaattaattgccacatacataatgtcctgaatactattgtaaatgttttatcttattttctttaaactgtctacagcactgtaaggcaggtaccactattgtcacagttacacagatatggaaaccgagacacagggaagttaagttacttgattaatttcaagcaatcggcaagccatggagcatctatgtcagggctgccaggacatgtgactgtaaacagaagtttttaactcaaagagggtatgtgtctgggttaatggaaagcttcaggaccctcagaaaacattactaataagcaaatgaaaggtgtatctgggccgggcgcggtggctcatgcctgtaatcccagcactttgggaggccaaggcgggtggatcaccaggtcaggagatcgagaccatcctggctaacatggtgaaaccccgtctctactaaaaatacaaaaaattagctgggcgtggtggcaggcgcttgtaatcccaggcacttgggaggctgaggcaggagaatggcatgaacccgggaggcagagcttgcagtgagtggagatcgcaccactgccctctagcctggaagacagagcgagactccgtctcagaaaaaaaaaaaaaaaatgtctatctggaagattaagttctaacagactcttcatttccatagatccaataatgcacttagggagatgactgggcatactgaggacaggaagagagaaatgaaaacacagccttttatattgttcttaacagacttgtgccaaatatcatacgggtgtatttaggtgattgaagagaagaaaggcacaggagtgaaattatgtgagcacaagggaggagttctacactcagactgagccaacagacttttctggcctgacaaccagggaggcacaggacgctcagtgcagagaggaagaagcaggtggtctctgcagctggaagctcagctcccacccagctgctttgcatgtccctcccagctgccctaccttccagagcccatatcaatgcctgggtcagagccctgggaaggaactgctcagttaggacccagacggaaccatggaagccccagctcagcttctcttcctcctgctactctggctcccaggtgaggggaacatgaggtggttttgcacatcagtgaaaactcctgccacctctgctcagcaagaaatataattaaaattcaatgtagatcaacaattttggctctactcaaagacagctggtttgatctagattacatgagtgcatttctgttttatttccaatcttggataccaccagagaaattgtaatgacacagtctccacccaccctgtctttgtctccaggggaaagagtcaccctctcctgcagggccagtcagagtgttagcagcagctacttaacctggtatcagcagaaacctggccaggcgcccaggctcctcatctatggtgcatccaccagggccactagcatcccagccaggttcagtggcagtgggtctgggacagacttcactctcaccatcagcagcctgcagcctgaagattttgcagtttattactgtcagcaggattataacttacctcccacagtgattcaacatgaaacaaaaacctcaacaagaccatcagtgtttactagattttaccagctgcttcctttacagacagctaatgtggtggccactcagttttagcgtctctgctctatttggacattttgcagttctaaaaaaaaatcattgaacaatttggactttgattcttggactctgttcaactgaggcaccagaatcccaggtttccagaaatagtgactcactgtatgaatccttatatagcctcagtggttcttaactttcccagtagaggtagctcagtgcatgctacactgctccatttgaattttgcaacattctaagtagtagaaaattctatttatttatccaaatagttgactcggtaaaagctgttcatgtgaagatactaccatggctgaataaatcccattctttttctttcttcaggctatcaacatttcagtggcaaatggttattatggaaacatttgccatttaaaagttaactaaattatttcttcaattttctctgtgatgcagtagactgtaaaaagattaaagtttgttaaaataaagtacatattcgataaggaagaaatagattattcctaatgacgtctgcaatgacctagtagaaagagtgatagaagcagttgttttcattatttttgtccaaaacttccttccaaatgggatttcattgatcatattcgtttattaccacctataagacatgttgacattatgtaacatctgatgtgaagcactgaggatacatcctgtctgtattattcttgccaaaaattaatggtgtgaattgaatcagtagtaaacaccatatacaaacccaactaggaggacattcttcaacatacctggacagtaaacttcaaatgtttgaaggccatgaaagagaaacaaaagtgaaaaactatcacagatttaaagatattgaggacaggataaccaaataaaatacagaaacctgaattttatcttgtaacataaaaaaagtcatcaacaggaaaaatcagtgaaatccatatggtattttaaatgagttaacaaataacattatatctatgttcatttcatggttgtgatacttatactgtggttatttatgatgctgacattagagcaagctgaaagaggcgcatatgggaatcatttttaccatatttttcaaattttaggtctaaaagtatttccacataaacttaaaacacacacacaagtaactaaaaaataagaaaaaggtagtttttaaacaattccacaagtttcctcctattttgcactttcctatttctttctttcttttttttttttttttcagatggaatcttgctctatcacccaggctggagtgcagtggtatgatgatctcggctcactgcaacctctgcctcccaggttcacgccattctcctgcctcagcctcccaagtggctgggactacaggcacccgccaccacgcctgactaatttttttgtatttttttagtagagacggggtttcaccatgttagccaggatggtctcgatctcctgacctcgtgatccacccgtctcagcctcccaaagtgctgggattataggcatgagccaccgcacccagctaccttttcctatttctaattcttatctctattaaagacaatcatagctcccattatgtagagtgtaatcactaatttgctcagttctagaatacaaagaaggcatcttaaaaattgactgtgcatttcttcatgaatgtgaaatccagggaccaggattctctattttttaagtccttggtttctctttaaactgagggtgaagagttcaagttctcaagtccaaaattacttatgttagtaaataacctcattccatttcagcatggctattatgttcatttaaatgcattttagaaggcatctctgtttatggcatcacaaagagtttaataaatcttctgtgcaaaaataaataacaaacacacatataaagctaaaatatcaaaactatttcagcactctgaaaattggtgaagcataaaataattaaagatgtatattctttatagaaaaaaaagtactagtgctttgagtaaggacagaaaaagtctgtagccttttgcctgtgacagcacccttctacccccagctcagtcagcatgaaatacagaactggagttttaccaatatgaggatagcaaataaagctagcagcttgctgccaaagcgggtgaacttgagtaaagccaaggaatgaagtaaaattcttcagtgtttccagctaaacatgcagaactccatagggaatgaacagaaaaagcccacagctttgttagtcaaagatgatgccctgtttggggcaagtagtacacctgctaacagtaaatagcagattcctgggtaagatagagccatattgctgaaacaatctctacacacattcctggtgacttagaagctatagatatgagtgatgagacccagaagtgcccggtgcaaagtaaaaccagagggaggtaagaactagctgcattttgcaggagctttttaaactacacacagatggattgacagaagatagatttataacctccagatatttgagcaaaacttcttctcaaatcattggtgaccactaagctgtgcagatacatgtgcagtttctataaattcaaactaaatattaagaataaaaagcagagatatcagtggtcaaacaccatatgagatatagatttttcaatatcatgcattgaaaatacatttaatatatgtaatccactagctcagcctattctatcctaaatgtgctcagtacacttacattagtttacagtagggcaacattatctaacacaaaccttatcttacaacaaagtgttgaatatctcatgcaatttattgaatactctattgaaagagaagatagaatagttgtataaatactagaagtactatttctacttgaatgcatatcactttcacaccatctgaaagtcaaaaaatgataactccaactatcataagtcaggtaccagaagtaagttctgacaagtaactaagaaaaaaattttaaaatgctcagaaaaatgaaaccagttccaggcctgacatggtagctcaagcctgtaatcccactactttagagcctgatgcagaaggattacatgaagccaggagttcaagaccaggctggccaaaatagtgacacccttatctctacaaatttttttttttaaatagcagagagtggtggcatgcacctatagtcccagctactcaggaggatgaagctggaggatcactggagcccaagaggttgacgctgcagcgagctatgatcacaccaccacactccagcctgggtgacagagtgagaccctgtttctaaaaaaattaaaattaaaataaaaaccccacaatctaaagagaggtactataatatattatcaaaagtgtgcagctttcagttttaaaaaatcctgaaaaaaaaacagaggagtatgatttatattgaaggaacaaagtaaagcaactacaataatgacaacagaaaatagccaatgaaagctgattctaacttgtcctcattattggctttagcaaagactacaaagcagttaatatgcagatgttcaaataattatttttaaaactatgatcattgacataaaaacgaaaatatttttaaaaagaagattcagcaagtaggacctcaagaaaagaaatggaaagtataaaaaatgaccaaatgggaactctagaaatgaaaagtaccataatacaatttaaatatttattagctaggtctaatagcaaattgagatgacagaacaatcagttaacttgaaaatagaggaatggaaatgtttgagcctaaagaaaatgtttagaaaaaaaggaagaaatgtcagagatttatagctcagagtgaaggataccaacaaatgtataatgagagtcacaaagaaggagagacagagaaagtggctgaaaaaatatttggagatacaatgacaaaaacttttcaaaagtaataaaaaatattcttagatgaaataattcaataaaacccttttagatagtcaatagaaattaataagtgaacacactatattaaaatgttgaaagacaaagaaaaaatcttcattgcatcagaataaaagcagacactatatacagagacacaacaacgtagccattggctaagttttcatcgggaccaatagaggctagaagcagtaaaatgacatatttaaatgctgaaaaggaaaaaaaagaaggcagccaggaaatctatccagtgaaaatatccttcaaatctaacaaaaaggcaaaaaaaaaaattttggtaaacaaaatacattcattcatagcagctatgtcttataaaacatttgagagaaaatccttcagaatcacaggaaatgacatcagacaggaccttgagtccactggaagaaatgaaggcctcaaaagtagtaaggaataataccaagactaaaaagataaaaatacacataatgctatttatatgaagtttaagacaggaaaacctaaatgattgtgtagatgtcagaaagacagttacttttgctgggtgggaagggtgacaactagcaaaggttgtccacgagggaagcacaagagaatgtgaaagcacagctccacctctggcccattcttttggaagagcccagattcatagggcaggtaacatctatggaagactcatgaatgacatgattgatgggtatttagcagaaaacaagttgtatgtatcacatactgttctatgcagagagtacaatacatgtgagtgagagagtccctctagcaaagaaaagaagtatgaactagaccttcagaatattagtttttagagttcatcagtttttagagtttttagagttcatcagaagaacacagatcaaggtgtcctctcatctgggcatgggaaagcaaactgactgcaggttctccctagatcagtggcccgtggctttggagacatgtacattaaactcacatttgttcacatccacagtcacttcctggctttaccataggaatgatggtctggctacccagttacttaggaactgtgcacacaggctgtcagttactaaaacaattaaaaacagtgactttgcttaaatatgtatcagtagttacattctgcagggaaaaatgagcagaggggatatattttaataccaaatgaaaaatcacaaccttgtgacttctttctctccccatataattcgttatgcttgtgctgaaacttcagagtatcaaatgagccccatatattcatccctaaatctttgtccttgtccaacctgagcccatgtttgggccatccactggcatccgagtacacttgtgagatgagcagtgtccagagggcattgctagggcgattcacaggcagctccatgcagtctctcccctcgaactcccagcatcactaaccctgaaggagtgtcctcctgtcctcctcagcacccagagcacagcctgccctgctgtgatttccctgcccagcttacaatctcagcatagattccactggctcaaagacaaagtcaggtcccaggcagagactgctgtgggggcctaagaaaaaccatcttttcatcaatttttctgttagaaatttgcagacattttcaccatattaaaaaattattttcattagtgctgatctaaatggttacagttagaccctcacagtgttatagctcagagcacaaacctcagcagctgttagtccagagaatcaggtggtctcagatgcttgctggctggtgcagccactgtttcaacaatgggaggaatgaagctgagtagacagatccagaccaggggccctctactcccgaccctagccctggacattgtgctctgcagggcccctcacaacctcactctctctttcccagaaccacattgttggcatctcacatggatcacagaatttaacacctgattgttttgtgaccatcttttctcaactctttatcttcaactaggtgactggtttattgaggagaggaatcgttttgtattccctacagaatgcagcctattgatggatgtaataagatcaactccatgaaaacccatgaaaaaactccatcaagtctcactggaaaccagcatctaaaattctataagatgttatgtcacaaacctgccattgggtggtatgtcacaaacctggccattggacaaaccccataataaacacaaaatagaagcctgatcttagaaatagtgaaattaagggtgatgttgtttcattatcagcaggcagcccccaaggcaggaatggggtctcatgtgtgacctggatcacctgggaggagctgccagtgtgctgagtggtgggaaaatgccctctgtgctctgagactggaagccttgccttgcccttcctactgccttggccatatcctcaaagtgcacctgctatgaactgaatggtgtttcacaaattcatattttgaatctccaacctccaatattactgcatttagacatagaggttatgaagaggtaattagggtgaaatgaggtgaaaacatcggggttctgatttaataggatttgtgtcctaataaaaagaaatatcattgagctgttactgaacccctcaccagcctccaagcgtgtactgagtaaagcatgcacttgcttctcttacacatgcctggcacattgctgaacacacatgaggatgtatccagagaggacatctggaaacaaacagggttctcaccagaaagcaaatccttctggactttgatcttgaaccttccatggttctaatatattcgcaataaatgtctaataaattagcaataaatgtctgtggttgaagccctccagctcagagtatgatggtgtggcattctcggcagacttatccactgttgccacgttctctgagcaggatcagccccaggagtcaccttgtggactttgggacccagcttttctccttttgctcctgctgtcctgactgcctggtgaggaaggggaagtcaggtttcagcctcagatagtttgtattaaacatgaactttccttgatgatgaatttgttagactgtttctccttctgatcagaatttcatcaagttggatgaaataaaagcttggtattaatatttgggaatctgcatgcttgttcccccacttggatgacagtgagcatgttatgtggatgccatcttcatcctcttccttgtctctcaggttagagggtcactgtcacctgcagggctggccagagtatgaagaacatcctagcctggcaccagcagaactggggcatggctctgagctcctgctggctcctactgccctcctggacatgatccctgcctgggtcagggataataatgggcctgaacagatgtcactctggccactaccaaccaagatgccttcagaggtaggtgatccctcttcctgtcccctatcatgtacaaatcttccctagcaacagctctacctgggggcccaggggttgctaagggtctgaaatcttctcaggggaacaggctgggggacacctctgaattcacattcccttttcatctcaaacccacttgccacctcttctatgaacatctctaatgtatcttgtggccatcactgcctgaagcatgtcagatgctttctcccacctccttctctgaattcatgatgaaaattcatcctcacttccacatgggctggccacaccttgtttctcttacatacatgccccggcacgttgctcaacccataattctgacccctctccatgaatctttgtgaaacggtcatggttggcaatttgtggttattggagaccagaaagtaaaatggtaactatcaagaagcttgtgcatggcactgacataggccattgttaacagggtcccagcagctggtcagtcatgaaagctgggcagagagatcccacatcaccccagtcagaggggaagctgggaatgagccatggaggggcttattcctctgaccatgcagcctctgagccatgtgtgctgctttgcttgacagaaatgaccagaaaaggacttgtctgtgctgagccctgtggacaaaacgtccctccattcagggtccaaattcactatccatctcctgggcatctgctgccctgtgattctgcagatccccctcaggtcactcatgatcctcagcaatgggtagctcactgctatcggcccagggggcacatggaagagagtcccgagctttatgaccctcaggccctggagtgaggaggggccatgaggtggtgcacccagtgcttgttttcaatgttcacgttcaatttattaaagtttaaaactataccttatactagcaatgaaacttgcatctctttatacataaacatgcatcacatatttatccacagatacatagtatatacaaatatataaatataacttatttctaaaatgtatgtatttaatatgtaaagtttatactagaaattcatattacaaatacacataattttatgtttatttttgtagcatgtgttccttttctttccaagcagaacagagtctggctgagtgaagaccttgaggacatttgctgaccctccctctttggctccagcagggtcccagtcattcaggacaagggaggacacagctgacagcagccagcccaggatcccagccccagccctaaggtctgtgtcctgagactttcactcttgccaggctggggggatatatgcttaatgcagctcccgcgaatttgtgagcagtttccctccctgaagaccctgccaggcagccctgcggccaaggcctgtggctcatcccaggttctcagccctgtggctcaggagaacagtggcttcctccacagaccagggccagggcctggaagcgctcaggcactgccagcctgaccttagctctgggctaaggaccctattccaaatgtctcctcatttatcgaagtacctgaaaatctgtctggttcttaaactcaaagtatgacttgagttgaggtatactcactccactgtctctaatgtagatttatagatgtgtagagagttttagaggatttttaacttttgtgacccagtgtaaacaaaacagtatctgagacaggtctcaatcaatgtataggtttattttgccaaagataaggcttatggcctgtgacacagctttaggaggccctgcaaatatgtgcccaaggtggctggattacacgttggttttatacattttagggagacacaaaaattacagggaaagacctaagtcagtacatataagatatacattagtttgtcctggaaaggtgggatatcttgaagcaggggcttccaggtcacaggtggcttcaaagttttcctgattggcaactggttgaaagagttaagctctgcctaaagagttgaattcatcataaagaaatccttgagtttagataagggggtgtggaagtcaaggttcttgtcacttagatgaaccttgcaggtaacagtaaagtagatggtgaatgttgcttatcagacctttaaagaaatgtccaactctttggaaaagacatagtaagaggaggagatgctctgcagaatgcaaatttcccccataacaggcagctttgcagggccacttcagaatacatcaaaaaaaatatttttagggtacaatatttagattttcttcagggcctattatctgtcatgttggagtatggtatcttattgctacaaagcatttgatttgtcagtctaaagatctctgttgtaatgataacactggtcagttttgtctgaactccaaagggaggagagtataatgagttacatctaaacccacctgccagtcatggcctaacctagtttttcagatttctttgacgttctctctgccaaaagagaagcccattgagtaggttggtggcttacaacttgattttttgttttaacacacagaaaaaaaatcacagcgtaaattcaatctaagatacattggtaaaaaaaaaaaaattaggtgcttcctgaatatttgtacatatcaaagaaagagaaatggtaagatttcagatgagaaatacccctcatacaaaagattaatgacttttcttttttactctctcagtttggatccaccagcaataaggattcctgttaggtagcaaatttatactgggaggaaaggaggaaagtgagggagggaacagaaaatgaatggtaaaagacacatcaacaacctacctgactcaggataactgaagatcaaccacatggtctgctttctccgctttcaagatgatgcctggagcgttgagttcttcaaaggaaggaaggccatgtcttaacatgtcagaggagcaggagagagatctcagccctgtaattcctgtttatagtggcattaatgtattccgctagagggctccagcctcatgacctaaacacatcccaataggccccacctggcaaaaaccattacactgagaattaactttacaatagatggattctggaggacacagtcaaaccatagcactttcctaagagatacacattccaggccatctggccagcaatgcatccaggcagagttctctgcccaagatcataaagaacataagacatatatatggtcattggaaatgagtagaggtacagcaaaggggaaagccctagattacagatggggactgctacgttcatcatggtacagttaacccttgaataacttgggtttgaaatttgcagatacacttatattttgttctgtgtgtgtcacctgtaagcaaatgcttaataagtagtaaatatattttctctattttatggtttccttaataacatttttttctttagcatactttattggaataatagagtatataatatatataacattaaaaaacatgttaatcaactatttattttattgctaaggcttccaatcaaaagcaatctattagtacttaagttagggatgcaaaaattctacacaggtgcagcccatttagtctctgggtattaaaaagacctgtagctcttgataatggtggggctgttagtgccacatgcattgaagaagcacggcatcatctttgtgtatctgtagtaaattgtttgatcttatactggtaagaacaatggcataacaccattacctaatacttacaaatatatatagcatcatgtcaataaattttatttttaattttttagaaaggaacaatgttaaactcacagaaatgtttcaagtatagcacaattacccccttccctaaatggaatcttataacagtcttttgaagacctgagaatcgtaccatctaatatgtactgtgtttcctacaaacaagaatattctccaaaataatccccatacaccaatgaaatatattaccccattgactctcgaggaatattgtcaaaaaatatctttaaaatgtttctcataacaaaatagtccccagtagaaacacattctctgcagacaaatttgtgctaccctggtcttacctgggacacctggggacactgagccggtgctgagttactgagatgagccagccctgcagctgtgcccagcctgccccttcccctgctcatttgcatgttcccagagcacagtctcctgacctgaagacttattaacaggctgatcacaccctgtgcaggagtcagacccactcaggacacagcatggacatgagggtccccgctcagctcctggggctcctgctgctctggctcccaggtaaggatggagaacactggcagtttactcagcccagggtgctcagcacagcctggctattcagggaaattctcttactacatgattaattgtgtggaccatttgtttttgtgtttccaatctcaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcctgatctatgctgcatccagtttacaaagtggggtcccatcaaggttcagcggcagtggatctggcacagatttcactctcaccatcagcagcctgcagcctgaagattttgcaacttattactgtctacaagattacaattaccctcccacagtgttacacacccgaacagaaacccccagggaagcagatgtgtgagactgggctgccccagctgctcctcctgatgcctccattggctgagattgttcctcagatgcagccacactctgatggtgttggtagagggggacacgaagtcacctctgcaccctaattcttttctctttctcagccccaactgcacagttctagcaatgcctctcttgatttaataaagacagagatcatgacacctgaagagtctagtttatggcttcagttggaattcgtataacagagaagaagccactatagatatttgaagcagatatagtcttaatacagagaattagagtaaactactgaagtctaaataaaatgtagagatgaatctctaaatttaatgttttatttgcaaagaaatatttgccaaatggggcatacaggaaaactcagtggtcttcaatatgttggaagaacaaagagaaatttagcattttatgaaaaagggaaaatgttacctatggctcttttgagaaagctcattggcactaggaagggttgggagctggcaagctcagactggtaagcagtggtggacaaagtgaatcctagaattatatcaagttatctcagaagttttggataaatttgatttcaggttacaataaaccaaaacggtgaagcttgcagagaattttgttactgaaatgccagggattcggtgtagatcctgcagctcgtcacacagaaagccaatcactaagacaagtattttcaaggaacaggctttaatcaggtgctgcagctgaggagatgggatgccattctcaaatgtatctctctgaccaactgaaattaggggtttatataacaaggaagaaatgtggaaaaacaggagttagggagggttaagaaagataattgggtcaacaggaagcaggaggtcagttaggcaatcataatgggtgaagggtctgatgtctcactgtcccgattcagtgatatataagtttcagcaaattgatagtatctgggaggcctgatggttgctttcctgaaatttaaaaaaaaaaaaaaaaaaaaaagaaaggtaagataaatgttgctatcttgagttttaagactggaggagtcgatttctgtttattcaaaaaaccataaactttagttccatgggataatagggcctatttcaattgcattctagaaacagtatttttcaccctgagtgcctttccctcctggtttcttggctctgtcgggtatcacaagaatgaccgaattcctatgattaactttcccactatgacctttcaaagccaaggatatagtagtcaggaaagctgatattagaagcaggaatctctggtgctccctcagaaaacagaatgcatctgtccctgaagtaagggctttctaaccatgtggtcctcagtcctgtctggaagcttaggggtgggggtgctgatgctctcagcttcctacagcatcttttcaggtgtttctctagtcctcacctctgttcctgtgtctgccttaggtaccaatggagaatattgagtcatccttttctgattccaaatctcatgggaggacctcttattgggcaactctataggacacaagagaggtaaaaagggatagttacataagttaaaatgattttccccctttgaggtcatttcaaaaattatatttaaaagcacatgttgaaaacacatccagctttattttcttattaatgcaaatttacgtttgcaaatattttcaggattgtaaaggttgaaaacataattacttgtccatggaatgatcaaacacctctataattaattggagtaaacattttcttgaaaatttgtactcactgaaatcaaaaaatatatttaaaatgtgtgaagctatgttagaaattattggacttaaattcaactgtgcagttcggtttgggatgttgttcactcctgtgacctgtcacaagaatcttgtgtcacgtgtagtcactgctgttcagcctcgtcctcagaaaattggtatctgtaggctaaagacaagctcagtgccctgcggaggaatcaatcagctgagcccttccttaatcagccagatgattgtgaacatgagcatccatgaagatgaaaacaaatatttacagttatcagccactgagttgtatatttaaccgattatcaatcattaatgcataaaagcttactgatacagtatttacacctctgcctatatatagatacatgtgttttttcttaaattggtggtataaatgtgaacattaagtaatcaaattatgaagttattaagagaaaattaaagatgaaattaaaactaattagtatttcattaaaaaattaaaatttaccttatttatggaaaaatgtgcatatatataagatacatagaagttaatatatatttatttgataaaatgttggctataagtatatatagtattcatatttaattatgtttattctattatatatgcaatatatacaaatttacaaaattattatctaaattatatacatttaaataattttttcttgcatctgtaaaaaaatggtattctggaccacagatagttcatactcttgctaaagaaaatttctttttagcctttatttttaaaactttaccaaattgttgtccttacctaaaatatttttccaaaccagtagatctccaagggtaggactacagcagattttgactaatgttgaatattaatcattgcatcctatgaaagtctccattatgttcatgcccacaatgatgatattccaaatagagttctcacaacaatggatgctagatggcgtcacattagtgccattgtcaaggaatccctggaaatgtaaaaatcctaaccgtgggtaaactgcaaggcctacatctgatgatcacattgccacattgcaaagagaacagcaatttaataatattggttgttggttttgacagatcatcaggccttaaaagaaacacaacaggatgattgcagacaaagtcattttggaagagctatgactagatgtttcaaaaatgagccataatcgaaaaacatgctttctcagtgaatattaatccaaatgccattaatgagcagggggcttttcataatgaggatgattgaacacatggacttcagtcagtcacctttgcccactttcccaggtaacctcatgaaccactgttacggaggtccctgtggggactcaataatatgagtttcaactaactgagatgtacagggctactggctctcttgaacactaatttgccaagaaaattgacccttcctgagcccctaacattctaccacacatcagggctcatactaacagctgatgtcaggtgattcaagtgcacttcatgtaacatgaggagagcagtggttattatcctatatatgaattttcctttgtctttggttatgttactgcataaaatattatttgaggattttccaaatgccttcatcagagtcaggaagttcttccatactgtggctttggatcaagaaggtaattgacttcaaaaaaagtgaagtaaagtgtagctcatgatcctgtcatgtgcacaggtgcagctttccctatagaaaaaaaacccattattagtcaagcactgctggcacacaaacccttgtgctattgaattgctatgctgtcagatgtggcggagggtctacaacactcaccgtgaatgttgctcttactcccataaacagaatatttatatcttgtaaatgagctatagaatcatcattgttgtgcaaactgaacagcttgaaatactctatttctattttctcagggctgtggttttctggctgatggttcttaatccaaagatttgacatgacaattatctcattaaattggaagaaataatatgataaacatgtgcctatttagacttaatacaatactggataagttgtcaacgcagggcgttagggtgtgtgctggggacacagatgtagcccatataaagcaagagcaaatataattgattttacatattttagagaggaagtacagaaaatatggaccctaggggaccttctggaatctttctatttattgccatttccactggtaaaactcagagaagatttcaacagtcatgaggatgaagttctagggatcacagtcatatgaagcattccctgcacttggatctccagtgaggcaaagggaagacgaaatgcatagtgggatatggacatgtaaacaccagagacagcctcctggtcagcttaaacgttgaaaagtgtatttattttttctctttagttttatcacagaatcatttggatctaagaaaagcgattatggctggttaggcagaaaggtgtttattatcatgaatttaatggattgaaaacatttggggaaaccagagtggcagctcaggcaactccaagtactccttttcctattccttgacccttaccatccccatattttccacagtcaagaaagatactctcattttataggaacctggcaagtgaagatactgtgcccacaggactgtgctgcctggctgagacccagaccaggaaaatgagcacatttgagtgagatcaggcattttccctccctcatctcaatccaaaagcactctgtagtaacacatctgatgggcagtcagagaaaggggtcagatctctcgtagttgatagcagagcggctgtccttctgggggcagtagtgagaagagctgctctcttttctgcaggagacagcttgaatgttgtggagtctcaggcaggaggagctcctccccagcctgtgccagcagtgccattcttggaattgttctagaggctttgcctggagcctgttccttaaggcttttcaacaatttgcaaggaatttaatatcctctagtaaatccctttatgcttcacgaatttgacatttgcaacagggaatatacacagtccacagtgacatcattcactgcctccttttttcttgctaaatataatgctttccaggtggacctgccagaggaagccaatgtgaataacaatccatgtcaccaaaaatgcaagacaaataagctgggtaaagccactgggttctcacatagctgcactgtcccccggtacaaaatgggagagtgtaaaactcttagctccaccatcagagagatggtgcagtgtgaccttctcagcatagtaagtcagtatttatagacatttaaatactaacaactttaataccaaaatacaggcaaaagtagaaaagaagataaattggacttcataaaaatgtaaaatgggcatcaaaagacataatcaacacagtgaaaatgcaacatgtggaatagaagaaaacatttgtaaatcttatatttgataaggggttaataatatctactatacaaaaataagtcttatatgtgaaccttaaaataaaatacctgattaaaaatgaggaaagtacatgaatcgacatttctctaaagaagattctatagagataattagaaaactagcataggaaaacatggtcaacattattaatccttagaaaaataaaaacaaaacccacctcacacctattaggattttttttccaacagaaaatgaccagtcttggtgagaacttagggaactggaactcctgtggacactgtcgtggtgatgtaaatggcccacctgctgtgggaaaccagatggcaattcctcgaagaattaaaaatagaaatactatataattcagcaattccacttttggacatatacccaagtaactgaagacattaacttgaggatatatttgtatatccacattcagaaccgaattattcacaatagccaaaaggtagaagcaactcaaatgttcacaaaggagggaactggtaatccaaatgtggtatatacatacagtagcatattgtagctttaaaaaggcaaaattagctttaaaaagggaaattctgacacatgctacaacttggatgaaactagaggacattacactaagtgaaataagccagtcacaaaacgattactgagttatgatttcactacagtatttgcagaacaggttccattttgccttgaatgatcccagtctccttccctttcttgcttgtagttttcaggaataactgtagaagtttctggaaatgtaacattctgagataaagcaagactggccagaacacgattggccagatattgcaagattgactccatttctgtcctattagaggaatttcttcaacactctaggcaacaatgtggagaaaagttgaattgtgagtcatgcttggttaaacacaaatatcaagaatgggcgaggaaggcatgatattttataaaatagttttctttgggtgtttctgagctttttaagagtattttgaaatatactgtttttaatctttattccacatattccatgaatgtgctcaaaacttccccagcaggaccagcttaaaatatcaaaccttaaggaaaagaacattgtaattaatcatatttggaccttatattggatgcctgcctgagatcactcatcagctcccccttgcttctaaggactgaatcaccaaccaatccagcaatccccacctttcttcctcctgtgttttaatacaattaatcataactgtacactttacatgcaaactgtgtttattcaacatcataataatgcttgttacttttgtcaatatgtttccccatgtccaattaatcattttcaactgtaaaagtagtttagtatccttagttgaggtgattgcaccatatttattctaattaaaaaaagaagcatatagttgcttttaagggattttaacttaatgtcagagttttcagaactaataaatgctatcatttaaggtttagtgcatgtaagtaaataaaacaatttttgatcgcaaatactgatactcagtaggggaatgagccatgcacagaataataactacataatgaaatggaatagaatactttcagtgttgataaattgcataaaaatcagccaatggtatgtggtatctggaggttgaagttgctcatctatgttaatcggggaagatcttagggttgtgctgtagatgcatctgatcggtaaggaggccaccaagtgaccatacaacctgcaaagactacagaatcatcacgggaagggcaggggctgggagattcctgataaaccactgcgcattgaaaaatttatttttaccactttagtggtataaaacccaaacagtcctataataatcagatgccttctgtgtttttattttcttaagaaaataatttattgtaatatcttttatcaaacaccttgacctggatcacacctaggacatacaatgttcccttgctcagaagctggaagcccaagtctgcacccttattgctagttggcaggctccccaaagctcttccctgccactcaagccttcatcactgggtcctgtagggtgggatcaccgaaggcagaggcaacactggacactggacatggggctctggcttcaactgcgtgggctgcatgtgacagggttcatatgtcccatgggactgagaaagactattgattagggagcacagcattcacctcccacttgatcagacagcacctctctgctgggaagcctatggagagggacatgagtaatactaaggaagatctatgttctgtttccactgcagcttccaggagaaacactcagctccccagtcgctagcttcaatgtcagtgtcttcaagacagagagtttacatcattcacctggaggaagcagaatctgggttccaaagatccacctacgtgctctttccaccttgtccactccagcttggtgcaatggtcctgggatcatctttgcttaacatttagcagattggttgtcctgatgacattgctgtttattaccatctaaaacttccctgactcacatggccaacattagcagtacccagccacaaacatgtatattggaattaattaaaattaacaatatagttccttagttgttttcactacatttcaagtgttcaggagtcacatatgacatataacggctacacttgcaaagcatagatatagacattttcaccatcttaaaaattattttcattagtgctaatctaaatggttacagttagagactcacagtgttatagctcacagcacaaacctcagcagctattattccagagaatcaggtggtctcagatgcttcctggctggtgcagccactgtttcacgaatgggaggaatgaagctgggtagacagatccagaccaggggccctctactcgccaccctagccttgggcattatgtgctgcagggtatctcacaacctcaccttctgctttccagaatcacatcattggcatctcacatggatcacagaatctagcccctaattgttttgtgaccatcttttctgaacaccctttatcttcaactaggtgactggtttattgaggagaggaatcattttgtgttccctacagaatgcagcataatggtggatgtaataagatcaactccatgaaaacccatgaaaaaactccatcaagtctcactggaaaccagcatctaaaattctataagatgttatgtcacaaaccaaacattggaggttatgttacaaacctggccattggacaaactccataataaacataaaatagaagtctgatcttagaaatagtgaaaattaagggtgatattgttccattatcagcaggcagcccccaaggcgggaatggcgtctcatgtgtgacctggatcacctaagaggagctgccagtgtgctgagtggtgggaaaacgccttctgtgctctgagactggaagcctcgccttgcccttcctactgccttgggcatgtcctcaaagcacacctgctatgaactgaattgtgtttcacaaattcatattttgaatctccaacctgcaaaattactgtatttagacatagaggttatgaaggggtaattagggtgaaatgaagtgaaaaccttggggctctgatttaataggatttgtgtcctagtaaaaataaacatcatcgatctgttccttaacccctcaccagcctccaagcatgcactgaagaaagcatgtacttgcttctcctacttacacatgcccggcacattgctgaacacacgtgaggatgtatccaggggtgacatctgaaaacaagaagcagggttctcaccagaaagcaaatccttctggactttgatcttgaactttccagggttctaatacattcacaataaacgtttaataaattagcaataaatgtctatggctcaagccatccagctcagggtatgttggtgtgggagtcccagaagactcatccactgtcaccaccttctctaagcaggatcagtctcaggaggcaccttgtggactttgggacccagcttttctccttttgctcctgctgtcctgactgcctggtgaggaagggaaactcaggcttcagcctcagatagtttgtattaaacatgaactttccctgctgatgaagttgttagcctgtttttccttctgatcagaattgcaccaagttggaggaactacaaactcggtattaatatttggggatctgcatgtttgttcccccacttggatgacagtgagcatgttatgtggatgccatcgttgtcctcctccttgtgtctcaggggagagggtcactgtcacctgtagagctggccagagtatgaagaacatcctagcctggcactagcagaaccagggcctggctctgagctcctgctgccctcctggacatgatccctgcctgggtcagggacagtaggcctgaaaagatgtcattctggccaacagcaaccaagatgccatcacaggtaggtgctccctcctcctatccctgtcctgcacaaatcttccatagcaacagctctgcctggggtcccaggtgttgttaagggtctgatctcttttcaggtgaacagtctggagacacctgtaaattcacactccctctttttctcacacccccttcccacctcctctgtgggcgcttctagtgtatcttgtgggcatcactgcctggagcatgtcaggatgttttcttccacctcctactccgaattcatggtgaaaattcatcctcacttcagacatgggctggccacaccttgtttctcttatatacatgccctggcacattgctgaacccatagttccaaccccactccatcaatttttgtggaagggtcatggctggcaatttgtggttattggagaccagtaagtaaaatgacaactattgagaagtttgtgcgtgggacagatgtagaccactgtcaacagagtcccagcagctggtgagccatgaaagtggggcagagagatcccacatcaccccagtcagaggggaagctggcaatgactcatggaggtgcttcatcctgtgatcatgcagcctctgagctacatgtgctgttttgtttgacagaaatgaccagaagagtacttgtctatgctgagccctgtgatcaaaatgtccctccattcagggtccaaactatcaatcttctgggcatctgctgctctgtgattctgcagatccccctcaggtcactcatgatcctcagcaatgggtagttcactgctgtccatgccgggggacatggaagagggtcctgagctttatcacccttaggccctggagtgaggagggccatgaagtggtgcacccagtgctcattttcaatgttcgtgtttactttattaaagtttaaaactataccttatactagcaaccaaagttatatatctttatatataaacatgtaccacatatttatccataaatagacacatagtataggcaaatgtataagtacaacttatttctaaaatatatgtattcaatatgtaaaatttatattagaaattcttattacagatacacatgattttatgtttatttgtataccatgtgttcattttctttccaagcagaacagggtctggctgagtaaagactttgaggacattggccgaccctccatttttggctccagcagggtgccagtcattcaggacaagggagggcagagccgacagcagccagcccagaatcccagccccagccctaaggtctgggtctctgagactttcactcttgccaggctgcgggatatatgcttaatgcagctcctgtgaatttgtgagcagtttccttccctcaagcccctgccaggcagccctgtggccaaggcctgtggttgctcccaggtcctcagccctgtggctcaggagaactgctgcttccctcacagcccagggccagcgcctggaagctctcaggcactgccagtctgactttagccctagactaaggactctattccaaatgtctcctcaattattgcagtacctgaaacctgttcttaaactcaaagtccacatttccacaattgataaagctagcatttggcatctggaaaagtagaaatgtgaattaattgtcattctcagagcctggtctcttccagccccaccagataaagttgccccatgttctcttctctccacagaactttgcttagaattttagggaaatgtaaaatgcggtaaagctcttattgcctgcacagaaatcatcctcttctcctttggtgcttagggcaccagctctagcctgctgggcatggtgaggacagtgagcctctcccagcctgggacaggagcagggattaagggcacatgtgattagctccacaatgcaatgtcaggggggtgaaggaggggcagggactctgggaagaatttgatccttcctaagaagatggaaggtgaagagcttttcttcaccttgtaaaatcaatgactttattttagatttgggagctgggacacgtgtttcattgccctgactccttccacatctcctctttctcttacaatatctctgactctgtctgtccttctcagattgtgtcctgaaaatctaattttccctcgcaatatgaaaacaaactaacaaaaccctcttcctcctatcacatgttgtgagatctgaccccaaactctgtgatacccagatcgtataacagataatcatgagattttacccaggagattttctagctaaaaacgaattctcgtggtagctcttctctcggaaaaattttctctgtctcttgtcataactgacaccagaaaacaaggtggaaatatttccaagaacagaagacaagcacgcgctcagtgagctgaaagacatttcttccccttgcattagtttccaatgctgctgtttaaatcgccacagtcttattggcttcacacaacataaatgtattaccctgtagttctggaggtcagcattctcactgagctaatgttaaggtgtcagtagggctgcattccttctggaggctccagaggaaagaactgaatcctctgcttttatcttccaggtgctcccacatttctggctctatggccccttccctcctcaaaccacatccttccatattgtcccagctcctctctgcaagcctcctcctctattttaatgacctttgtgattatattggtttcatctggataaccaggttgcttattctcaaagtcgttaacttacacctgtcaagttcttcttttgctatgtaaggtagaatccttatgatagggctctgatgactggaggaccaccaccgttcttagtctcacgcgggtttgtttaaaaagaaacggacatgcgtggggttgttttaaggagcgaaaagtttaatacgcaagaaggaaggaagaagaaaacagctccaccgtacagagacagagagaggggagattagaactaagagaaaactccatgtgcggtggaaaagtggctgcttatatgaggaggctgaaggaggtggtgtctgatttgcatagggcttaggggattggttttaccaagcatgtcattcatgtagcttgagaaaaaactggccctcccaccctagtgttttaatatgcaaatgcagggtgccataaagttctacacacatggggatatgtgggggcagccatgttgtcaggcaaatgtcggggcaaggaagaagaccgtgggagctggacgccgtggctcacacctgtaatctcagcactttgggaggccaaggaaggtggatcatgaggtcaagagatggagaccatcctggccaatatggtgaaaccccgtctctactaaaaacacaaaaagtagctgggcgtggtggcatgtgcctgtaatcccagctactcaggagactgaggcagaagaatcgcttgaacccaggaggcagaggttgcagtcagccgagatcgttccactgcactccagcctgggcgacagagcgagactccatctcaaaaaaaaaaaaaaaaaaagaagaagaatgtgggaatctccatgtttggctggacccagtttctaatggccagtatttgtatatcaaagcttgccgcctgtaatcccagcactttgggaggccgaggcgggcagatcaggaggtgaggagatcgagaccatcctggctaacacagtgaaaccccgtctctactgaaaaatacaaaaaattagccggccgtggtggcgggcgcctgtagtcccagctacttgggaggctgaggcatgaggaaaccagagggcggagcttgcagtgagccgagatcgtgccactgcactccagcctgggctacagagcgagactccctctctaaaaaagaaaaaaaagcttgccggaccagctctaagagccagggctttcctgctaaacaagaaacatttctggagctgctttaaaagaaacaaaaccttcccaaggaccctgtttcctctctatatgcctaaaatagtttcttaataactcgtataacatgggttccagagacgaggatatggacatcttttggggtggggacattattcattccactgaccataaacatattccccaaaattgtccttctctagagtaaaatttaaaaaaatcacaaattatttttatgaagcaagagagctggacaaaatcttagactcaggttcctctaacttgtgagttttgactgttggagtgtgctcactccactgcctctaatgtagatttatggatgtgtagatagttttagaggatttttaaattttgtgacccagtgtaagcaaaacagtatctgagacaggtctcaatcaagttatagatttattttgccaaagataaggattatggcctgtgacacagccttagggggtcctgtaaacatgtgcccaaggtggttggattacacgttggttttatacattttagggagacacagaaattacaggcaaagacataaatcaatacatataagatatacattagtttgtactggaaaggtgggatatcttgaagcaggggcttccaggtcacaggtggcttcaaagttttcctgattggcaactggttgaaagagttaagctctgcctaaagagttgaattcaccataaagaaatgcttgagtttagataacggggtgtgcttgagtttagataagccaaggttcttttcgtgtagatgaatcctatgggtagcagaaaaagtagacgttgcttgtcagaccttaaaaaaaaaaagtcagacctttggaaaatgattagtaagcataggagattctctacagaatgcaaatttctcccacaacgcgcagctttgcagggccacttcagaatatttcagagaaataggttgggtgcggtggctcactcctgtaatctcagcactttgggaggccgaggtgggtagatcacgaggtcaggagatcgagaccatcctggctaacagggtgaaaccccatctctactaaaaatacaaaaaaaattagtcgggcatggtggtgggcacctgtagttccagctgcttggaaggctgaggcaggagaatggcatgaactcaggaggcggagcttgcagtgagccaagattgcgccactgctctccagcctgggcacagagcgcgactccatctcaaaaaaaaacaaaaaaaagaaaaagaaaaagaaatatttttagagtaaaatttttagattttcttcagggcctattatctgtcatgttggagtatggtatcttattgctacaagcatctgtttcctcagtccaaagatctctgttataatgataatgctggtcagttgtgcctgaactccaaagggaagagagcataatgagacacatccaaacccacctgccagtcatggcctaacctagtttttcagatttctttgaagttctctctgccaaaaggggagtccatttagctcgttggtggcttacaacttaatttttggttcacaaaacacacaggaaaaaaaatcaataaattcaatctaaaatagattggttaaaaaaaagtgttttctgaatattcctagatgtcaaagaaagagaagtgataagaattcagatgagaaatatccctcatacaaaagtacaatgattttttttttctgtcttattttgggtccaccagcaatgagtattcctgtttaggcagcaaatttacactgggagaaaaggaagaaagtgaggcaggagcagaagatgaatggtaaaagacacatcaaccacccacctgactcaggataactgaagatcaaccacatgtggaaacatggactaaattcctctgggctattccacctgagagatgagaaagctgggatatgtatatacctcatcttatcctcactgattgtgagctgtctctcctgttctctttcaagctgctataacaggttccttgtcgctgtgtaattcataaaaaacagaaatatattttctcacacttctggagtacggaaagtttgagatcaaggcatgggcaggttaaggtcagctttctctgctttcaagacgatgcctggggcattgagtccttcaatggaaggaaggccatgtcttatcaggacagaccagcagaagagagagaaagattccagccctataaaccctgtttatactggcattaatgtattccactagagggctccaccctcatgacctaaacacatcccaatagggcccacctggcaaaaaccatttcactgagaatgaactttacaacagatggattttggaggacacagtcaaaccatagcactttcctcagagatacacattccaggacatctggccagcaatgcatgtaggcagacctctctgcccaagatcataaagaacataagacatatatatggccattggaagtgagcagaggtacagcaaaggagaaagccctagactacagatggggactgctacattcatcatggtacagttaacccttgaataacttgggtttgaagtttgcagatacacttatattttcttctgtgtcacctgaaagcaagtacttaatcagtagtaaatatattttctcatttttatggttttcttaagaacatttttttctttaccatactttattggaagaatagagtataaaatatatataaaatgtaaaaaagtgtaatcaactatttattttatcactaaggcttccagtcaaaagtaagctattagtacttaagttagaaatgcaaaacttctacacaggttttcatctgcacctgtggtcagtgccccaacctccatgttgttcaggggtcaactgctcactcaatctgcagctgcatctctctgaaacaggatcttggcaggtggctgcaagtaaaggaatccagaaaataacatctcaaactatgctgcattggtatgatgattatgtaaagccaaaggcatttagaaagcagcaaatgcacaagaagtcttttcctaaatatcccttatctgcctaaaagcaaattctccagaagaaaaacaattgtcaaggaaattcttcctgggaaattttatatcagggaagattaacacaaaacatgaatcaaaaatagaagagactgcaagttgatgctttatccaggcaggctattgcctgttcttttgaggatgcatttcttttttcatctattctctccaggttgcctacacttcccaattccctcttccctagaaaggaaatatgaacaactggatctcattgagttatctgggtaatcaccccactatgatatcccaccgcactctaagtgaattttgtttgccttttctcttattcattattcttttgtcggttcattttcagcaaacatttagaggacaaatggaactttcttcctttcttccaatataagcaagttcccttaaaattcaggctgcttacaaagcagcagaaatgtttgtgcatgggctgcagcactgtgattttgctcccctagtcaggcatcagtaaaattttgtggagcccgaggctgcagcccactgatgctgatgtggttacatccacttcccctgctactgagtcaggctgggacgttcagggtacattagagatatgagatataatgaatgcaaatccatgtccagtttcatctggatccaactgatttctccatgtacatagacaattgcttgataagagattgagtatgtttttcctaaaggtgttaacagggaggctggtgtctgggtcaggatgatgtccccatgcactgataaaaagtataagaagaaagtgtcattgatggtgcatggcagggacatgctccgtgcagtggccaccctcactaagacagatgaactttgggaaataatacccaatggcagaaaagaaggtagactatgaaggtacccaaaacaagaataaggtgcacctcatttagtctctgggtattaaagagacctgcagttcttgatagtggtggatctgtgagtgctgcatgcatggagacaacacggtatcatctttgtatatctgtaataaattgcttgatctaatactagtaagaacaaaggcataacaccattacctaatacttacaaatatatagcatcatgccgatacattttatttttaattttttttagaaaggaacaatgttaaactcacagaaatgttgcaggtatagcacaattacccccttccctacccggaatcttatgagagtcttttgaagacttgagaatcctaccatctaacattttactatgtgtttcctacaaacaagaatattctcctaaataatcctgatacaccaatgaaatacattactctatcggctcctgaggaatatttaaaattctcaaaaaaatacctaaaaattgtttctcataataaaatagtccccagtagaaacacattctctgcagacaaatttgtgctaccctggtcttacctgggacacctggggacactgagctggtgctgagttactgagatgagccagctctgcagctgtgcccagcctgccccatcccctgctcatttgcatgttcccagagcacaacctcctgccctgaagccttattaataggctggtcacactttgtgcaggagtcagacccagtcaggacacagcatggacatgagggtccccgctcagctcctggggctcctgctgctctggctcccaggtaaggaaggagaacactaggaatttactcagcccagtgtgctcagtactgcctggttattcagggaagtcttcctataatatgatcaatagtatgaatatttgtgtttctatttccaatctcaggtgccaaatgtgacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattctcccacagtgttacacacccgaacataaacccccagggaagcagatgtgtgaggcagggctgccccagctgctcctcctgatgcctctatcagctgagagtggtcctcagatgcagccacactctgatggtgttggtagagggggacatggagtcacctctgcaccctaattcttttctctttctcagccccaactgcacagatctagcaatgcctctcctgatttaataaagacagagatcatgacacctgaagagtctagtttatggcttcagctggactttatataacagagaagaggccactatagatattcaaagcaggaattgtcttaatacagacaattagagtctaaactactgaagtctaaataaaatgtagagatgaatctctaaatttaatgttttacgtgcaaagaaatatttgccaaatggggcatacaggaaaactcagtggtcttcaatatgttggaagaacaaagagaaggttagagttttacgaaaaagggaacatgttacctatggctctttgagaaagttcatgggcactaggaagggttgggagctggcaagctcagactgggaagcagtggtggacaaagtgaatcctacagttatatcaagttatctcagaagttgtggataaatttgatttcaggttacaataagccaaaggcagtgaagcttgcagagaattttgttactgaaatgccagggattcagtgtagatcctgctgctcaccacacagaaaaacaatcactaagacaagtattgccaaggaacaggctttaatcaggtgctgcagccgaggagatgggacaccattctcaaatgtatctccctgaactactaaaatgaggggtatatatatcagggaagaaatgtgggaaaacaggaattagggaggggtaaggaagatgatttggtcaacaggaagcaggaggtcagttaggcaatcacaatgggtgaagagtctgatgtctcactgtcccgattcagtgatatgtaagtttcagctccttttgatagtatctggaggcctgatggttggtttcctgacaaaagaactcctcagataagaaaaatataactatcttgagtttttaagactggaggagtcaatttctatgttccttcaaaaaaccataaacattagttccatgggataatagggcctatttcaattacattcttcagacaatattttgcaccctgagtgtctttccctcctggtttcttggctctgttgggtatgacaagaatgacccaattcctacgattaactttcccactacaacctttcaaagccaaggatatagtagtcaggaaagttgatattagaagcaggaatctctgttgctccctcagaaaactgaatgcatcttcccctgaagtatgggctatctaaccatgtggtcctcagtcctgtctggaagcttaggggtgggggtgctgatgctctcagcttcctacagcatctttccaggtgtttctccagtcctcatctctgtccctgtgtctgtcctaggtaccaatggagaatattgagccatcctttcctgattccaaatctcatgggaggacctcttattgggccactctatagaacacaagagaggcaaaaaaggatattcatataagttaaaatgattttcccccaatgaggccattttaaaaaattatatttaaagccacatgttgaaaacacatccagctttattttcttattaatgcaaatttacatttgcaaatattttcaagattgtaaaggatgaaaacataattatttgtccatggaatgatcaaacacctctataattaaatggagtaaacattttcttgaaaatttgtactcactgaaataaaggaatatattttaaatatctgaagctatgttagaaattattggacttaaattcaactgtccagtttggtttgggatgttcactcctgtgacctgccacaagaatcttgtatcatgtgtagtcactggtgttcagcttagtcctcagacaattgatatctataggctgaagatgaggtctgtgtccttcagaggatccactcagctgagcccttccttgatcagtcagaggattgtgaacatgagcatccgtgaacatgaaaacaaatgtttactgttatcagtcactgagttgtgtatttaaccagttaccaatcagtaatgcataaaagcttcctgatacagtatttacacctctacctatatgtacacacatgtattttttcttaaattggtgatttaaatgtgaatatccagtaatcaaattatgaagttattaaaagaaaattaaagacaaaattaaaactaattagtatttcaataaaaaattaaaatttatcttacggaaaagtatgcatacatgtatataagatacatagaagtgaatatatatgtttttgataaaatgttggctacaaatatatatagtattcatatttaagtacatttattctatcatatatgcaatatatgcatatttataaaattcttatctgaattaaatacatttaaaattttttgtaaccttccataaaataatggtattctggaccacatgtagttcttactcttgctacagaaaatttttttgtttatttatttatttatatttatatttatattatgtttaaatttatgtatatttatattatatttatattatatttaaatttgtttatatttacatttatattatatttaaaataaatttatttatatttttccaactcaatggagctccaagggtaggactagaacaaattttgactaatgttgaatattaaacattgcatcctatgaaagtctccattctgttcatgcccacaatggtgatattccaaatagagttctcacaataatggatgctggatggcgtcacattagtgccattgtcaaggaagccctgcaaatgtaaaaatcataacaatgagtaaactgcaagggttatatctgatgatcacattgcaacgataacagttttggggtgatcagacccaacaccaggtcgtgggggtgacaaagtctggtggagtcaaagattgagaaaaagacagtttgagagagaaatgtgggcaccagggaccatcgtagtgtatggaggctaagaaggccctgagccctgggatcccatgctatttattggtaatccaacaaagaaacacgtggtaagaatgtggaggccaaaaggatgcattgcattaagcacatgatttacacctgtgatggtttagcatttgctctactacttgagataatggagagcaggttcttttaactcaagatacaatcgatccttggagagcaaagagaaaggagccagcaagtgtagacacactccagagccacgagtcctggattctatccaagtcacaagggattttatgccctgggcttagattatggtgcgtcagggtagccttccaccctttagcacagagcttggtgtactaaaggccacaaggggttttagaccctggaccccggacgtgttccaagactcttttacattacgtcagacatgcaagccctgcctcagcttctcccaacattcagcttttcccaacataacggcaatgtaataatattggctgttggttttgacagatcatcaggccttcaaagaaatgcaacaaaacgattgcagacaaagtgattgaaaagctatgactagacttttcaaagatgagccaaaataaaaaaaaaatgctttcccagtaaatattaatcaaaatgctattaatgagcaggggcttttaataatgaggatgattcaacacatggacttcagtcagtcacctttcccagctttaccagggagtctcatgaaccaatgttatggaggtccctttggggactcaattatgaatttcaactaactgagacttaaagggctactggctcttctgaacacctcatttgccaagaagaatgacccctcctgaacccctaacattgtacaacacatcagggatcagatgaacagctggggtcaggtgatactagtggacctcatgtaacatgaggagagcactggttattttcctatatatgaatttgcctttctttttggttgtatttctgcacaaatattatttgaggattttccaaatgctttcatcagagtcaggaaattattccataatacggttttggatcaagcaatgtatttacctcagaaaaagtgaaaaaagtgtagctcatgctcttgtcatgtgcacaggtgcagatttccctatagacaggggaaaaaaacattattagtcaggcacagctggcacacaaaccttgtgctgttgaattgctatgctgtcagatgtggtggaggctctgaaacactaaccatgattcgtgcttttactcccataaatagaatatttatatcttgaaaatgagctatagactcatcactgttatgccaactgaacagcttgaaatattctgtttctatttattcagggctgtggttatctggttgatggttcttaatccaaagagttgacatgacaattattccatgaaattggaagaaatgatatgataagcatgtgaccatttagacttaatacaatactggataagttgtcaacacagggctttagggtgtgtcctgggcacatagatgtagccaatataaagcaagagcaaatggaattgattttacttattttagagaagaagtacagaaaatatggaccctaggggaccttctggaatctttctatttattgccatttccactggtaaaactcagagaagatttcaacagtcatgaagatgaagttctagggatcacagtcacgtgaagcattccctgcacttggatctccagtgaggcaaagggaagatgaaatgcatagtgggatatggaggtataaacaccagagacagccacctggtcagcttaaacgttgaaaactgtatttattttttccctttagttttatcactgaatcagctggatctaagaaaagtgattatggctggttaggcagaaaggtgtttattatcatgaatgaaatggaatgaaaacatttggggaaaccagagtggcagctcaggcaagtccaaatactccttttgctatttcttgatcctctccctgccccgtgttttccacagtcaagaaggacactctcattttgatagaaacctggcgagtgaagatattgtgcccataggactgggctgcctggctgtgacccagaccaggaaattgagcacatttgagtgagatcaagcacgtcccctcccccatctcaatccaaaagcattctgtagtaacacagctgatgtgcattcttcaccacatctgggacttaggaagccaaggacatgaggagtagcatttccagactctaccatagagaaagtattgccagaaactacagaataaaataaatgtgaaagaagctggtgacaataactaaatgtgtcatgcatatatgtattttaaataatttaatattttctatataccctttctttaaaaaaattcaaagtgctatttttagccacctttacaatttaggccaaaaattaaacaataagtagacagattaatggctcatgagagaagaacattttttcctagatggtgttgggatgaacagattggagtttccccacattttggggagcacaatgctacatggggagcatgatgttctttgtaaaggaaatctttatgttgggttgtagcattttgctgttgatactagtaattcctggaaattcaagtgtagaaacgtgtatttatgatagaaaaccacagtgtggacttgggcagaaataacccctgtacccttgaaaacagatgaatctacatgagtctgacatgaagatataatcaacacaggcagggctgcagggaaaggggtcaggtctctagtagttgatagcagagctgctgtccttcagggggcagtagtgagaagagctgctctctttcctgcaggagacagcttgaatgtggagtctcaggcagcaggagctcctccccagcctgcgccagcagtgccattcttggaattgttctagaggctttgcctggagcctattccttcaggtttttcaacactttgcaaggaatttaatatcctctagtaaatccttttatgcttcatggatttgacacttgcaacagggaatatacacagttgacatcattcacagcctccttttttcttgctaaatataatgctttccaggtggacctgccagaggaggccaatgtgaacaacaatccttgtcgccaaaaatgcaagacaaataagcccgagaaagccactgtgttctcacctagctgcactgtgccctggtacaaaatgagagagtgtaaaattcttagctccaccatcagagagatggtctagagtgaccttctcagcatagtaagtcagtatttatagacatttgaatactaacacctttaataccataatacaggcaaaagtagaaaagaagataaattggactacataaaaatgtaaaatgggcatcaaaagacataaccaacacagtgaaaatgcaacatgtggaatagaagaaaatatttgtaaatcgtatatctgataaggggttaataatatctagtacataaaaataagtcctacatgtcaacattaaaataaaatacctgattaaaaacgagaaaagtatatgaatcgacatttctctggagaatattctttagagataattagataactagcataggaaaagatgcttaatattattaatccttagaaaaataaaaacaaaacccacctcacacctattaggatttttttttccaacagaaaatgaccagtcatggtgagaacttagggaactggaactcctgtggacactgtcgtggtgatgtaaatggcccacctgctgtgggaaaccagatggcaattcctcgaagaattaataatggaaatactatataatccagcaattccacttttggacatatacccaagtaattgaagacattaacttgaggagatatttgtatacccacattcagaaccgaattattcatagtagccaacaggtagagcaactcaaatgttcacaaaggagtgaactggtaatccaaatgtgatatatacatacaatagcatattatttagctttaaaaagggaaattctcacacatgctataacatggatgaatctagaggacattacgctaaatgaaataagccagtcacaaaaagattactgagctgtgatttcactatggtatttgcagaatagttttcattttgtcttgaatcaacccagtccccttccctttcttgattgtagttttctggaataactgtagaatgttctggaaatgtaacattctgagatagggcatgattggccagaacagcctgggttccgtttctgtccctactagaaacaggaattccttcaacactctagcccagtgtgtcatgtgattctaagacataaaacccagggtgggctgtattccagggtccctcagctgcagtccttgtggggtacacacagtctagtgtcaatcaggtccccgcagctttgtgctctctctggctgactctctgtaagtagtaatccacttcatgtaactggttgtgcatgggtgctgtgtgtcaccggatttgggtaagttggcaaccagtgcacagcaaaccttcttggcaaaattggtgcagtgagaaggtttgatttgagagaaccatggcttaatggtgaagatggaggaacaatactctccagtacctggcccagtacagagacatcagcctggtgatgcaagggctggacatgaagatggatgtttaatgaggagggaggataaatgtgacatggtgagaggcagcgtttgatgtgccagtgagtcagtggaaacagcggagaagcaagacagcaagagacagcaagagatggcattttgtgagaagatggacatagcgatcagcaatgggcaagacagctattggagaagtggcaagacagtgatcagtgagagagggtgtgatggggatcagcactacagcgagcaaagctacagagttgctaacattgcagagctgttaacactagccaaaggctgttttaagagccatcatctttcctgacaggcggtggagctgagcagttaggtaagtggccacagagccactgcttcatgcaggccagctgctgcatgcaccagttcacccacgggagctcaacccacccaagctggggggcctggagagatcttcacacaggccccacgttagacactgcttggcaccattttggctcctgcacacctgtaagtgtcccatctacccacctgccctatgtcagatgatccaggaaataaggcctttggctaaatagtccatttgaagtcccccatagcacacctgactacatcctcattgctccttctcttagtcatttctcctctaatgccattttatctatccattagccaatttatcttattttctaccctgatatatgtgtttgctttgcagttttttctttgggtccctactaattatgtttgtgcaattgtttaaggcaggacacttggatgtaagaattctcctgttctgttgactctaagaagccagagtcacattgttctgtggccccaaccaggcctttggggctcactgttggccaccccactgaggctccaggattttctgcactggtcagcccctggatactccagggtttcctggcatttggtgtgggacactcataggctgatacgcgggtactctgggttttcagcatttggtattttcggtcactccctggatgctccagggtttccagcattgacatttgtctgaggattgtggattggagactcaccctatgggaatcttggtttgccttttcttgttttcttccctaaagttatcattttccataacggccttgtgttttctttttgtcactttatttacactttttcttctacactttatttaataaaaatactgctttaaggccgggcatggtggctcacgcctgtaatcccaacactttgggaggccgaggtgggtagatcatttgaggtcaggagttcaagaccaacctagccaacactgtgaagtgttgtctctactaaaaatagactggacatagtgatgcatgcctgtaattccagctacttgggaggctgaggcatgagaattgcttaaacccaggaggcgaaggttgcagtgagccaagatggcacaactacactccagcctggtaaaagagtgacaccctgtatcaaaaaataataacaataaataaaaattttttaaaaaaagtagcgctttagtcatattttgttcactaacaaatgcttacaatttagtttcataatgtcttgctacctcttcttacaccttctatacaggaagtggaaatctgagatgagaacaatgatggcccagtcactttctagaaaatcgtctgcatattgaaactgggttttcttaagttattaatttgctacattattgaaaattatacaggccaggtgcagtggctcatgcctgtaatcccggcactttgggaggctgaggcgggtggaccatttgaggtcaggagtacaagaccagcctggccaacatggtaaaaccccatctctactaaaaatacaaaaattagctaggcacagtggtacgtacctgtaatcctagcaacttgggaggctgaggcaggagaatggctggaacccgggaggcagaacttgtggtgagccaagattgtgctattgcactgcagcctgagtgacagagtgagactatctcgaaaaacaaacaaacaaaaagtaaaacagaaaattttgcctttgatgcaataatgagtttcttttaaaacttctgagattagtgtcttagagattcaactgtggtgttttgctgctttcagcttattctccctttaaaaaggcctgagatcattgctgtctccttttgctccttcatcagctcctgtggctttttcacctccggttctgactgttgttgcggacttgatgctaaagtgttttgtcttaggcgtctctggaagcaatgttttcccccagtatagtattattctacgtacttggttttttaacatatataaccttatttggggccttacttttttatttttatacagctttaaaaatacatatattcttctttgagatggagtctcactctgtcacccaagctgcagtgcagtggtgcgacctcggctcactgcaacccctgcctcctgggttcaagggattctcctgcctcagcctcccgagtagctgggactacagacacatgccaccatgcccagctaattttttttatttttagtagagatggggtttcaccatgttagccaggatggcctgtatctcctgacctcatgatctgcctgcttaagggctaatgagtgcctgcccacctccatgctgtctggcctaaaatatttaattggctataaatgttttcattccaagctctgtggccaaaggaactaccaaagaaacctaaaaaaaatctaactcaagccatggtgggaaacagggagtcagacacaccttgctccacccctgtttgaaatgtaggccagattcaaaagggcttttaaaattatgaaaataaaatagtgcccttttccacaaaacaaaataatagctcctctgtttaaccaaaagacttagtcttatgaaaaacttaaaaagaaggaactggctgggtgcagtggctcacgcctataatctcagcactttgggagactgaggtgggtggatcacttgaggccaggagttcaaaaccagccttgccaacatagcaaaaccatatctctactaaaattacaaaaaattacctaggcatgggggtacatgcctgtaatcccagccactcagaaggctgaggcatgaaaatagcttgaaaccaggaggcagaggttgcagtgagcccagccgagattgtgtcactgcactccagcctgggcaacagagcgagactctgtcttaaaaaacaacaacaacaaaatgatcccccaagaatcaataataatcagaataaaggggcccttaccagatattcttaattattccaactactgttaggcttcaggaagccactagctgtccaggattaaacctgtttcttatgagatcctgcaggcacaaaaggtggacaccacaacctccatttataaaacctagaaaacttaaggctgttgttttgcaaacacatagattaacaacttggttctgtgggtggacataggagcattaatttttctctctcttccaattataattttcttgtttaacctcctagtaaagtttatatcttctaaatttcatgtaaaaatgatacggtccgtcataagtctttcaatccattctgtcttctgaccccacaaatgaaagcatcctgccactgggccccttagttcagataccaaagatttttactcttcaaatgctagggaaggcctgcccccataaagtcagaaggaagcactcacagaaaagggactctgctcttctgcagtccccttaagattaaggaggagtatctaatctccaaggggcaatgaggtaggaggtaggtgggactcaactctggaccagattgaagagtgggtgacacaaggaagagacactggaagcacctgtccataacacatgcccaccagtgccgtatcagtttaccattgccatggcaaaacctgaaagttactgcccattttctagttatttctgaataacccactccttaattagcacgtcattaaaagcagtgataaatatgactgcaaaactgccctatgctactgctcttggcacactgcctatggggtagctctgctccacaagagcagtcacagaggtgtaacactgccacctcagtaaagctgttttcttctaccaccagcttacgctgcattccttcctagtgaagccaagaacctgccctgcaccacttttgtcaagtcagttgacataaaattactcataatatcctctctttatttttttactcttataggctgtgtaatgactttctcctttccacttacaatattgtgttttgtgtcctttttctttccctcttctatacacccttcatcaagtagtcacaggcttcaattcacttctttcttggtggtaatatggctcatgagaaatgctgattcttctgggtatgaggacattcatgtttatatgcaatactgtaaaaagtactgtgacgtaagcctccacttcacaaactgaccactgtcaaacatcatctcccaaccaatagagaatttttttgttcctcactagtataatttacataggagtagaaatctcaagtttaaagtgtggatttgcactttaccatttggtgtattcaagaagatgaataatattaatacatcagcagggcctggtgcagtggctcaagcctgtaatcccaacactttgggaggctgaggcagacagatcacctgaggtcaggagtttcagaccagcctggccaatatggcaaaaccccgtctctactaaaaatacgaaaattagccaggtatgttggcctgcacctgtaatcccagctacttgggaggctgaggcaggagaattgcttcaatcagagagacagaggttgtggtgagccaagatcgtgccactgcactccatcccagatgacagagcgagactctatctcaaaaaaaaaaaaaaaaaaaaatcagtagctttgaattttaaacatctatttgacaagaaatttgtagttctttctctctaaaataatgtaatgattctttcaggaatgagcctggtttgatgcctctctccccaacatgatagaaatgtggcataaatctatgaaaaattccatttccctgttcctacaacaactatctgggatggaaaacttcttcccttgctctagtcctttcttctacacccagtttcacctaatctgtgactcaaaacaatacttgtcaggaaacattctggaaagagcaaaagacttctaagaggtgtcagagattcctgtaccaccatctgtccatctctagagggggttgtgagtatgaggaagagcagagcttgtcaatcttgctttcactcccactgtatttcctaacaacggcaaccacagcaacagccataacatcataggacaaatctctactacttccaaggcttttatctcagtaaatcttctttacctctatctcaggcagctaaaagttttgatactcatacaaatagtactgtagctttctgtttataattggaaaagtgggcaagactcagtgtaatgcaggcattccttaagctagttagcatccagtttttagattatcattgcacacatatacccagcatatgtctaatagatatgtaaaaatccatgaagcaagagttataatagcttgtgttttctgttgtattgtattttcctcttataccatcttctgctttttgtcattaaaaaaatctgttgaagtcagtctaaattattggatcataagtagataaaatcttttttttgataacacattgccccaatgaatatgtttctttgcaagacacagtccttatttccaagataacacactagaatgtcaagaatagtttcccttaaatcaacagaataataaattttgtcgtaatgtctgctcatccgcatgtaggcacagcttagtttagtctttacatagacgacactcctatataagaaaaacttaaagacggtatgttcctctgcttgctttctgaggatgccttactctgtaatggagtaattttcaataaattctctcttatcactgcactttccaactttccttgaatttcttcctgcatgaaatccaagaatcctctcttggagtttgaatcaaaatccccttttctggtaacaatatggtctattttagtaaattttttgaaaagattatgcaatctgctgtgctggtggagtgttctcgaagtgtcaattatgtccagatggttgattgtgctgtccaattcatctgcatctgcactggcctgagaggcaggactgcttgtgctacaggctgaacctgctgcagagccctttttttgccccgggtcccactcaaggctggctgactcgtgtatcagtcggtcagtgagccagtacagtattccaaggtacagaatttcttgcctctagaatccaaagaggcctaccaaggccttcctcccttcaaagacaacgacatgcattagatacaatggaatggaatatgcattcctcttcccgtgaactctaattttctccttgtttacgaagcacacattacagctagcttattcactggggcatcatttagtgccatttaatggcagctgtagagccaagtgcccagaaataccagctacagtgaaatacaagctgagggaaatcagccttgcaaccacagccaaataaccctggaactgtttcaagttcatcctgatacttagagacattctatcaatgagcaccagagttagtgagagctagttcctcctcagaattagctgggtggagccaagaagaaagcctattcaccacctaaagattgatacacatcttcatcatcacaatctccattgcatcagcaatgaagagtgacaggctgcagtcacagtgtcttccacattgattcatggtatttcagaatgtcacccttctaagccaggcaacaccaatattttattttggtttcatcaacacaaaagatattctgtgtcactttgcttacataagaagcccactcttcgaccccaactggatatttcttcactgcttcactcaccaggggatttgcatgttgtcccctagggaagaccttcccttgtgagtctgagataaaagctcagctctaaccttgccttgactgatcaggactcctcagttcaccttctcacagtgaggctccctgctcagctcctggggctgctaatgctctgggtccctggtaaggacagaagagaggagaatgggactggagggtgagctctgtggaatctgcagcctcccatttgttgttctgtctacatgtcagatgcagatttcttgtcctccagcaaagggaatttaatattcagacctgtaagaactaagaacgagccacaaggaaaaagaacttcactgtcgagaacttcaaaaacaaagaggccactttgtgcctttaattattggattatttttggatattggataaatgtagtgtatgaatctaatcaaacacaaaaaagtagcctaacgtatacaataaaactaaattataaaaatgtctcacattgtttgtatgtaaccttgtacttctcactgttattattttaggatccagtggggatattgtgatgacccagcatctgctctccctgcccatccctctgggagagccggcctccatctcctgcaggtctagtcagagcctcctgcatagtgatggaaacacctatttggattggtacctgcagaagccaggccagtctccacagcttcttatctacacaatttctaacaaattctatggagtcccaaacaagttcagtggcagcaggtcagggacaggtttcacacttaaattcagcaaagtggaggctgaggatgttggggtttattgctgtgaacagggtctgcaaggtcctcacacagtggtaaaaccctgaacacaaacctccctacttgggatggcccagccatccacaagtgtttgcacgtggactgtctgcatggcagattctgagttggcttcacaggtagatgttagatgactgcagggaataatttgcaggaagatccagactgttctggccccatcactgtaacagccttatttcacatggctcaagcagaagaatgaaggtgatcaaagtgctctctgagcaactagacatgacagaagagagagctacctggaaagtgcattctgatcctccctgtgtttcctgcatttgtcaatgagatttagtcagcataacagcaagaaaattgaggcctactcatggctacaaaggttgggtatatgttaggattagcaggttttgttatatttttaacacgataacgtttggtaatattcagaaattggtattttcccactttctaacttcctacctctccattagtggttataccaaacctccacttacatacctgtgattgcattctacacaagctatactcagggggagtgtgactcacagcaattagtgaaaatgtttagtttgcaaacatctaaatagactttgtcaattcatagtggagataacattttatcccaaaagtctttgatttgcctcaactgccttttgtgagagaaaaggagagctcttagaattgcaagtggattttgaaaataaaagtataagccatttggtgacaactgcagaggagagtgcccacaaatttcagctgtacaatactgatacttccagctggggtaaatcagccatccaaccacagccaggatgttactaggcagtccagaaacagttccagggcattttcacataacttttttttcatctttatacagtatctgagctagtgctttagttaggaggctctaaaatttgacattataattttcattacttctgctgtatgtacctccatctagtccttatgtcaatacaaccccaggacgcagtcaagtcaaattcatgagagccatatttaccctgttccaaattctggtttaaagatttgtatttgcttatcaaattgaagatatcagtgctatgagaatagatattcataaaacacctccctctccttcataaatgttaacattgggatacatttcataacatatttctcattaccccttcttttttgttgttgtcttctacaagttctggtggtagttgaattacagttatgaccaatactatgagtctgaatccaaggcaaattacttttaatggatcttgaaaacttagcattaatccagaaacaacgatgtcgctgttatttaggggcatacttaggattagctttattgaccagcaaatattcagttaattatttccatgggatcaacaaatttttccttttattttactctaaatagttaatttttgtgtaaccagatttcctaggataactggttagtataaattctcatagtttcaaatttctcctatggctgttaagattccagaatataagaaaggcaatcattctttgggttgagaaaattcctaatttgtgagggcaagaatacaaaataagagtaaaatttgactaaattagtttttagtaagttgttctaggttctagttttttgttaaactttataattttatcccacaactacttccaggagttcataagttattttattttatttctttttattttattactgatctttatttttctatttagcataaaaagtgttttagaagagcccagtatgagcatttctagaattacagaaagatgaggactgttgctgctcaaagaccactgaaacagtggattaccctcggctcctgcacaagaaagatcaagacggaggggaagtttacaactgtgagtcccctgctcccttaaggcagaaagtcaccatttccactttctgatgaagatattgtctcattattatctcattataactaagagtgaccaccaaacaattcattcacctattgcatcttactttatctaatgtttttgattgttgttcattggaaataaaacacagtagttaaaacacaattttggttgatttcagaaactagtgtaagggatttaatttggtcgattttttctgaagctcttaaaatttctgtatttaaagtttatgtaagtattttatagattcttgaaattatttaaaccggaagaaaaaacattgaatttgagaattccaggttcatagtctccatttttctgcaagtaaactatcttatctaaattaaaaatacaaaaaaattatttactttgtcatttccgtatatttatacaaattatttcaaagacagatgtacccacagtttaaaatgctattgtccttgattctatctctaaactcttcttgagttttccacttttcatttgtctggcaaatcaaattttcttacaaggtggaatagacaaatctcacattaaaaaaactgaaaattattaaacaagctctggcttttgagaaaaacttcttttcaagatagaggaccctgtcttcaagagtaagcctagagcagagatgttagaggcagttaaaaattttaaggtggggaatgctcaggtagacaatggaattattgtctcactttatccagttagtccatgggtgagctgggctcagcagaaagtttagcatttacagataaaaagccttcatcgccaacacatgattctcaaactcatttttatggttgggttgagtatctctgtaggattttttagtatttacttcaagtaaaaggaaagaaaagaatttaaacatttggatacaaattcatattaggtagatcaaaaatgggatcttgacaacccagagaagtcagacatgtaaacatactaacgtctcccagtgtttagagagaatatataaattcggaggataaacacatccacaaagcctgctctgaacctgtaaaacagaatggttagccatgaattttacttcttctgggtgacaatttatagttatttagaagagacaaccagctttcattacaagtgtcttgaagccaggaatccactctagacaatctgcatttggggaatatccctctgctagttgagatttttaaaaccattttattgagataattgacataccaaaaaattgtacatatttaatgtacacaatttcatgagtttgaaaattagtacacacccatgaatccatcaccacaatcaatgccataaggaacctccatttgggtatgggaaggaaccacacatctgggtatgtattctagtgcaaagcattataggtttggacagtttgggttgataaagtcaacagaacaaacattataggatgtgcaacagtgttatataaatgaatcaaagctctgtttactgccctcaaagttgtgtattgctaaactgcaggtttatttttaaactactatcatcaagttcaaattttacacaactaattatttcaaaaatagccctcaaattttattattattattattttgccatttagacactgcttgctttgcatatgccaggaaacctcacctgctgccaataaataaagtaagattcaggcaataaaacccccaaactgcaactgtcctcttgagctttctaacccagaggctctccatcatgctgctgtgtgacatcacctagacacataagcccctttctccagtgtccctttcctcaggtgttttcttgtttcccttcctttctgaatagcaacctggcaccttcacatctgcaaagactcctgctgtgaaggacttgtccctgtgagcccctcaaagtttcacccaataaatgtgtgtgctactgctactctgtggtcacctctttttccttgataagcccccaaatcccctacaaatagggtcaaactccaccctacgaacactgaatccagcttaatggacacaagcaattccacttccaagactcctctttcccaagtcatatatatatatatatatatatatatatatatatagagagagagagagagagagagagagagagagagaatatatataaggtatatatattacatgtatatatacatgtatacatgtaatatatatattattacacacacacatacatattatatatgtatatatattacatgtgcttttacacttatggacccccaaacaggatttggcaagaaagttgaactacaagaaaactgacctatataagtctgtcctcatgcagttgaatgtgaccaagattggagacacacagtggcctgcttcccacctagatctaaacataggctgttcttacaaactttatcaattcttatctttgtccagtgtggagtgatccactctagctgctgttgtcaacattttggcacggtatgttaacatacagaaaggggaggttcccatttagaattaagaatattatactcccagatagtataagaaaatttcaaagcctttttctgatgaaagaagaattcttacaaaagtttacatggtctggatacttaagggcaacagattttgagacaaaataaccaattacaaggcagactttttaaaggtttatcattaacttttactggcaatagcaatactctgaaattcaaaaaagattattttgtaagaataatatttttaataattgatttataataaaagaaaatatgacaaatctttcactgttactcattctcccacaattcaagttgctgtattagatagtggaaataactaattattttttaagaagttatgtttttcttgtttttttgttttttaatttttttagtatttattgatcattcttgggtgtttctcagagagggggatttggcagggtcataggacaatagtggagggaaggtcagcagataaacatgtgaacaaaggtctctggttttcctaggcagaggaccctgcggccttccacagtgtttgtgtccctgggtatttgagattagggagtggtgatgactcttaacgagcatgctgccttcaagcatctgtttaacaaagcacatcttgcaccgcccttaatcattttaaccctgagtggacacagcacatgtttcagagagcacggggttgggggtaaggttatagattaacagcatcccaaggcagaagaatttttcctagtacagaacaaaatggagtctctaatgtctacctccttccacacagacacagtaacaaaccgatctctccctcttctccccacatttcccccctttctattcgacaaaaccgccatcgtcatcatggccggttctcaatgagctgttcggtaggcctcccagacggggtggcagccgggcagaggggctcctcacttcccagatggggcggccgggcggaggcgccccccacctcccagactgggtggctgccgggcgggggctgccccccacctcccggacggggcggctggccgggcaggggaggaagttatgtttttaaagagctcatttttagagtagttttgggttcacagcaaaattgagaagaaagtgcagattctcgtatctttctctgacacaggcaaagcttccccagttatcaacatcccccaccatagtgaacctacattgacacaacattatcacccagagtttagattagggcttcttagtttacattagggttcacttatgatgtcatacatgttataggttttgaaaaatgtataataggaaatatccatctttgtagtatcagacataacagtttcactgccctaaaaattctctgttcacctcccccattcatcccccaccctcccaaatccctaactaccactgatcctttcactgtctctatgattttgtcttttacagaacatcatatagttgaaataatataatatgcagtcttctcagattgactttttcacttagtaatatgcatttaaatttcctccatgttctttcgtggtttgatagcttgtttatttaggctataaataatatcccattctctggatactcaattgtgttggatgcacaagaattaacattggattaaatcaattaatttttgactactgaatcagcctttcatacctagcataaatccaacttggcatactatactgtatagtgtttttttatacattgtcatagtcgatttgctaatactttttggaggatttttgcatctatgttcatgagaaatatttgtagttctattttcttgtaatgtctttgcctggttctgttagtagactagtatttccctcacagaatgacttaggaggtatgccctttgcttctatcttgtgaaatagatggagaatttgaagaatttcttcctcatatatttggtagaattcaccattgaatccatctgaatctggtgctttatttttaaaaaggttgttagttatttattcagtttattaaatatataaaatatatatagggcagtttatactgtctatttcttttagttagttttggtagattgcttctttcaaggacttcatccatttcatcaaagttatcaagtttggatcatagcattgtttataatagtcgtacagtatccttttaagcttcataggatctgtagtgatgtcccctctttcagttctgctgttagcaatgtgtgtgctttctgtgtttccttagcttggcttgaggcttatcaatgttatttgtatttttatagtattagcttttaatgtttttttttctgttgacttcctgctttcaatttttttgatatctgctctaatatttatttcctttcttctgcctaatttagatttaattttatcttctttttctactttcatacagtgaaagcttagattattgattttagatttttcttctttctaatttatacatttgataatataaatttccctctcagcacctctttcgctgtattccacaaatattgatgagtcatgtttttatttccatttagttcaaaatcttcttaaatttctcctgagatttcttctttaactcttttgttatttggaagtgtgctgtttaatctccacatatttgggtattgtctacattttggtattgatttgtattttaataccattgtggtttgagagaaggcactgaatgatttctatttttttaaaatacgttactgtgtgttttatgacctggcattaagtttatcacagagaatattccatgtgatcttgaaaaaatatgtgtttggacaaaatagtgtacacatggcaattatacatagttcattgatagtgttgttgagtttgactgtttttatgggttttcagcccgctggatctacccatttctgatagtgaagtgttaaagtctttaactgtaatcgtggactcagctgtaccttcttgtagttctatcagtttttgccacatttattttgacagtctgctgttaagctcgcatatgttaagcactgctttgtcttcttgaagaattggcccctttttcatatgtaatgctctttctgtccatgataaatttccttgctttgagatcttcttttccaaaattaatatagctacttgtgctttcttttgattaatattagcatggtatatctttctccattcatatacttttcaatctatatgtgctttaatattttaattaggtttcttatagacaccatatagttgaatcttcctttttgatacactctaataacatatcttttaatttgtacatttagacacttgatgctccaactaattatcaatgccttggattaatgtctaccacactttcactgttttcgatttattgtttggtgtgttttttttctatgtttatcttctacttgtttctgcttttttatggttttaatttagcatcttatgcgcttctattttctctcctttattagcatattagattttttaacctcttttagtgttgctctgaagttttcaatatacatttacaactaatccaagcctactttcaaatactcctataccatttcataggtcatgtgagtacctgataataacaaagtattcctaattttttccatttgttgcattattgtcattcatttcacttatatgtaagtataaataagtatgcatatatgtgcatacgtgtgtatttatatatgtaaatgtatacatcagcatgcataataatcacattactattattttgaaaaaaattatatcagttaagaataagaaaaatatgttccttaatttttccctcacttatttcttcttgatgctcttcttttatgtaaattcaaatttctgacctatactatattccttctctcaaaagaacttttctttttctatttattacaaagcatgtttactggcaacaaatttttctgaatttttgtttgtctgagaaagccatcatttatcatttccttttgaaggatgatttcatagaaaacagaatcctaggttggtggttttcttctctcaacacgacatacttcactctactctcctcttgcttgcattgaagtgaagaatgcttcctgtttcacagaagaagttggatgcaatatttatatttgctcctctacatgaaaggtttgtttctcttatgttcatgctctctctctctctctgtctccttttcaatactttttctttgtttttgacttcctatagtttaaaaattatatgctcaagtgttttttgtttttgtttgtttgtttgttttgcttatttgcttattttggcagttatactgcttggtgtttcctgatcttcttggatctgtggttcgatatctgacattaatttagaaaaattttcactcaatatggttttgtttaccacgcctccaccccgtcctcctcctttttcttcatgtccattaacccatttaccttttgcccaagaatacttgctggcagcacttgcagctacagtgtttacctcaaaaagaagaaggtgagaatgtggtcaacattccacaatgatactgtgattgaagtagacaacagaaatggagagaaaactaagaagtcatatgccactgtggactatagtgagaagatgggagcagtggactcagctgatttgatgctcacttcttcaaagggcacaagattcggtctaagaaattctttcaccaccttctaaacattacagtgctgaatgaacctctacaccctgttcaagaaggacaatcctgagcacacaattagccatataaacttcagactgacgttgattgaaaaaatgctcttaaagcatcacaggccagggcagcaaagtcttccaggtcatccttgctctgatgatgtcatacctcttcacctgtatggaagacctttccccaagagatatcaccaacatcaggggagcgaaatccaactggtcactgcaaagtttgctgcttgtgcaaagacgagcctagcaagacaatctgaagagaaacgtgatatttttgtgtggaatgtgatattccgctttatgttgttctgtgctttgaaatttaccacacaaaaaattattaaatactgattatcatatacatttctgttatattaggattagagacaagttctgtttagaaataattccaagaacggattttatattttatttcacattgaaaatcagtcagatttgcttcagcctcaaagagtgtgtttatgtaaaattatatgaatgctggcagcaaactgcacttttttttttttctaaagagaaaaagagttaaacaatgtaacaccttttgtatatgtctcacagttcttgggcctttggttttcagtctttattctcttttctcttcagttttggagatttctattaatatactctcaagatcagactttgtttttccagccatacccagtcctttctgttacagtgttctgtttagttttgttttttaatctctagcattttcttttttttgctttttcttgggatcttcatctttcagtttacattgctcctctattaaaaattacaacatccctgccatgtctggttccgaagcttgcttgttatcttcaaaccatgtctttttgccttttattatgccttataatttttacttgatagccagataaaatatattgggtgaagggaagtgctagaaataggcctttaataatatgggggtaaggtgtaggggaagagaaacattctatacttctatgcttagggttcagtgctttagtgagcttatgtctgtggactgtaaacatcacaagtgtctctttgcttctttctccacccatgtaggtgggactggatgctagtgctggatggagttgagtatttctctttccccagtcagttagataataataaaactgtatatagcacattaggctggttaaatagtttctccctagagcagagcttaagaacagagtgctctgacttcctccctatataattgtgtcatgatttttggtttaatcaacttactgttcttctattagtgagaaaactatagtcaccccaagaaacgtgaatcatatttaatatatgaaaaaaatttactatattgtgtatgctatagttctgtggttattattgtaggttctcaaacactggattacgtgttataaaaacatttttgtatttctgcttttacacttgatattgtataataaacagatcaattgtatgaaattaaccctttctttcaaaaattgcataatttttctgttttttttttttcaaggcagaagaatttttcttagtacagaacaaaatggagtcttctatgtctacttctttctacacagacacagtaacaatctgatctctctttcttttccccacatttcccccttctctattcgacaaaactgccatcatcatcatggcccgttctcaatgagctgttgggtacacctcccagacggggtggcggccgggcagaggcgccccccacctcccagacggggcggctggccgggcgggggctgccccccacctcccggacggggcagctgcagggcggagactctcctcacttcccagactgggcggctaccgggcggaggggctcctcacttagacggggcggccggtcagagacgctcctcacctcccagacggggtggcggcggggcagagacactcctcagttcccagacggggtcacggccgggcagaggagctctttacatctcagatggggcggcggggcagaggcgctccccacatcccagacaatgggcggccgagcagagactcctcacttcctagacaggatgacggccgggaagaggcgctcctcacttcccagactgggcggccaggcagagggggctcctcacatcccagatgatgggcggccaggcagagacgctcctcacttcctagacgtggtggcagccgggcagaggctgcaatctcggcactttgggaggccaaggcaggcggctgggaggtggaggttgtagccagccgagatcatgccactgcactccagcctgggcaacattgagcactgagtgagcgagactccggctgcaatcctggcacctcaggaggccgaggctggcagatcactcgtggtcaggagctggagaccagcccggccaacacggtgaaaccccgtctccaccaaaaaatacgaaaaccagtcaggcgtggcggcgcgcgcctgcaatcccaggcactaggcaggctgaggcaggagaatcaggcagggaggttgcagtgagccgagatggcggcagtacagtccagcctcggctgggcatcagagggacaccgtacagagagggagagcgagaggcagaggcagaggcagaggcagaggcagaggcagagaggcagagaggcagagaggcagagaggcagagaggcagaggcagagaggcagaggcagagaggcagaggggcagaggggcagaggggcagaggggcagaggcagaggcagccataatttttcataatatgaaaatagcacaatatatttagccatctcttactgataggcattcagatgtttccttagacaacacggagttattagttctataggcaattttcttagtagtaagtttgggccaacaagtgtacgtattttaaatttcactccaatagtgagcagagattacttaggaaacagtagaaatccacattgcaaccaccaaagtatggcttttcaatccctctccattcccaccagcagagggaggcataaggctttaagtttttttgccaatcatttgatagaaaaagggcaattcatttttttcaaggttttcaagtaataaagcttaagattttttttactttttattttttaactataacatagttataggttcacaggaagttgcaaagaaatatacagaagtctcatacatcttggcaacttcctccagtgttgacatctttcaaactatagtacaataccaaagacaggaaattaacattggtgtcatccatagaacttattcagttttcacaagttacgcacgcacacaatttttgtttgtttatgtgattgtgtttatgtgtgtgtagctcgatgtgaatgaatcatttatgtgaccttctataaccaccactgtaatcaagaaattcagctaaatcatcaccacacgactcctggtgttacccttttatagccgcactcaccttctctaccccatccttaacccttggcaaacaccacataaaagacatcatgcaataagtaccatttcgagattggcttatttcactggcgtaatacccttcaggctcatcaaagttgggtatatcaattgtttattgctttttatttctgaatgtattctataatacggattaccccagtttatttaactgtttacttactgaaagacatttgggtaatttccttgatttagctactataaataaagcttctgtgaacatttgtgtacaagtttctgtataataatgttttatttctctgagataattgctcaagagttcatttgctaaattacacaagtccactttcaatttattacatccctttaatagagattttttttcagatcaaaaacttcaatttagatgaggtccaatttattaatttttcattttatggattatttttctaatttaaatttgctttcttcatcattttgtgagatgtctttgatttttatagtttacttttatttttacatgtattgattttcttcagtgtataattttgtgtttgacattgatttaaaacttctacttagaaactttatattaggcttctgttgctttctttttatatttttttgtttcttttagaattcctttttcttctggcttataaatagtctctttaaatacaaagtcagatatatattcatataaattctttgttatagatttatcttttaatatttctgtatttaataaatatgtaattcacatatatgttatggtggggtgttttaacatatcttcacttaaacatattgacattctggtcattatgttattacattttatttcatatgccattttattaaattccataattaaaacacatcaattatccatgtatattgggtgcctattttctatcctttctataattatctgtaattttttttgcctttttttctgaactttatccctttactaagcttaccttatgtgtctttgactccatttatttctttgccttattacattttttctatgttaaaattactagttctgctttacttttttaatcctgtacctgtaaccagacacatttattttacctattattttcttgctatctcatccttgaaaataaatttaagtgtttttcttttttttttttttttggtgtgtcttctaaatttacaatcatttgctgcagaaaatacttttgttttactagagtacatcattttcagaagagttatctaatttattatttacttgctatgtatttttgtcagtcatatagccctctcccatggtatatttgtaattttcagtattatttcatttcaaattacttatccttgatggggttgctttacccaagtcttttatttgccaaaatatggtatagttcaatatttcttgattgctccaaacacatgtgggtgcattttattattaccttccctacctccaccccagatctgagtctgaggactgtatccttgcaggttgtgtgtagtagttatcacttggttgctggagaaagagtagaagacagaggatgggacagtgaacaacttaaagtggtcaagtttgtctctattttctagagccttcttaatgatcggtcatctaggtggcctaataaaaaaatgcaaatttcaccccttttacttcccacctctacttctgtcctcctccacccagagttgtaggagggggcaaagctcagggattgtcccaaccctaatcatggcacaaaagttccaagggttcagggggagtttttcaggacttttctcatggcatattggctcctctgaaatattttatctttcttctcaatccacaaattgatgcttgccctgttttccagagatatctactagacatctgaaaggttaaagtttgaaaacttcttaaatttcttgaaaatgttctttgttttttcaaggaatactcaaattccattattcctgctttcttctaggggaatagagctaggtaagcagaatttaatcatttaggaaaaacaagagggtatagtactttccactcaaactcaccacactaatctaagttcccgctcttcatctcctttgccctaaggtgtagctgtaattctcagctgttcattttcagctgtttataaaaatgtagatttaaggtgtagaaagaccattattttagttctacctagatcctttgggaagccactagtttattttagttgaaatcaaataaaataaaaatttaaaagcataaaaacaattcccagagtgataaaagaaaacttttagttaactagagctaatatgcatgttaacatcaatgaaaaatataactgagtaatcagggacccaagcgcacagttggaagcagtatagtgggacctctctggccctgaactccatcacaagtaacagaatagagtcctggagtggagctcatagagaagtgatggttggcatcatgttccctgacttttcatgttccttgtagccttgtgttggtgtctgcacatttgaagatgcagtcccttcttccagacattttaagttggttttgttgggggaaaaccttcacctatggatgggtgagagtgccagctgactggtgtggacaccatatcttgctgtaggagaagatggacttccttagccccagcttccagtggcaaggcagatggaaccagtgggagttgggggatggttattctccactctgaataggatccactacaatgactcttctgcctctgagggcctctggtggatacagcattggtttcaggactaagcagatggagagaccctgccttatccacaatgaggcaagttccttgattagtttaggttaccagtcttcatcaaggtttcatgctcacccccttcatcctttccagatcatgataacatttatagacttgttttaaataccacttactcagtggaacaaacttctccttcccatatgaaccagtttcataaaacccacccaacttgctttctctttctgacaatgataacttaaaatgcattattattgataatgatataaaatatgaattttgaaaaatcaaaagtatttctgaaataacttatatccaaatggcagggcagccccagtacactcctccacatggcatctcaagtagactggcaggcaaagatccaatagaaaaggtcaccaaatcccttgggacatgcttgagctaccctaggaaatgttttgttagccccaactcccactgggtgaaataagagcaggtgtcccctttgagcatcaactcaaacttttctgagctgatttgcatgttgggccattagacaacggtccaagcttctcagagcatccttaaagacagcttgtcagggcccctgaggagcagcctctagttcagctctcagagatagggtccggggctcctttgctgtggatcctcctgctctgggctccaagtgagggggtatagggaaacatcgggcaaactcatgtggccatcattgttttttgtgtctctggattcttggttgttggatttagggcactcattgtaggttgtaagttccccagttatcttttgttttctggttactcaagatgttgcatatgactgtggttacaagtgtcaccaatgcatggcctacatggggacagtctcagtatatctgatataatttatctgtctttatcatttcaggctgcaatggggacattgtgctgacccagtctccagcctccttggccgtgtctccaggacagagggccaccatcacctgcagagccagtgagagtgtcagtttcttgggaataaacttaattcactggtatcagcagaaaccaggacaacctcctaaactcctgatttaccaagcatccaataaagacactggggtcccagccaggttcagcggcagtgggtctgggaccgatttcaccctcacaattaatcctgtggaagctaatgatactgcaaattattactgtctgcagagtaagaattttcctcccacagtgctttaggtctaaacaaaaacctccccaggcagctgctccctgaggctcaaatccctcagatgtggctttttatgcaggtccatcagcctgctgtcataggcttgtttgaacaaaggggtcaaattatcaaagagaaaatccttaaattgatgtgtgtgtgtgtgtgtgcatgcatgtgtgtcacagccagttttataatttaataatttctttactgtatcaggacctctcagaagttttctacttctcaatgtatattttttatgtcaaagacccttaccaatagaagaattttaaacattaagaaaactttgtagtcattttaaaaaatgctctgaatagtcaaaattattagctctatatctttcagatataggtgaccttctcacctgaattttgacttttctccacttttatttgctgaacccacatgaaaaggcttttctagttatttagaaacctaagacttgtgaggtagttatctctgcttatttaatttagatgtctctatctcggtgactttcccaaaagttagattctcagctctagttttaataaattgtcctttactcttcatgcagtgttcatgtcctttttcttttctttttttttttttttaaacagagtctcactctgtcacccaggctggagggcaatggcacaatcttggctcacggcagtctccacctcccaggttgaagtgattctcctgcctcaatgtctcaagtagctgggattacaggtgcctgccaccacgcccagctaatttctgtatttttagtagagatggggtttcaccatgttggccagcctggtcacgaactcctgacctcatgatccacctgccttggcctcccaaagtgctgggattacaggtcatgtcctttttctatgatattttccatgtccattgttaaggttttttttctcatcttctctttttgcttttctaattgctctaacactacaggcagagtggactccagaaatgcaggtgtgcatagtcacaatcatggaaagattagtgattatgtgcccctccatccctaccttggcctccgtcagtcttctgcatcctccacaaagcaagcagagaaactctggcaaaataggcttttgcagcatttcagtctaataagatttacattggtttctaaatttgtaacccttgtaaccctatctcactacatataaaattttattattagttggctgttggcccatgcaaattatcacacacttagtggcttaaaataatacacgtttataattcacatgcagtttctatgagtcgggagcctgggcagagtttatctgggtcctctcttcaaggtctcacaggctgcagtcaaggtgttgaccaggctgcattctcatccagggacttaaagagtctgcttccatgatcattcaagttgttgacagaattgttttcatagtaactctaaggctgagggtcctggctttttgctggctgttggctggagatcaccctaagctcctagagaacatcttaagtttcctgccacatgggctactaataatcaaaccagctaggataatttcttggtaacaaggagagctcagttcctcttttaatggctttgacctgcttaagtcagatccactcacaataatctcccttatgattaactcaaacccaactgatttgggactactgcatctgcaaaatactttcacctttgcaatattgtgtatgctagaaggaagtcaaaaattctgcccagactcaagaagagggaattacacagttaggaacaccagtggttctgtatcatggggccaacctagggttgtccactaaaactgtcatattgcctaagtgttttgtttgtttttattctctttctctcaaatggcccctgtcctaaggggattaaataaggaagcttcctctggtaataggttctgaccagcatcagacaaacagattcctcaaaatggtgttttcatcccagcttctcatgtttctcctgttgcttcctgagtgacgaagtggtgaaggtttcatctatagagtggaagatttgaaataaataaataattttataaatattggcctgtaattacctgtatagtaaagaaagaaagaatatctaaaaaccaattgggtagtttctattttaagagactagaaaaagaagaaccagcgagattcacagcaagcagaaggaagaaaataattttaaaaatagagtataaatcaatgaagtaaaagacgaaaatcattgaaagcaaaagttgtgtttctggaaagattggcaaaattaaaaatctttatgactcttgaagaaaaaaagagaaggccaagattattaaaatcaggattgaaataaggggtacaactgcctatcctacagaaactttaaaaatactgtaagagaatatgatgaacaataataagtcattaaattaggcaatttagatgagataacccaaaactaattcaaaaacaaatagaaaatatgaatagaaccataacaagtgaagaaattaaaaagtttccaataaagaaaaactgagactacatggcgtcactggtgagttctatcaagaatttaaagaataaatattaccaatcttcattaaattctttcagtatacataggagaaaagaatacttcccaactcattctatgaagccagtgttaccccaataccaaagccaagcaaagacattccaaggaaagaaaaccatagaccaatatcccctactaatgcatgtgaaaaaattatcaaaagatataactaaatagaatccagtagcatatagaaatgattatgcaccataatacaaatgggattcattaaacaatgcaagatagattaacatctgaaaatcaataaagtaatatgccacatagagtaaatataaaaaatgtaatcatctcaataaacggagaaagatatttgataaaattcaaaactcttttatgacaaaagctctcaacaaacttgtaatagaaggaaacttcctttaccttataaaggatatatatgaaaaacttacagttaacatctacttaaagttgacagaatgccttctttctaatgtcataaacaagacaaggatattcactcttgctactcaattcaacactgcactggatgttcttgtcaagcaatcaagcaagaaaaaaatgaaaaataaagtatatcaatatttaaaagaagagtaaaagtattttaattacagaaaatataatcctgtatgtatattaaatgataaggaatacatgtcccccaccactacacatacaatctactagtaataaacaactttggcacagtcacacaataagatatgcaatatgcagaaataaattttatctccatgtacagttacattttgttatgtttcaacagatatctgtaaagtcacaaacgctgaattaacaaatattgaaccattggtcctagtggtagtactggtttatgttcctatgagcctatggtcacattttcattaactgatcaataggtaactttttgtatgagtatcttaaacagattatatatatctcataaagtcttaaatataggcatatacatataggcatacctgtagatttggttccagaccactgcaataaagcaaatatcacaataaagtgaatcacacaaacttttgggtttctgcatatatataaaagttatgtttatactatactgtagtctattaagtgtgcaatagcattacgttttaaaaacaatgtacatcatttaaaatacttcattactaaaaaatggtaataatcatctgagccttcagtgagtaatctttttgctggttgagaattttatctcaatgctgttggctactggctgattagggtggtggttgttgatagttggggagattgtggcaatttcttaaaataagacagcaataaagttttccgcattgattgaatcttcctttaattaaaggtttctctgtagcatgacatactttttgatagcactttacccatagtagtacttccttcaaaattggagtcaatcctcgagccctactgctgctttatcaactaaattttttttatactattataaatcctttgttgtcattgtaaccttgctcacagcatcttcacagcagtagattccatctcaagaaactattttatttgctcatccgtatgaagtaactcctcatccattaatgttttactgtcatattgcagcaattcagttacatcttcaagctccgcttcttttctttttctttatttcttcttaaaaatgggacacatgtgcagaacatgcaggtttgttacatagttatacttctaattctagttctcttttaattttacacatcttcatttacttactccactgaagtcttgaacccctcgaaatcatccatgagggttggaatcaacttttttcaaacttctgttaatactgatcttttggccagctcccatgaatcacaaattttcttaatggcatctaaaatagtgactcctttccagaaggtttttaatttacttcgcccagatctatcagaggaatcactatctacagcagttctagccttatgaaatgtattttttaagcaataaagcttggaagtcaaaattactctttgatgcatgagctgaagaattaatgttgtgttagcaggcatgaaaacaacattcatctccttgtgtatctccttcagagcccttcagtgactaggtgcattgtaaatcaatgagcagtaatatttgaaagaaatctttttttactgagcagtaggtctcaacaaatatttggtaaaccatgctctaaacggatgtgctgtcatctaggttttgtggttccatgtatacagcacaggaaaaatagacttagtataattcttaagggccctaggattttcagaatggtaaatgagcattggcttcgacttaacataggtcatcagctgcattatcttaataacagagtctgcctgtccttggaaacttttaagccaggaacctctctagctatgaaagtcttagatggcatcatcttccaacataagactgtttcatctacattgaaaatctgttgttaagtgtagccactttcattaatacttctagctagatcttctagataacttgctgcaggttctccatcagcactttgctgcttcaccttccacttgtatgtcatggagatggctttttttctttaaacatcatgaaccaacttctgctgcttcaaagttttcttccgcagcttcctcatctctttcagccttcataaattctatgagtttgggccttcctctggattaggctttggattaagggaatgttgtggctggtttgagcttctatccagatcactaaaactgtctccatatcagcaataaggctatgttgctttttagacatttgtgatgtgttcactggagtagcactgttaactttcttcaagaactttttcttcgcattcacaacttggctaactggggcgagaggtctagcttttggtctatctaagcttttgacatgctttgctcactaagcctaatcattcctagcttttgattgatagtgagagacatgtgactttctttcactttaacacttacagatcattataaagttcttaattagcctaatcttcatattatcgtgtctcaggaaatagggaggcccgacaagaggaaaacaaggaacggccagttactggagcagtcaccacacatacatttatcgagtaagtgtggtttgtgtgttttgtggttccccaaagcaattataatagtaacatcaaagatcactaaatacagatcaccctaacagatataataatgaaaaatttaaaatattgtgaaaattagcaaaacgtgatacagagacacaaagtgaacatattcttttgggaaaatggtgatgatagacctgcttaacccaaggctgttacaaaccttcaatttgtaaaaaacagtatcttcaaagagcaacaaagtgaagtgcaataaaacaaggcattttcctatacacacacacatacacacacacacatacacacacgatttattaacattgaactcatggccaaaagcactatgacttgtgcctgaacaaagcttatctaacacacatattttcttcgtaagacacatggcagacttgtgcttaggaacattaaacagcaattcagcattattatatttggggaacatttataaccacaaaattaccaacataaagagcaaaattgagcaaaaggacacttgtttacagtatgagaagtgaaacaagatggaagagtgtggctttgttaaacctcagttgggaacatgagtgttcagtggctcaatttttttgccactctgtgcatgtccacaaatgagaataaaagcactctatgtattgactttgggattgtattaaattttagcaggcaggcaaattcacaaatacagaatacacaaataagattgactactgtggatcactaacttgaaaataaagcataaagacaatgaacaaacattgataagaagaaaatacttctgaatatatttaacaaaaaagtaagagatatgctgaaaactataaaacattactgagagacattaaagaagatccaaataagtgaagagacatttcatgttcatggactggaagattcagtattattaagatgataattctctccagtgtgatctacagattcaacacaatttgagtcaaaatcccagtaggctatagaatttggtgaactgattctaaaatttatatgaaaattcagaagacttcaaataaccaaaacaatttttcaagaaaattgaagttggagggcataaaatttccagtttcaaaatgtacagttgaccctctaacaatgtgggagttaagggcacagacgccgtgcacaatagaaaatgtatgtataatgtttgaatccccaaaaatctaactactgatagcctgttgtagactggaggccttaccaattgtataaacagctgattagctcatattttgactgttatatgtattatatactgtattttacaatcaagtaatgtagagaaaagaaaatgtttttaagaaaattataaagaagagaacatatgtttactagtcattaagtgaaaatggatcattataaatgtcttcatccttatcgtattcacattgagtaggctgaggaggagggagaggagagattggtcttgttatttcagatgtggcagaaaatccatgtatgagtgaacctgcacagcttatatcagtgttgtccaaggatcgcctatactataaagcagagaacaactataaactacagtttccaggacaagatggtgctggcacaaaaatgaacttatagatcagtaggatggaattgagaatctagaaataaacctttacatttttggtaagttattttttaaaataatgcctaggaaattaaatgggaggaaggatagattttcaattggtatctataggtgaaaagacgaatttaggccctgatctcttgccatgcacactagatcaaaatagatcagagatcttattttattttttaacttttaagttcaagggtgcatatgcaggatgttcaggtttgttacataggtatacatgtgtcatgggggtttgatgtacagattatttcatcacccaggtattaagcctagtatccattagttatctttcctgattctctcccttctcccaccctccaccctcctataggcccaagtgtgtgtttttcccccttgtgtgtccatgtgttctcatcattaactctcatttataagtgagaacatgcagtgtttgtttttctgttcctgtgttagtttgcagaagataatggcctccagctccatccatgtccctgcaaaggacatgatctcgtccatttttatgcttgcatagtatcctatggtgtgtatgtaccacattttctttatccagtctatcattgatgggcatttgggttgattcaatgtctttgctattgcgaatggtgctgcaatgaaagtactcatacatgagcctttagaatagaatgatttacattcctttgagtatatacccagtaatgggattgctgggtcaaattgtatttctgactttaagtctttgaggaaccaccacactctcttctacaatggttgaactaattcacactcccatcaatggtgtataagcattcctttttctccacaacctcatcagcatctgttattttttgtctttttgataacagccattctgactagtgtgcgatggtatctcattgtggttttcatttgcatttctctaatgatcagtgatgttgagctttttttcatatgactattgactgcttgtatgtcttcttttgagaagtgtctgttcacatcctttgcccactttttaatggggttgattgttttcttgtaaatttgtttaagttccttatagatgctgcatattagacctttgtcagatgcatagcttgaaaaatttttctctcattctgtagggatctattcattctgttgataggttcttttggtgtgcagaagctctttagtttaattagatcccatttgtcaatttttgctttggttgcaattgcttttggcatcttcgtcatgaaatctttgcctgtgcctgtgtcctgaatggtattgcctaggttgtctttcagggtttttatagttttgggttttaaatttaaatactttatccatcttgagttgatttttgtatctggcttaaggaaaggcgtccagtttcaatcttctgcacatggctagccagttatcccagcaccatttattgaataggaagtcctttccccattttttgtttttgttaactttattacagatcagatggttataggtgtgaggacatatttctgggctctctattctattccattggtctatgtgtctgttcttgtaccagtaccatgtggttttgataactgtagccctgtagcataatttgaaattgggtagtgtgatgcctccagctttgttctttttgcttacgattgccttggttattcaggacttttttgttgttgttgttccgtatgaactttaaaattgtttttttctagttttatgaagaatgtcagtggtactttaatgggaatagcattgaatctataaattgctttggacagtatagccaccatttaatgttactgattactcctatcagtgaatatggaatgtttttccatttgtctgtgttgtttctgatttctttgagtagtggtttgtagttctccttgtagagatctttcacttcccttgtcagctgtatttctaggtattttattctttctgtgccaattgtgaatgggagttcgtgatttggctctcggaataactgttgttggtgtataggaatgctgtatgaatgtatgaatggtgtataggaatgtatgaatggtgtataggaatgctagtgatttttgcacattaattttgtatcctgagactttgccgtagttgcttatccagcttaaaaagctttggggctgaaatgatggggttttcaagatataggatcatgtcatctgcaaacagggatagtttgacttcctttcttcctatttgaatgcactttatttctttttcttgcctgattgccctggccagaacttccaatactcagttgaaaaggagtggtgagagatgacatccttgtcttgtgtcagtttttaaggggaatgtttccagcttctgcccattcctaaaatctgaaattataaaaactttaggttaaaacttttccatttctgggttcaccaaatatttcttagttacaacatcaaaagctcaacttatgaaagaaaatgctaatatattaggtttcattaatgttcaaaacatttgcatttcaaaggataccattaagaaaatgaaaagacaaaccacagaccagagaaattatttataaaccatttatctgatacacgccatatttccagaatatataagtcataagacaacccaatttaaaaatgaacaaaatattttagtatagatgttatggaagaagatatatgaacagacagtaatcacatgaaaaggtgctcaacattattagtcattaacaaaaatcaaattaaattcacaataggcaccattccatatacactataatgattttaataatttaaaaaacagacaataacaaaagttggtgagaatgtgacagaaaagaaggcttcatacactgttggtgcaagtgttaaatgctgcacactcttgaaaacagtttggcagtttttaaaaaataaacagaaatttatcatatggctcagcatttccacttgtagaggtctgtctgagaaaaatcaaaaccggtgtccacacaaagacttacaggcaaatattcatagcagcattgttgatcatcatataaccaaaaagtgcaaaggacctcaatgttcctcaacctgtgaatagataaataaaatgtgatatatccatacagcggaatactatccaaaaataaaaaggaatggcctactgatacatgctaaaacagggatgaacctaaacttcgtttaatggaaagaaaccagatagaaacgaccatgcatgcattattccatttatatagaatgttcatatcaagcaatcaatagagggaaagtcgattaatacatgcctgagactgggagtggaaataaaaatagctgccggtctgcataagggatccttcaggggatgattaaaatgttgtaagattaaactgtggttatctgcaactttgcaaatttaccataagtcagtgatttgcacacttaaaataggtgcttttcatggtttgacactgtactttaataaagcaattttaaaattgcactgattttgtgactgatctaccttggactttcacctgggtagaagacacctgaggagctgagcctggaactgcacttcccctacagatatggtggatgcaaaggagtgttgattatggggaatctgcacactgataagggcttctggcagctggactttctttgcacatttggggagggcgtgggtcagtggataggcaatgttatcacacagagctctggaatcctccactgtggggactctttcagaatcacttcctcaaggcatgatctctcagctccctcttggggtctgaatatgcaatgacactatggcgttccatctcacttcccaccaaaagttctcagtgcaggtaaaatgtgattagatgaagtttgatgtagtcagaaggtctcctataaatgctaaacagagaggagttctgaaagttgtaatgtgcattacaagtccaaggatttaaccaacatgcatttacatgatcatgcctggactcaagaaatatctcattacttgatatgatttaggtcaattgtttaaaaaatatttttctgagtagcaccctatttctctgatggtgaaaatattaataataatgtagggacttccatctttctatgaatgaacacacatctacaggatcttttttaattctggtgattattatgctgtttttagatgtttaaatagcattgttttatttctgtaatatccttatttcaggcattggtcagagtttttattgtgtttacctgtctcctctcattccatattcctgacatatatatattcaatataaatcaaattgccttttacatttttcatttgtcactataacttcattcatctctgtgaacattgctgtatgttacgcatacatttttcccattgtcataactgctttttttcttcattgtaaccccacaagatgtaaaatgattccatatttgtaaagatagaaaagacaaattactacttttcataattctgcttctatgttttcaaatattggctcataaattaacatttttgggaatttatgtttaacatttctaaagagattatctccagatcaagagatgaaaaatataacctattctttatcatcacattttggattgtgtagaaaacctatactttattcaaacatttctactgaagggcaattaaattatgttcaggttttgctaatataatcaatggatttgttaatacaattttacctatatctttacacatgcatacttctatttctataaattagcttctcagatgtgttttaggtaatagatatgtgtcattttaattttactgtaaaaattcaagttgttgcaatttattaatcttttttgttgtgtagtgttacgttgtataaataatgtcacactttactatctactgatcaaacaaaaaaatcttaatcagaaaaaattctctcattttgaagaaacaagaataagattaatagctaacctctaaacataaatgaggaaaagcagagaccataaaatttccttaaaatgataagaaaaagtagccatatagctagagttcccttcaaagttaagcatccttcaagaattaaggtaaactcaacaccacgtaggaggtcagtatctctaggcatgggaactttagtcacaaatcccctaagttatttttacttctaatctttgagaatcagtgagcaacaatgggagaattctttcccaagagaatcaatggggcaattaaacatccttgaggcagcaaagcagatattttcgtgcttcctcatggtctttatatctcttcagtagtccattcaagaggaatagaatccaaatttgcaatgagactaaaatttaagaccctgctttgaacaaactcttacatatattctctgattctagtgctctcactaactctttgtttattaatatataacttttaggaaaactattcttcagcatacccagataaaaatatttcatgacaaaaacatcgaaagcaattgaaacaaaagcaaaaattgacaaatgtgacttaattaaactaaagagcttctgtacagcaaaagaaactatcatcagactgaacagacaactacagaatgggagaaaatgtttgcactctatccatctgacaaaggtctaatatccagaatctaccaggaatttaaacaaatttacaagaaaaaaacaaacaactccattaaaagtggacaaatgacaggaacagacacttctcaaaatatatgtggccaaaaaatatatgaagaaaagcccaacatcactgatcattagataaatgcaaatcaaaaccccagtgagataccatctcatgatagtcagaatggcaattattaaaaagtcaagaaacagcagacactggtgacgctgtggagaaatagaaacacttttaaactgttggaatataaattagttccaccattgtggaagacagtgtggcaattcctcaaagacctagaaccagaaataccatttggcccagcaatccaattactgggtatatacccaaaggaatgtaaatcatcatattacaaagatacatgcttatgtacattcattgcagcactattcataatagcaaagacatggaatccacccaaatgcccatcaatgatagattggataaagaaaacgtggtacatatacgatggaatattatacagccataaaaagtaatgagatcatgtcctttgcatggaaatggatggagctggaagccattgtcttcagcaaactaacacaggaacagaaaaccaaacatctcatgtcctcacttacaagtgggagctaaacaatgagaatgcatggacacagggagggacaacacacactgggggataggggaagagcatcatgataaatagcttatgtacataaggcttaatacctaggtgatgggttgataggtgcagcaaaccaccgtggcacacgtttacctatgtagcaaacctgcacatcctgtacatccatacatatatcctggaacttaaaacaaaataaatttttttaaaaaacttatcaaaaaatattagaactaataaataaattaaatatagtttcaggaaagaaaataaaaaagttgcatttctacaataacaataaacaatctgaaaaacaaattaagaaaatgattccatttacagacttaagtgagtaaaaaggtaaaccagagacagagacaaatgcgaaaaaatactggttctatctatatctataattgtataaatatagatacagatgttagttcaggctgctatatcagactaccataaactgggggatggacagggttaaacagcagaaactttttcaattctggaagctgagaagttcaagatcaaggtgccagccaatctggtgtatagtgaagcccgactccaggtttgtagaggaccttctccttgcatcctcatgtggctaagagcagagagctagctagccctctggtctcttcacttcttcttataaagacattaattccattcatgagggctttaccctaacagcctaattacctgccaaggctcaatcttgatcaacatattgagattaagatttcaacatatgaattttggcagagcacaaacattcagattgatggatagatagatggatggatgataggcagatacacgctgatatatatcacgcatatgttatatatatattttcatacatatctgttcaactaaatcagaaaatgcattagtaaaatgggcagaatttgacagaaattttaacccagaggatggtcaaatgccctacaagcatatataatccatatataatcccacaaacacagatcgtaattatggagtgatactactacacatgtagaagaaaggcttaaattaaaaagttttacaataccaagtattggtggacatgtagaacaatagaaaccctcatacattgctggtggaaaggtgcatttgtataccctgtttggaaatcagaaggattatctactacagtttgatataccagcaacaaagtattttactctatattccagcaagtgtgttcaaagattgctaacatgttacatatcctttctaaagtttgggacataagacatatataacttttatcatttcttctgtatacatacacacacacacacacacacacacacacaaatgtgagtatgtttgtgtgtttatggagatagacaatagatagattgacagatagatcaattgatagatagagagatagatagatgatgtttttataatgctgctgtggtaacagtgtgagagacccagggaatgtccaacaagcatacacagttacccacataaataaccttttctctgctagctgcttcaataggttcatcctatcgtaaaccactgggggttgtgtacatggtgcaaggtagtgactcagtaagaaaatagcacacaggcaagggatagagcatctatataaaaagaaataatccgggtttatatattcccagaggatggaaatttgctttcatgtcactatgagcctaaggtagatgggaacagagagaaagggattataatgtaatatttcctggacaggattttcactaaaacctggagcttcaatcttagagaagacttgataagaatttacaaaactcaatagttttatttttagctaaatacttaatagtgttgttcacattctgaccactttctgtattcaccatctttgagactaaacatactatttattattcttactaatgtctgctccagacattaaggggagcgattacattactcaagaaagaagcttaagtgaggactaaaagcttacaaacacgaatgtttctgttccctcttatagggtagtcactaatattgacatcaccttaatattctgttgaccatatttatcaatgtatgtccttggaagcggaaaagagattagagtagaaaaaaagagagctgtaagagaaaaaacgagattccagaatcagattctttgatgtctgctcttatagaaagtgggagaaatctccgaaattgagccttccaaagaacttaacatatgaaatcatgtttttgattatcattcatctaccctgccctccagggttccagcccagttcagtgacagtaaaactaagacagaaattgctcttaactacgagctcatcattgtgcatattattactggttgcaatggcctttgttggtcttcaccatgcaataaccacaaagccctcatttctatgatccaattatttccttccttggtaatattatttcagccactccttatttgatggctattaaatactaacctgagaagtcagttaagtttgcagagttagggataattgcagataaatcttaatatttcattaggaaacaatcctacatgaggtttcttcaggtagtggctgtagtagaacaatagcaagaaggctagcataatccaggaataatgaggtcaaaacatgaagactgccttgctggtgctgttttcccacaagtttcagaggggtgattctaaatagcaaatgctcaattaaacagcatcacctgaacattagagagtgaagataaaaagatacatgtttcctcaagtattgtgatttgccaaatttaatttcctcaaccgctacacagttttcaggtttttggaaaaatatgtggggtttcaggtaagatttgagcagtggcatgaaggggataacccaaaacttgtccagatataacacatgccaaagacatacagggtatctctttaaatttggaattatagaattgaattgtgttaaaagaacaagtaacttaaaaaaaagaaatgagacatcttactgatccatataattaagaaaaaaaatggaaaataaaagaaagataaatacttgaaatctgaggcaaacctgactagtaagagtctgcacccaggttacatgttgctctcataactatcactcgcttttccccatcactggagggaggactgaagaggactggtgagcactcagtgggttagggaagagtcacgatgactgtgtggatgagggtgagaatgcttatagggagggacaatttcctttaatgctactatttggaatctaagctagatgcattttggtttttggttttgtttttcttggaggtggaaatgatgagtgtggcaaaagacagggagttggccatgagaatttacctctgcttggaagtgaaattgttggcacagctggacaacgtgagaaaggctgtcctggtttttgccatatcaagtgtgtcaggcacagcatgggggcagcagaaactacagaaacaaaaagaaaaaggaagtgagttgcatgggcatggagaagccttataaacaccacagggccacccagttccacattctgaacattttcagcagcagctgaggcaatcccactgagagaacttggaggtttttgtaacagggtgtatcactgtgagagggaaattatcatgttgtagacagaagtaatatgcagcatcctcagattctatgttattaattgtgagggtaaaatctgttccatacccgctgccactgaatcgaggtgggattccaggaacgagagtagtagcttcttgaataatgaaaatagcagcttctcctggtttctgttggtaccagttcatatcatcatcaatgtcttggctggctttgcaggagatgttgactttgtctcctggagtcgctgacatgaatgctggagactgcgtgagtgtcgtttctgccctggtatctgattatggagcaaagtaaaaaacataaatcaaatgcatcatatttgcagagaatgaggaaaatcaattccttatgaaaatatattatttttgtggatatgcaggggacttggtggcacagaggagaggaagtgtttctcttaccagagatccaaaggaggaggaagctgaggaggtgaacctgggaccccataaccttggccctgacctgcaggtggtagtcagttcctaatcagtttgacagcacagattttatggccacaaacatattatagggttatataaaggacaaatatgcaaattatatggtacatgatggtgacatagggagtgtttaaatggcagactgtgtgaaacctaacccatgagctgtgcatagttttatcttcacagctgtgcacactcagaaggttaaaattaacgtaacctcctgggtgtgcatttatcatctttctttttctttgcatttctgcaacaagactcattattctgcaggcttcagtgttacctcttctgtggttctgatgctcagtaacccaccagtggtagacgccatggcaatattcctgacattgccaacaattgcctttcttttttccctgcatcaggcatcctgttctgttacttgtgatgaaacccagtgttagagaggctgcacttttacaatgcacacttggttccctgattactgagccctacttttcttttgcattaatgcacttgttagttctactaaactataatttcataacatttcggtagttgttttcatgtattaaaatttttattttattttgactacagtatattaattacttttcagtggaacctggtagtcgtaaaatgattttctttctataccataaatgcacatttttaaaaactataagcagtctttgaaaatggaactctgaaaattacaggtataccttagtgtaaaagagataaagaatgagaaattagattagtgtagtcagtttgagtggaaagtgatgttactcttctgggtttttttttttaataataaaattctgtttttcccattttattcttctagaaggcaaagggaatcatggaggtggaggactcttcctaatgaaacaaaaagcattctagaaagtttccaaacttcagcattgctggtatctgatatgtattactggaaaacagaaccaacaacataatttgtgagccccagtgcaaaataaaaatgcagggctgcttcttaaaacaggaagagaattttctcaaaaatattttattactttgaaaatataatagtaacatgaatagcaagatcagctttcatataattcaaaatgtctgcttatgcattctatcatatcactggatcctccattacaaggaaaaaataatttttaaattgtttttctcaataataattgataatttgaatcttcatatgagaataatgttcttttctatcaaatataacaatatttaaacttagtttttacttctaatactgtggaaaattgctttgcattattacagcaattttcaaacatggagattctaaactcttgggagaattataataactccttgatatgttttgttacaatgtttatgagtatgcttttattttgtaatgatttactcacagtgcttactgcctaagcatcagtagttcctgttttaatactcaggctggagagttaaaattaattatacttcaatttaatttcgatttattaagccacacaattatataacagcagtaatacatagaattttgattaatagctactattatcataacatatttgcactacccatgaaacatttaatgttaattaaaagtgcacttagaaataagccagacacagaaagacaaatatttcatgttctcactcatatgtaagagctaaagtagtggatcttatggagctagagagtagaatagttaccagaagctgggaaggggggaataaagagaggttggttgatgggtacagacatgcagttagagaaaaggcataagtttttgatagcatcatagggtgacaatagctatcaataacattgtacatttaaaagtagctaaaagagaagattttgaatattctcaacacatagaaattatgaatgtttgaagtgatggatgtcttaaatatcttgatttgtttattacacatttgatttgtttatcacacacacatatatcaaaatatcacaggtaccccataaatatgaaaaattattatttaataataaaatattttggaaaaacaattaaaaattattttattaaatcactggaacagtagaaagaccactagtggtgtatgaagagtgacttttactttttaatctaaatacttcattgtagtttcttaataacaagaatgtatgcaaacatcacttgtataatctacacataggaatatatattaaaagttttctctatgtaatgtgtttatttatagctttcattctaataaaaaaattagcataaaaaagtaaataaaacctgacttggattaattgtacatttattgcaatccctagtacaactacttaaaaagtaaaaaacaaaaacaaaaaaaaagatcaccatcactgatatgctaagaaaagaaagaaaatggaatcatacaaaatgctcaattgaaatcacaaaagacagaaaaaaagtgtggagacaaatgagcaaaaagaaccagagcaccaaatatgaaataacaaacattattcatcaatccaaatgtactaataatcactttagacatcagtggattgttacaccaattaaaagagattgtcagccacattataaaaaacacccaactatatgtagtctacaagaaatccattgtaaatataaagacatatagattaaaagtaaagggatggagaaagatataccatgctaacacttatcaaaagaaaaccagaataatttcagacagaccagacttcagagcaaggaaaagtatcaaggaattaaaaagaggacatcattatagattttatgtatgctaaaaaaaatagtaaaagaatactatagataactttgtgcccacttacttgataacctagatgaaataaaccaactttttgaaaaatgcaatctacaaaagctcacactgaagaaatagtaaaatcagaaaagacctgtatctattgaagaagtagaatcaataattaataagctttcaaaacagaaaacaccaggcctagatggatttatgggtgaattctatctaatatttaaggaagaaattataccacttctctacaatatattccagaagagaaaagcaagagagaatacttcctgtttctatgagactggcataatcagaatgccaaaccaaaaaaaagaaattactaaaaaaatctacagaccaatattgctcatgaaaatagatgcaatattcctcaataaaatattagtaaatcgaacccaacaatatctaaaaagaattatatactataagcaattgggatttattccacatctgcaaggctggttcaatattagtaaaccaattaatgtaatccatcatattaacagattaagaagaaatacataatcatatcaataaacgcagaaaaagaatttaaagaaatcccatactcattaattataaagaaaaaactctcagtaaactaagaatagaagagaacttcctcttgtagatgcaagtcatgaagtccatctacaaaaatctgcatgtaacaccatatttaatggtgagaaattagaagctttcctgctaagatgtggaaaggatgttccctcttacttccttttccacagagtactacaagttctgccaatataataagacaaataatggaaattaaagatacacagattgagaggaaagaaatttcatatgattatatcattacgtgcagaaaaagcatttgtcaaaatccaatacctattcatgatttgtaaaaattagaaaaatttaaaacacaatagctgttcataacagaatttattcacaaaattaaaaaatgaaaatgaggctgccgcaaaactaagtttttgagtggcacatttgttagctaaggaagagaagccacttacccatggtaagttaattaaatcatgtttgattgcagcagctaaaaactgtgtccagagaatataaacttgcttaggactattggctttctgtacgtttatggatcatagttcaggcaaaagcactgtgttcagggaaggtaaattcatatccagagtaggcatctattttagtaggaatgaaatgctgtttcttacatgatggaagtggtctaatgtaatcaacctgccaccacgtagctgcttgtcacccaggggaatggtgccatattagagaattagtgtaggtctctgcatctgacagattggacactcagctgtggccacagccagatcagctgtagggagtgaaagtccattttactgaggccatgcataagctccattcctgccactgcgatcactttgttcatgagcccattgggcgatgactgggcattttgctgccattcttattaccgttatatgaccaagctattcagtgcagacacacaaagataacaccatgtttctttgaagggtgtgtaactcacacatacatcattgttcaaggccatgggtctctttaatttccagtgaaccaaatgggctataccttattattattttggaaacttccgtattccacccttttgctgccatttgatcttatttcctacagctcatcagcatgaagcctctgactactgatcctatagatgattatcttttaaaaatcaccatttcttcctccaactcaagaggataaccctggaattagagtctgggtcaggataaacctaaaactctggatcaggtgaggcctctgaggatcagttttctctaaggcaggatgaagaccaagaatatcccaaggaaatccccaggatatcacctggagaattactgggatttgcataggggatagggaggaaggggaattggggatagagtcaaagccagttgtgctatcagtgtagccaggccagggaacccccaagccctcaagtggaggctgcaaatacagcaaacttgtgtctactactcagagtcgaaagcctgtctgtgcacagcagtcctggtaccatctgtgtcagtgatggctcaggggtcagctgttacatatgtaagtattacttgatgcattttaaaatcttacaaaagacaattctaagggtcagactgagagaaagacttaattcaatgtctcatttgtatgagtaagatctaatttgcatcactaagatctaatatgaaaagttatgtgaatttggttggtccctctcgctctcaaaatatcttcttttacagtactcatgtgttttagactgtggttgactataagtaactgaagccacagaaaggagatttgtggatgaggggggactaacatacttaggaatacaactatatacatatgacttcatttttaagaccatattgtatttaggtatctactaatatattatataaagctatgttttattccattccctggcttttacttttatcatgtatgtactcggacacacaataaagcagaaaattgtttcccccaaccacagttttactcaaaacttagaatcatcggcagtccttggttaaaaatgtgtttttctagaaccttctgcagttttgattaaatagattccatggaaaccacacacacaaaaaaagaactaaatgagagctcagatttacctcacctacagaggtctatttcttctctagaattttaggtcatctaacctttgtgtcttctgtagctctccgatgtcatcatacacatgaatttttagttaagtttgtgtttatttctgcatttatagcaacagctatggtggtcttctaagtggaaattctttcatttttttaattaaattataatatgctcatgtccacttctgtattatattataagacattaaggtctatgtcaatcaataaatacatatgacatacacaaatgctgaaaatttattaaaaactaaagaaatgatagtgatcatgtcagagtttatgatattagataataaacatgatttccatataccagtaataaatgtctagaaatatgtgttttaaatataccgcatttaaaattttctcttttttttcacaaggggtctcactatgtcactcaaactggcctcaaatctgtgagctcaagccattctcctgcttcagcctctcattcctaatactgtttgtgatttaataacaggaaacatcacttatggtattatgttacactgaagttaatgaaggtttgaattcacaacaaaataatccccttctgccaaaggaaataaattgtatttgagatgccacctattccaaagtaagatatcccatggtgagtataatcaaaatttcaatgacaatatacaacatacatcaatatatagagaacagaaagaaaacttagttatttgattaaaaaatcattatctcagcagggtgcggtggctcatgcctgtaatcctagcactttgggaggccaaggtgggcggatcacttgaggtcaggagtttcagaccagcctggccaacatggtaaaactctgtctctactaaaaatacaaaaattagccaggcttggtggtgtacacctgtagacctagctactcaggaggatgaggcaggagaattgcttgaacccatgagtcagaagttgcagtgaactgagattgcaccactgcactccagcctaggtgactgagtgagacactgtctcaaataataataattattattattactattattattttctcaataattaatttacaaatatttgaagttgcagagacagaaaaaaatagagcagaaggaaatacagttggaaaaaaaaaacagacagatacttatctgtgctactctatcaaaaaaatgcttaagaagtctttgctcatgcctatgtcctgaatggtattgcctacattttcttctagggtttttatggttttagatcttaaacatttaagtcttcaatctaccttgagttaatttttgtataaggtgtaaggaagggatccagtttcagttttctgcatatggctagccagttttcccaacaccatttattaaatagggaatcctttcttcattgcttgtttttgtcaagtttgtcaaatatcagatggttgtggatgtgtggcattatttctgaggccgctgttctgttccattggtctatatatctgttttggtacgtgtaaattagttcaacaatttacacgtaccaaagaagacagtgtggcaattcctcaaggatctagaacaagaaataccatttcacccagcaatcccattactgggtatatacccaaagaattataagtcattctactataaaacacatgcacacgtatgtttattgcagcaccattcacaatagcaaagacttagaaccaacccaaatgcccagcaatgatagactggataaagaaaatgtggcacatatataccatggaatactatgcagccataaaaagggatgagttcatgtcctttgcagggacatggatgaagctggaaaccatcattctcagcaaactaacacaggaacagaaaaccaaacactgcatgttctcacttataagtaggagttgaacaatgaaaacacatggacacaggtaggggagcatcacacatcagggcctgcggggggagagcgggggctaggggagggatagcattaggagaaatacctaatgtagatgatcagttgatgggtgcagcaaaccaccatggcatgtgtatacctatgtaacaaacctgcacgttctgcacatgtatcccagaacttaaagtataataataataaaccaggaaataaataataataaaccaggaaagccaagttaaacccatttgcttgactgatcatgatcctactggatacattctcatgggtcccaattttgcccactgctcattttcactgatctcattttagggggttttaggtatggagtccttaggattttgcattaagtttggtgatttttaagagaggcctatcaccagagctccatcagtgatcatttgactttatgtctgaccctgtacacaggtggctacttgtctcctaacctcagttttcctctttttccttattagaaaacaataacaacatcaacacagaccctcttggagctaggaatggccaaaagaagtgatgtgtaaaaaacaaacaaacaaaaataaataaataaataaaaaccacttaataaactggatgtagaagaaacatatcttaacataataaaaactatatataacagacacactgaatgggggaaaagtgaaagcctttcctgagagatctggaacatgacaaggatgcccactttcaccactcttattcagcatggtactggaagtcctagctagagcaatcagacaaaagaaagaaattaaggagatcaaaaattcaatggaagaagtcaaattattcttgttaggcgattatatgatctcatattttgaaaaacctaaggactccactaaaaaactcttagaactgataaaccagttcagtaaagttggaggacacaaaatcaacatacaaaaaaacaacagtatttctatatgccaacagtgaacactctgacaaaaaattaaaaataatcccatttacaataaccatacttaaattcataagaattaaccaaacaagtgaaagatctttataatgaaaactataaaataccaatgaaagaaattgaagaagacaccaaaaaatggaaagatatttcatgcttaaggattggaaaaatcagcattgttaaaatttccatagtacccaaagcaatctacagattcaatgcaatccctatcaaaacgccaatgacatttctcacagaaatagaaaaaacaacccttaaatttatattaaaccacaaaggacccacaatagccaaagctatcttaagcaaaaagaacaaaactgaaagaattgcattacctgacttcaaattatactcagagctatagtaaccaaaacagggtggcactggcataaaaaagagacacatagaccaatggaaagaatagagaaccctgcaatacaaatccacatacctgcagtcaattcattttcaacaaagatgtcatcaatttacactagggaaaagaatctcttcaataaataatgctggggaaattcgctatccatatgcaagagaatgaaactagacttcaatctctcaccatatagaaaaagcaaatcaaaatggattaaagacaaatctaagacctcaaactatgaaactactacaagaaaacatttgggaaactctccatgacatcagtctgggcaaagatttcgtgagtaataccccactagcacaggcaatcaaagcaaaaatggacaaatgggatcacattaagtttaaaagcttctatacagcaaaggaagcaatcaaaaaagtgaagaggcaaccacagaataggagaaaaaatttacaaactatccatctgacaagagattaagaaccataatatgtatgaggagctaaaacaactctataggaaaaagtctaataatccaatcaaaaataggcacaggatttgaatagacgtttctcaaaagaagacaaacaaatgacaagcaggcatattaaaaggtgctcagcatcattgatcattagagaaatgcaaatcaaaactacaatgagatatcatctcgccccagttaaaatggcttatatccaagagacaggcgataacaaaagctggcaagaatgtggagaaaaaggaacccttatacactgttggtgagaatgtaaattagtacacccactatggagaacagtttggaggttcctcaaaaagctaaaaatagagctacgatatcattcagcaactccactgctgggtatatacccaaaacaaaggaaatcagtatatcaaagagatatctgctctcccatatttgttgcagcactgttcgcaatagctaagatctggaagcaacctaaatgtccatcaacagatgaacagaaaaagaaaatgtagtacataaacacaatggagtactattcagccataaaatagaatgaggtcctgtcatttgcaacaatttggatggaactaacgaacgtcattacgtttagtgaaataagccatgtacaggaagacaaacatcatttattctcatgtatatgaagagtctaaaaatgaaaacaatagaatttatgaacatagagactagaaggatagcgaccagaggctgagaagagtagtgggcaggggtggggagtagggggaaagtggggatagttaatccatacaaaaaatacttagaaagaatgaataagtcctactatttgctagtacaacagggtgactttagtcaataataacttaactatacatttttaaataactaaaagagtgtaattggattgtttgtaacacaaaggataaatgcttaaggggctggagaccccattctccatgatgtgattattacacattgcatgcctgtatctaaacatctcaggtaccccataaatatatatacatatgtgtatatatatatgtgtgtgtgtgtgtgtgtatatataatctttctactgtataccatgaaaattaaaaatggaaaaatgataaataagaagaaagttggcaaactattgtaaaaggcaatgagaaatgctgtcacatatttctagagtaataaagaattagaaaattgcctatgaaagtattaatatgatggaaagaaacagggtctctggaaggaaaaagctacagagggacactaccttctatgtgggaggctatgaataggaaggatcaaggtttaatattgggaaggattgcagatgaagaaagaaaaaagagaattaggaatccaagtagaaactttccagagtcaaggaggcacatagaggaaagaattgacccatctgtgcgtaaaactgagtggaccctgttctagagagtaaagataaatctatttggctcggtcatgtgatgtgtccatgtgaaacatgcaggttcctgcaacacaaaaactcctgacaatgtctctaagggatctttacaacattttgctttaataatcttctacaaaaagagatccagcaaaagtcaagtctcttaatttaatcctgggccctgcaaaccctccaacgaataaatcaagagagtgacctccccaacacacagaggaagcatgcatgttgggggctgtgtgcagaggaagcagctgctgcagcaaagacctactggcccagcgtatggggaggaggtttgtgttcgaggctgaagcactgtgggaggagtactataatattgctgacagtaataaactgccacatcttcagcctgcaggctgctgatggtgagagtgaaatctgtcccagacccgctgccactgaatcggtcagggaccccggattcccgggtagatgcccagtaaatgagcagcttaggaggctgtcctggtttctgctggtaccaagctaagtagttcttattgttggagctgtataaaacactctggctggacttgcagttgatggtggccctctcgcccagagacacagccagggagtctggagactgggtcatcacgatgtccccgtaggcacctgtagtcagtaatggacaatgattatacataaacttatacacgctgtctcagatataattgaaatatgtcatttaaatttgctttctagtagtattataagtcagcagataattggatccatattggaaatagtcattatttccaactatatcttaattttttttatttctacacagatattactctgaaaagactgtggcactttttaattcctcaccagagatccagagcaacagagaaatgaagacctgggtctgcaacaccatcttgctgcccctgcctgcctgttgtagctcagttcacaatgcaaacggcccgtttataaaatccaaacagctggtcgtggcctggaggggcctatgcaaaaacaaccagtgagtacaaaagcaaatttcatgagcagtgggttgtgaaagtacccaatgtaaatcaagagccaaaaatatcatcacagaatgtgtaattgtatgaatagaaaagacagaagtcaacttagaagctctaaaactacaaactgctgaaagatctaatgactaggacagcctagtaattttcataggggcataaatgtgaaacgccttgtgcatcgtagaagaaagcagaagagaaagcattcccaatttcttaactgccttttacctatattaatcagtaatatactggcttttacctctgttaatcataataaacaaattctcaataaattttatcgatactcttcaatgcctgctcagcaacattttccgaaggcagctcaagatattaaataactcataagggccaacctcctattgcagcattctttgggatttaaccagtttcccaagactcttttcacaatgttaagatgttagaaatagatccaaaactaggtgatatatcccctagtaaaactgtgaggtcaaacttgtctggctaatgcttccatttaaaaatttctctttcttgatccttcattgtatgtacacaataaatcaggggaaaactttaactgagtgaatcaaagtattctcattattataataggagcttcacacacacacaaaaaaatcaattctattactctcagcctcagttcctaaagccaagttaaagtcctgttctaagatcattgttgcatgaccatatgtattccaggtctaatctaaactgtggataaatcccagcaggacattagagatttttgtgagagtaagcatataggattcagggtttatgagctttagatttttcttgtcaaaatgaatgagagttgccatatctaaaaattattcccagataaataaaattcactacctagaattaatttatgcatataagtagaaatgctatctccctttttaccatccaaagtggaaagcctcatggaactagaaattaatattagaaaaatcagttaataaaagtatgtcatttcatcaattcaataagttataatagcaaaaaaccataataaattatcacttaaatgtcaatacatttataaactatggtacataaataggatattgaatagccattgatgctcctgatgaaaattagcaggcagtgataaatgataaatatgaagcacatgtcaataaataaaataagttttatgtaatttaggagaaaatggtgataatgacacaaaatgtgaattatggatgcatctataaaattctttgtacatttgtgaattgtaaatatttatcttagagacattattactttgtatatgttccatttgctcacctatatgtcccagtctccttacaaatgctatggccaaagaaataggcatacatacatcctttgcaggctgaggcaggaaaaagatcttacggaattttccagtctatcctttatctgtataagcaacttaagaggccatgtgctccaaatggtgcaaatacaagatggtagagcctctgtctgcctggatccttgagtggctgcatggagcagagcacctttctggccctggtgaagattgtagcatgagcaagatataagcatttgttggagctaggccatgagatttggggcagtggtataacctaccctattatggaaaatataaatacacaaaacagaaaagagagagagaagtgagagaagactgtgagagaagtgcatgagagaagactgtgttttgttcatttcctataatcctatatcaccatgggatcctgtgccttctggtgatcaaactaatgttctacagctccaaagaagaatgctcgcctaacgtctccattccaatgacctagagactaaaagccaaaaagaaccttagaaattatctattgcattctttgatgtaaggaaatatcttagagggcacagatagaaatatcttaacccaggtcacttagttcgtggcagagctgaggctaaaaccaggccttttgactcctaattttgtgctctttacaccttctcacatcacttctccaacccaaagtctagcagaaaaggctaaaataagatatatgcatagatttgctattataagtccatgtacttcctcagacgctttaagatggggcttctcatggttcacaataagcagcagagggaagtgaataactatcttcgtctcccctactgctatttgtgcagtttgaagcttatctcttaaatcatgttttcttctcgtagtaaatactacaacttgtgccttttatgtgtgtataaattttaatataatttttttccatgaaccattcaagtaaaatggacactccaaaaagatgttcaataaggttacatggcttcacattgccccctctacaccatcttgtggagctacacattcacctcacccaaatttgagaaaaataatcaagaaaatgactctcactagcagtgagaccaagtccataagcactaatgtcatcagtgcacactgcagcctcatgctgccaagcatgttttgggcgtatccctggactggtttggtgacatgatcaaaggtacattttccacctgcatagccccatcctggatctatagccttccttgtgtctttgtgaacaacctagtgtgaactcaaagtatgagacagatctcaattaatttagaaagtttattttcccaagattaaggacaagcccatgataaagcctccagaggtcctgatatatgtgcccaagggggtcggggcacagcttggtgttatacattttagggagacaagaaacatcaatcgatatgtagaagatgtgcatcgctttggtctggaaaggtgtgacaactcaaggcagggaagggggcttcctgctggggttgcattgttttgagtctctgatcagcctttcacatgtgaaaggcaggtagagaaatagtcatttatgccttagtctggcttattgaaacagtagggcagaagaagcattgcatatgcatttgtctgaagtgaacagagggatgactttgagctctgtcctttctttgtccacaaggaattaccttgtgggcaaattgtgagggaggtatgtagcttttttttctttgtagctatcttatttaggaataaaatgggaggcaggtttgcctgatgcaattcccagcttgactttcccttttggcttagtgatttttggggtcctgaggtttattttttctttcacattagtataactacttttctttttctaattccttttctacttgtatgtgttacagctgacttatgttacttgcaaaaagaattctgactaatgcaccatctgactagaaggcagggttcttcgatgataacgaatcctccagaatctagtaaacagaattgcctgaaaaagaggtgggtgtcttcttggggaatttctcatggcaatgaatggcaactggccaaaggatttatgaccagactgagctctcttttatctattctgttactcaccaagacctattagggtttgtgctccacagggacactggtttctaagttctagggttaaacagtccactcccaggcccaccacaccataccctcctgacatctggtgaacagcaataaaattgtttcttattctgaaaatcctccaatacttccaccatccccaaaaatgcagtggaggaggagagaaaatgaattgttccattagagaacacaatatccattatattattcttggcctttgagataccttacaaaacaaatacaaaaaaagtcccaatttaacatcttttaataatctttacaaaacagaacacatctcctttcttgataatagtcaagaggctcagtggcaactgtggtgaaaagtgtcagattctggtcatgtttcaaaggtagaaaaaatagaatttgttaacatattggatgtgaggcgtgggagaaacgtgaaatcaaggtggttgcaagtgtttaacctgagcaactagagaatttggaaggacattttctgagatggggaaggcaggcgggaatcagggattagagttgaacatattagacatttgagatgcctgctagacctctaattggcaatatcccttggacaggtggatgaatatgcgtgattctggagttcgggaaatagtccgggtggagatgcaaatttgggaaacagggcgaggttactagcaatgagttaaatcaatgaaggcaggctgggacctggcaggtaacccaacaagtagaggtcgaagagatgagaagaaaacagcacaggagacttagaagcagtggtcaggaggaaggagttgaaccaagaaagtgatgtcccagagccaacaaaataaggatttcttttctgtttacaaatgtaaaattaaaaggtttaataaaaagaaaatttacttttatggttggttgttattaagtggtccaaacactgtctcctatttgtagaatcagaactctctcatggcagtagaaaatttggaaagttactttttaaaaggtgtgtgcactgctgccctttgctggtcaagtttatgcactgcaaattccaaggacgattgctcgtcagcttttctcctttaaaatagctcaggctgtacaagctagaaagaacctcgcaagatattccttccaacatttgcatttgacttatgggaagtgcaggttcagccagaaaagttgtgtgcaaggccgtttatgtaagtttatcagacctgattcttacggctcttcccattgtttcgagcctcccttccattcacttcccgctcatacgcgaccaagtataggacaggagtagttattctgcactttatagcagctccactgtctggcactctgatgttctttaattacaagctttatgacagtgattctcaacctgctccactgcctccacctagtggcagaaagaagaaaatgtgtgtaactcgggagtctctggtctgaaagctccggggtatcatttcttcaaagtcttgagcttgtttttgtttgtatttatttatttatttgttttagagacaaggtctcgcactgcactccagcctgggagacagagcgagacaattcaggatctatctagtgaataaagagatatcagtaatgactgttttatattgtggctgtagcgcattcgagggataattcgattctgttctgctttcgaatgcatggctcactgtaacctccaactcccgggctcaagcgatcctcctacctcagcttctccagtagttgagcttgatttattttaaagtttcataaaattttggcatttctttccacaatatggccatgtgtgctttactataaaatattttcatcacaaaatttacatcgctggaaatccccataagccagtttgagaaacacaacccaagaaagcagaacagactcaaattatcccttaaatcccccttaaccacaaatataaaacagtccgtgactgggcgtgttggcttacacctgtaatcccagcactttgggaggccaaggcgggtggattacttgagctcaggagttcaagaccagcctggccaacatggtgaaaccccgtccctattaaaaatacaaaattattcaggagttgtggcaggcagttgtaatcccagctacttgggaggctgaggcaggagaatcacttgaacccaggaggtggaggttgtagtgagccaagattgtgccagtgcactccagcctgggcaacagagcgagacttccatcttaaaaaaaaaaaattaagtaaataaaatataaaaaaataaagcagtccctattgatatctctttattcactaaatcaacctggaattgacctgaattctgatttttttttcatcatggattttttgcattaattttgattgtttaaatattgcattaaaatattatttatcttgactactgagtttgcgggacctccttaaaatttatgaccaaggcaatgcctcactcactcgccttaccataatctgggccacatatcaggggctccaatagcaagcaacatgacttttgaacagctaagacttctctcttcactgtgaagaccagatgggccctgcaaacagtgtaacctctacatgaaaatgcacgagattccaactacaaccaggcacaaaagactctgatggtgaagtcccagccctccaagtcccaacttcctgaagggaaagagcaccccaagttctgaccagaggccagagtcataacgaagatggaatgtgagcttgacatagaaggggtggtagcacctggctcagtaatgaagaggctttcggtcctgaaggaagagctcagcacattcaaagattagaagggaggtcccagtcataggagcagggaaggagagaaggcccaataagaaacacagacaggagggaggggtcagggcaagatcatactggaaacaactagagagctaataaaagtcacagtgcccagtccccacatggaccagactcttcggaatctctaggcatcaatttgggcaccagtagttttcaaagttctccagaagattctatgcacaccagccaagggtgggaaccacaggtgttggcctagggatcatgacaatgagtttctaagtgcaataagaaacctccagagagtttaagcaggggaataatttgatttgtttcttgtttgtgatttttaaagatcagtctggttactgtgtgtaagacaataatccagaaaatctgttgctcatgaaccacatatctgtaaatttgcttcccctgtaactggatctaaccaacaaaaattagtacttactaagaaattacatgcccagggactatgctaagtaattcataaacactattttatttactcctcacagcaagtttataagagaaacgttattatttccacatttcggatgagaaatttgaggcttggggaaagttaagtaatttacctaatgtcacacccagttcataagatgcagagttaagattctaattctgtgtctaagttgatgctccatcaaacacaccacgcctccaactaggaagcaacatgctggccagaggatgctgtcatcaagtttacagaatggttagatttctaggcacagatgaataaatcaacatgttggtttgcaatagaatgaatctatccagctctgaatttgcatccaagggtttgtgagcacacaagtctaaaagtgtggcctcagctctgctaacttcatcaaggtgaatacctaggaggccaccctctgagaccaccagatggacagtccaccatctgtttacagatggtaaagccacataccagctttgccatctgatgttctctattcacattcaacatttatacaagaaatagtcatatggatccttttcaatagacagtactggggaaattgaattgccatatgcagaagaatggaactagacctctatctctcaccaaatacaaaagttaactcaagacagattaaagacttacatataagacctgtaactacaaaaacactagaagaaaacctagggaaaatgcttctggaattaatctaggtgaagaactcaggactaagatatcaaaagcacaagcaccaaaacaaaaatagacaaacaggacttaattaaactagaacgcttctgaacagcaagagaaataatcaatagagtgaacagataatctgcagaatgggtgaaaatatttgcaaactatgcatcctacagggaaataatgtccagaatttagaaggaactcaaacaattcaacaacaacagcaaaataaccccaccaaaaaagtgggcaaaggacatgaatagacatttttcaaaagaaggtatatgatatggtttggctctgtgtctccacccagatctcaccttaaattgtaataatccccacatatcatgggagagacccggtgggaggtaattgaatcatgggggcaggtttgtcccatgctgttctcatgatactgaataagtcctatgagatctgatgattttataaaggggagttcccctgcacacactctcttgcctgcctccatgtaatatgtgcctttgcttctcctttgccttctgccatgattgtgaggcctctccagccatatggaactgagtcaattaaaccactttttctttgtaaattacccaatcttgggtatgtctttattagcagcataagaacagactaatacagtgtacaaatggccaagaagcgtacaaaaaacaaaatgctcaaatcactaatcactagagaatcgcaagttaaaaccacaatgagatattatcttacagcagtcagaatgcctattattaaaacaccaaaaaataacatgttggcaaggatgcagagaaaagggaatacttacacattattagtgggaatgtaaactagtacagcttctgtggaaaacactatggagatttctcaaagaactagaaatagaactaccatgtggttcagcaataccacaactgggtatctacccaaagggaaataaattattatataaaaaagatatctgcactcacttgtttattgcagcactattcacaatagcaaagatatggaatcaacccaagtgtccatcaacagatgattggataaagaaaacgtggtgtgtgtgtgtgtgtgtgtgtgtgtgtatacacataccacaatgaaatactattcagctataaagaaaagaatgaaatcatgtcttttgcagcaatgtggttggaactggaggccattatcttaagtggataattcaaaaacagaaggtcaaatgtcacatgttctcacttataagtgggagctaaatgatgtgtacacatggacatagagtgtggtatgataaacactggagattgagatgggtggaagggtggaaggaggttgagtgatgagaaaatactaaatggatacaatatacatgattcaggcgatagatacactaaaagcccagacttcaccactacacagtatagctatgtagcaaaattgcacctgtattgcttaaatttatacaagtaaaaaaaagatcgtacgaattctgttttttattctctatgaaattactactgagagtattatccaatgccgtttctatgcagtgcccccaatattatccatttagcagctcctatgcaatgccccaagatagaaattgtcttcaacttttatcccaggaaaaccttcagtcacacgtagaaactagaaatttttcccctagatgaaagttatgtaacataacacattatcttcatttagtcggtttccaagaagctcagaaccagattttatgttcaatcaaaaactgcttattttaagtgaggtttactgaggtataaattacaataaaagccaccttttcgtgtatatttctataagttttggcaaatgcatagctgtgtaaccacaaccacattcaagatataggacaagtccctcatcctttaaagttcctttatgccccttccttcaccccagcccttggcaaccactggtttttgtctgatccaatcgtttgcctcttcctgaatgtcatgtaaatagagccatgcaatgtgaagccttttgagtctggctttgttcacttgttcacttaggagaatgcatttgagattcatctttgctgtttcgtgtagcactagttcactgtctattgttgagtagtattccattgtgtggatatgccacagattgtttatctagttaacaatttaaagccatttggtcatttctaatttttagctgctaagaataaagttgctgtaagctttccaatgcaggtttttgtgtgaactcaggatttcatttcgcttgggtaaattcctagctttgggactgctgagtcatctggtaggtgtatgttgaactttataagaaactgccaaactgttttccaaagttgctgtgctcttttgcactcccatcagcagtgaatgagggttccacttgctcgagcctagtattttaacttcactatataccttctttgatgacatatcctttcaaatttttggtcaagtttttattggggtgttgttactatggactgtgagagttctttgtatattctgcatatgatttttttctcacatttgtgttttatgaatatgttctcccaatgtgtggcgccttttattttcttaacgtgccatgtgaagagcagaagtttaattttatgatgtccaaattatctttttttcttttcttttttagatcaaaataggggtctattttgattaccactgttattttatctccatttgattttcgatttttatttttatttttctaatttcattgtaaatttttaattaaacccaaatattctaggggaaagaggcaagataaaaatagtctaacttgggcataaattttagagtcatattctcttgccgagaaaggaaactagctctcttacattgattgtttaatttcagacgtcactactttatgaggatgcccaaattatgggctttaaaaaatatatatccaaacaggggttcagaaagaataactaatttgtccacaacaacacaaaaaatgattccaccataagtttgcccagtgacagggtctatattattttctatatatcaaattctacaactggttcttaaagctactgtacataacctaagttaaaatattaggtattagttgataagacattttatcatctatgaaatgttgcctgttgtcatagttagagaatcttttaaaatatggagctattttcatagattaaactatgccagttaaaagttgggtaaaaagaactacagaataatatttatgtttatcgtgtaaggttttaaagcaaactccaagtcattttcatcaatgaaatcaataaggttttgcaaatatatatgtatgaaaatactgatttaaaatgcaaataaggggagagtttgagagagagagagagaccaaatgattttataattctagtaagtttataggtttatggggtttttacgtacttttctacccaacttgtctataagactttaatgaatcacttagaatttttaaaataatttattattactctgtacctgttctttactctgcaaatcttaccttgcccttttgtctaaaagcaataaaatctgacctggtttatatcgtatcattgattttgttacttagcaagcacagtgatccattaggcctatgtaggctcatggtttatacaacactgccatctgctgacagagtgtgacagtcacagtcagcaacacgagaccactttattttcatttttagtgtttatagaaatatgaatatacacaaatagtataatgaaccctaagcttcacaaattaacattttgctaatcttgtttcaactaccgcctcccccctcatccaattactctgttctctcacctcctcacacacagacactggcagtatttttcagccaatcattaatacgttgccaactgataaggacttttaaaaaacaaccaccattccattatgattcccagcataattgagagtaattccctaatatccaatacccattttctattccaatttccttgattgtctttaaactgtttttaccctaagtttgcttaaatcaaagtccaggtcctgttaaacatatggttaagttttacccaaacccaaataaataaataaataaataaataaataacctattttttccaattccagggaatagtgaaagagggtaaatgccattatttagaaacataaatcacatcataggactagaattatcttgaagtcaaaattgaagactgaaaatggaaaagaaaggtatagactaaacttatttaaaaacttcaatgcagaactctaagagaagatattagaaagttgtaccagcattcattattcagtattcatcagtattcactcagctatatgtagttgaaatctaactagaggagcttgatcagataaagagatacatttttctcaccaaggcggactctggaggcaggtggttcagagctagacagctgctgcaggacccaggtcctttccctgcctgctcctccactctagcttgtgactttcatcctgcaagatgggtgtttctgccaagttccagatagaagaagatagaacacaaaggagaaataagcagtggtgcctctgtccatcaagcaaaatttttccagaaatgcacaatagatttcagatgatgtctcaacagtcctaactgcaaagaagctgaggaattagatttttggctgggacactgttgccctgtaaaaaaattgggattctgttattaaagaataagaggagggaagaaagattgaaaactcctatgcaatagtgaaaaaaataagaaactcaataaaaaagtgggcataccttaaaaacaggcaattcacaacagatgagaccccaatagccaataaacatttttaaatggtcaacctcatgagtgatcagaaaacacaaatatgtattttaaaccaaaaataaaatacaatgtattgaccatttgagtggaaaaaaattaaaaagcctgataatatcaagtattggagaggatgtagagtgaggaaactccatggaggacctatcattgcaaatgtgggaatgaaacttaatacacgaatttgaggccaatttgtaaattgaaaaatgcgcacaccctgcaaccaagtaccccttgcaatatttttgaaaagacaaaaacgttatgtaaatggaatcatgcaatatgtgacctttatactcagcataatgcccctcagatccattgaagtcatgtgtatcaacagctcactattttttttttaattttttttagagacagagtctcactctgtcacacagggtggagtgcagtggcgagatcataactctctctagcagcctcgaactcctgggctcaagcatcctcctgcctcagcctcccaagtagctaggactacaggcatgggacacaacacacagctaatttttttaaattttttttagagacatggtctcactatgttgcctacgctggtctcaaactcctaggtcaagcgattctcccacctctacttcacaaagtgctgtaggtatgtaggtatggattgtaggtatgaaccaccgtgcccaactcactactttttattactaattattccatgggatggatgtaccgcagtttgttttaccattaatctattgtaggacattttgactgattccagtttttttttaatacaaataaaaccactatgaatagttgtgtattgtatacgtttttgtgctaagttttcatttttctgggataagttttcatttctttgggcttttactgtatccttgatattataatatgttacatcttcagttttattctattcaatatataatcttttattttccttgaaatctcccatggattgtttagaagtgtgttgttttgtttccaagggtttggcatttttcccattatttttctattatcgatttccagtttgattccaggtggtcagagaacacacttcatgtgatttcagttctattaaatttgttgaggtttgttacatggcccagtatatggcaattttggtatatgttccatgagcacttgaaaagaatgcgaattctgctggtgctggttggagttttccagcaatgttgatttatgatcttactcattgatggtggtgttgagtttgatgtgttcttacgatggcagctttaacattcttgtcaggtaattctaacgtctctgtcatgtcagtattagcgcctcttaactgtctcatcaaagctgagattttcctggttcccctggttcctgttgggatgtgtggttttcatttgaaatctggactttggagtattgtgttatgaggctttggatctcatttaaactcatctcagcgaatttcctctcttgccactcaggaaggagaagttgggtgtttgaatggagcagagccgttactgcctaagaattgttttactgggcttcccctttctttctcctttgactagagagagccagctttttattagggctttatgtttttctgggcctgttggtgtttctgggttgacaaacttctccagaaccaagtctggaatggatgaggcaaaaagaaaccccgtggaatgcactgctgggtcgctccttgggtcccaatgttcctaactggtctgccttcttctctccagcttccagagtcttcataagtttgctttacgtacaatgtccggggtttttactttacttgagagaaataggtaaaagtaattctactccatctttcaggaagcaaaagcccccttgtgtatttttttaaactttcaaaaacaaaacaaaaggcagctgcaacagtaaagaagctagtaacacccttggtgggaaattcaagtccaaatacacattttaagtttggctagccagtgagaacatcagaatagttcaggttttaaacaaatttatatttatgattatgcatatactaaaagctgaaggcatcttatatttactaagcacctattttgttcttgttaaaaagacagaattccattccctaggaaatttgacctggcagctggagctgatccacctggccactagagcacagagcagggagagtagtagccctgccccagccacccctcaagacaggattctttctctgggaactgtaggtaacactaaatcgttctggaacacaacaacgaaagaagaaaggaaagagaaagaaagaaaggaagaaagagagagagaaggaaggaagggagggagggaaggaaggaaggggaagggaagggaatggaagggaaggaaggaaggaaaaggaaggaagggagggagagagggaggaaggaaggaaaggaaaggaaggaaggaagaaggaaagaaaaaaagaaagaaagaagaaagaaagaaagacaagaaagaaagaaagaaagaaagaaaggggaaagaaaagaaagaggaaagaaagagaaagaaagaaaagaaagaaaggaaagaaagagaaagaaagaaaaagaaagagaaagaaagagaaagacaagaaagaaaaaggaaagaaaagaaagagaaagaaaagaaagaaaggaaagaaagagaaagaaagaaaaagaaagaaagaaaagaagaaagagaaagaaagaaagaaaaagaaagaaagaaagaaagaaagaaaaagaaaaagaaaggagaaaatgacagcaattacttttgcaacaacctaatataagttttttaaaagttaaatattctgttccatgcattgctggataccttataaataacagggcatcctatgacctgaatttcccaaattatgagttgagggtttgaactagttttaaaaaacaaggaggccaggcgcactggctcatgcctgtaatcccagcactttgggaggctgaggcaggtggatcacgaggtcaggagctcgagaccagccttaccaacatagtgaaacaccgcctctactaaaaatacaaaaattagccgggcgtgatggtgcgcacctgtaatctcagctactcagcaggctgaggcaggagaatcgcttgaacccagaaggcggaggttgcagtgagccaagatcacagcattgcactccagcctgggcgacagagggagactccgtcttcaaaaaaaaaaaaaaagacaaggaatctgtaaaacaggcactggaagtatatgcacttttattttcattctatgctatccgatgcctactgctatttcccttcatatttaacctccaacagctgcattttgctccctccagaccacctgattggagctcacgtgctcccacacagtacctccaaccagagagagtcgagtcccacagaaaggcgtaacaatcaccagtaattttgcacttattttacattgtgccttgatacagagtactcaatgaatgctctttgaatcatatttaataaatatgtgtatttgggattgtagcatattgcagctacctggatatataatttaattagaaaaaaaattttgtgtggctcaatcaacaaacgacttttctctctctctctttctctttctccctctctctctctttcttctcagttgatgttgctggagttcagtgttgtgcagatggcagtgacaaatgccatgggcacatgagatatgataaaaggtccctgaagaaggtggagaaccagttatcttatgaaattttccagagtgggtactggatctctcctgtctggcaccatgctggcctcagcccaaggggaatttccttccagagacagagggcagtgattgaggtggggagacagatcgtaacactgagacttacatgaggacaccaaacagaaaaaaggtggcaagtatagaaaattctttcttctggacagtcttctctgttctaacttcagcaaaattctccccccagtggatgctattgcacaaccctacatatgctatgttttttcctatacacacttacctatgataaaatgcattaattagtcacagtaagaggttaacaacaataactagtaataaaatagaacaattcagtaaaataagagttacttgagcacaaacactaggatatcatgacagtcaatctgatgaccaagagggctactaagcatctaaacaggagggtaagtgtagacagcatggagacgctggacaaagggatgattcagtcccaggctggtatggagcggaagggcatgatatgtcatcacgctactaaggcacacaatttaaaatgagtaaattcttatttctagaaatttctttttaatattttcagactacagttgcctacaggtaactgaaaccccagaaagcaaaattgttgataaggaggtactactgtacatcgtcctttgaaccaactttatcatttgctagtatatacatatatacctacatacatacatatacacatacctgcacacacctatatgtatacgtacacacacacacacgcacacacacacactcacatctactaatgttagaataagtttgctaaataagatgcacaacttgttaatgtcctacagagcaataaaaccataagcattggggttatcttttctactagataaaaatccattatcattttcataaagttttctttacattaacatctaacttttgcaatctagtttttaatcatcataaataggaagcaaatgaactgtttctctagtgaatcaaatatccttgaaaacatacatagtcatctttttggtttatttttatttttagataaattatttaaagttttaaataatttaacattcacaatagtttgtgactgtatattttgacttggtccttcaaacttaatttgtacttttatgtatcgtgcttacctcaattttttattcacttttcctaaactttgctggattggtttattatttttgtctatttcttttccttctagtggtttgggagggttttttaaatcccattactattgaatgcctattaacttgccccctttttctttcaatctctattcccacggcctgaagcatgagggccaagctgtctgtaaccagcagagagatgacccaggtgttattccactctccactgtccacctatcaccattcccagcccgatagctctgaagtacggcttttctggggctctgtggggaaaactagaactggctgcttcaaggacacctcctgtttttgcaatggaaaaaatgtttctaaattccagtttctctatgaattcaatgacatggtttaaatctctgtggtgttcttcaaagttttttcttctaataggacctctcatgattctccaaccacgaaataaattcattatcatttttatatttcttctgtcattgcaaaggaggttttgaaagagtggaggacgcgctaatgaactcaaaaatccacactattccttgtttccatctgttgttcattcattgtttccattggcctgtccgcctcctatcctccttcttagacttggagctctagcctcagccaggatagggaaaagagagatcagactgttactttgtctatgtagaaaaggaagacataagaaactccattttgatctgtatcctgaacaattgttttgccttgagatgctgttaatctgtaactttagccccaaccttgtgctcacagaaacatgtgttgtatggaatcaagatttaagggatctagggctgtgcagaatgtgccttgttaacaacatgtttacaggcagtatgcttggtaaaagtcatcgccattctccattctcgattaactaggggcacagtgcactgcggaaagccgcagggacctctgcccaggaaaactgggtattgtccaaggtttctccccactgagacagcctgagatatggccttgcgggatgggaaagatctgaccgtcccccagcctgacacccgtgaagggtctgcgctgaggaggattagtaaaagaggaaggcctcttgcggttgagataagaggaagccctctgtctcctgcatgcccctgggaacggcatgtctcagtgtaaaacctgattgtacattcgttctattctgagataggagaaaaccgctctgtggctggaggcgagatatgctggcggcaatgctgctctgttgttctttactacactgagatgtttgggtgagagaagcataaatctggcctacgtgcacatccaggcatagtaccttcccttgaatttacttgtgacacagattcctttgctcacatgttttcttgctgaccttctccccactatcaccctgttctcctgccgcattccccttgctgaggtagtgaaaatagtaatcaataaatactgagggaactcagagaccggtgccagcgcgggtcctccgtatgctgagtgacggtcccttgggcccactgttccttctctatactttgtctctgtgtcttatttcttttctcagtctctcgtcccacctgacgagaaatacccacaggtgtggaggggctggacaccccttcgagccaggattatcagggcatttgggggtctgcaaaactaagccccaactcatcgatttcacaacttcatccagagccagcctgaacagtagttgcccatgatttctatgccttaatacgagaagagaacataggggctgggtgccaagtaggtagacagggagggcagggaactctaagacagagcttgaggggctcattcctcttgcaaaatgaaacaaaaaccacagcactgaatatgtaaatctcggtggctgaacccctcctaggatagtaagccctgacacaattgctgctatcttctctttctctcaaggaagtcaaaaaacacctgcagccttactgtccccttggaaacaagatgaacatctacattttctaaagtgggacaagaatctctgttcatatttatgtcccatgcatttgcacgtggccggacaaaggactttgcttctgccagcacatctgtcttcagatatgagaggaaacagacacaacctggaggcggcaaagaagcagctctttctcaagtgacctcctctatctccctacttcctggctaatggggcagccttgatccttgggaatccaggacagatatccactcgtgacaaactagctggaagaatgacaaccaatcaggttccaagcaccactggatgtgaaccacagaatttcctcctctccttgtggaatgtcagcttacgtctgacaaaaaatgtaaaactgagagagttacaatcttaaggaggagtcaagctaaagcagaaagaatcacctactctggactccagcatgactgctgagctcaaatatatatagagagagaaagaaccacaaacttgaagatggatatcagctacagactttcctgagtcaggtagggaaatggccatccctcaaaccttgcaaaaggcaaacttatgccattgtgtcctctgacatactgggtgatgtactgtatgttactgatgtgaggggaacttcctaaattggctagtaaattatgccaaataaaaagcaaaaatgatatttcttgaaatgttacatctgaggaacattgctaaaataatttatcagtagttttcaggatgatttatagatgtgcattgaagtgtgtacttgtgctctctctctcctctctctctctctttctctcctctctctcgctctttctctccttgcccccctccctccctgactttccttcctgtcccctccacagcagtttatattttttttctgataatctaactttgctgagggttcaatgtaaagcaccttcagtgatgagttagttggaatgttccccaagaaattctatttccagcactcttttacatgaaatccaagaagctctcagactatcttactgacaccttgcctttcctcaacagatcaatcttatcaatgtccatcacagatattttgtagaacggtggatcctggcagagtctcacagatgcttctgagacaacatttgctttcaaaaaatgaaccacacacatcctaaagatctcagccacttcccatgtttcattttgtgttacagcaaacatcacaacaatcattcctacagatcaccactgcatgtgatcaataaaatagtttttgcaacaatggtacttatgataatcatcttttattgtttacaaatactgctttacaatagttattcggttgcactgttcatattagatttccaattagctcacttaggaacataagtccctcgaacagctcagtcatctttttcattcctgtttctatcccctacatctctttcctttgcagacgactatctcctacactgaaacaggaaagcttttacctttttggcatgcttgatttaaagattatagaaaagtatttgacaaagaaaactcacacatgtgtgtacatatcttttaaaaagttatgtttatgcattgcacaggaatatcgagaatgctaataggcaatgtcagagtttactgtttttcaaaattagtacagttttattatttctaaaaactataaaatgaatatattcacatcaccatacagaagagtaggaggagatggcataaagtgtcattgttcctcctctgcaatcccaggagataactaccaagcacaatttatgtcttttaaaattcagcccgtatttatatacatatatattcaatgtagatgggatcatgatatctcaccacacatactcttcagtgacctgcattttcacaaacaccttccacgtaactatatagaagtctacgtcttccccttaatgtctgctttgtgctacattgtaaagctctagcacagtttaaccaaactcctattaatgaggattttagttatttttcactctttaaacaatatttccatgtgtagtcttatacatacgtctgtacacacttatcccagtctaaggagttccttttaccttcccccatcccagcattccctgtcacgcttgttgcttccgttgagtgactttactcctggagtataatctgcgtatagttcagttaaaaacatgggatctgagtttaggtcacagctctgccacttactgccataagccagttccttgacctctctgccctcaagtttttgcacctacaaagtaggggataatattagttcctagttcatagagtcttgggaataattaaatgtgatgatccatgtacaatgtctggcacttagtaagtgctcaataaatgtcaccctttatgattggtattgcgtgtatgtctgcagagaaaatcactttgtgtcccctttaaaaaaggactatgcccttggtcagctattttgcacattaaatttcacttgccaatattaactctccacctctaacttgatccctctccttcctcatcttctggtgagaccaaatgctaattctgctattcaaggcaactagcaaagctgccagtgacagaatcaaataaacctacccctaatctttagaattgtagttatgatttctgttgtaaaagttactgttgtggcagtcagtattagtctttggtctatgatagcatctctgatctattattgattttcaattatgtatttttttttatttattctgaaaatgtttgttaagcatttgctaagtaaagatactggactgagcctcccaaatacagggcaaataaaacatcaaacagcttataatttagaagggtagaagagaatctgaaagcaggtaaaaataaacaggcactcggctgggcgcggtggctcacgcctgtaatcccagcactttgggaggccgaggtgggcggatcacgaggtcaggagatcgagaccatcctggctaacacggtgaaaccccgtctctactaaaaatacaaaaaattagcgaggcgtggtggcgggcgcctttagtcccagctagtcgggaggctgaggcaggagaatggtgtgaacccgggaggcggagcttgcagtgagccaagatcgcaccactgcactccagcctgggtgacagagcgagactccgtctcaaaaaaaataaataaataaaataaaaaataattaggtactctaggcccagtgacctgtctctgtactctgtaaattcaggtcacctgctcagggctaatctgagagaaggtctctcttcagttgaattttgaaagacaattagcagttcacaagctaacccaggtggacaaagatgttcccaagcagagggagtgcttgtgaaagctggaggccatagaaaaactctaaggagtgtagggaggtgggagtaatgtatggaaggggtggagatggaaggttaagagagatacaaggctgcaaaaatggagctggactcaaaagaaaatactgaaaaggtcttcagtgttgttgatgagattactatggaaacactatggaacactgggactccatggcagctccaaagatggcatgcgcctggtccagctcagtaagagctgagctcttcctgtgctgtgaaaacagacaaaccaaccaagtaaagtctacttttctactctattagtcttcactttggtttcgtataccatctggagctacatttcaaaatgcatttcaaagttatgagccttaagttgatatatatttagtctacctttttttaaataacattgcagcaaaggagaagataaaatagtaagacaacctgtaattattactcattgagaagctgatgatttccataattacactaaatgaagtttatcctttgcaaaagcccccccagcccaccccaaaagaaagtacaaaaaaactggccattttttttaattgcttgtttttctttgtaattaacattcagtctactttctaaaaaataaataaataataagcagtccagatgtggcaagttgctaaagaaaggaaccatcaggccatagacgtaaatatattctcttcttggattttaggtctcacctaagaaaataaacacatgctatgtcagagaagcctcagggtttccacacctgctcgaaaagggagttgagcttcagcagctgacccaggactctgttcccctttggtgagaagggtttttgttcagcaagacaatggagagctctcactgtggtggacgttcggccaagggaccaaggtggaaatcaaacgtgagtagaatttaaactttgcttcctcagttgtctgtgtcttctgttccctgtgtctatgaagtgatctataaggtgactctgcaatcagcctctgatatccttcagggaaaagataaagataagtctgtagtcaaactcgagaattgattgcacattttctttgaagagcaagcaagattcagtcattgggtgagaataacttgtctaagtaatagcttcagaaatgtcctggggaacataacatgttctggacagagccttggtcaattgtcagaaagggagtttttgtataggagggaagttaagaggaaccattgtgtgtacacttttggccaggggaccaagctggagatcaaacgtaagtacttttttccactgattcttcactgttgctaattagtttactttgtgttcctttgtgtggattttcattagtcggatgccagggatctaacaaacttcattcccaggttaggtacagaggaggggaaattgttccacaggacgctagcttgtggctaatttttaagatttctaaatcaaaataacttcattgggggaaagaggcttgctgagctttcagggaggtttttgtaaagggaaaagttaagacgaatcactgtgattcactttcggccctgggaccaaagtggatatcaaacgtaagtacatctgtctcaattattcgtgagattttagtgccattgtatcatttgtgcaagttttgtgatattttggttgaataaacctggtgacccagaagtaaatagcaggacaccagaaaatgaacttaaaaagctgagcaaatagacgaatcattgggtttgagaggagaataggattcatgggggaaatggggaagaaatagctagatttttctctgaacaagcagcctatctcatatgattggcttcaagagaggtttttgttgaggggaaagggtgagatccctcactgtggctcactttcggcggagggaccaaggtggagatcaaacgtaagtgcactttcctaatgctttttcttataaggttttaaatttggagcgtttttgtgtttgagatattagctcaggtcaattccaaagagtaccagattctttcaaaaagtcagatgagtaagggatagaaaattagttcatcttaaggaacagccaagcgctagccagttaagtgaggcatctcaattgcaagattttctctgcatcggtcaggttagtgatattaacagcgaaaagagatttttgttaaggggaaagtaattaagttaacactgtggatcaccttcggccaagggacacgactggagattaaacgtaagtaatttttcactattgtcttctgaaatttgggtctgatggccagtattgacttttagaggcttaaataggagtttggtaaagattggtaaatgagggcatttaagatttgccatgggttgcaaaagttaaactcagcttcaaaaatggatttggagaaaaaaagattaaattgctctaaactgaatgacacaaagtaaaaaaaaaaagtgtaactaaaaaggaacccttgtatttctaaggagcaaaagtaaatttatttttgttcactcttgccaaatattgtattggttgttgctgattatgcatgatacagaaaagtggaaaaatacattttttagtctttctcccttttgtttgataaattattttgtcagacaacaataaaaatcaatagcacgccctaagaaaaatcagggaaaagtgaagtgtacctatttgctatgtagaagaggcagcttacttgaaaatcagcagcaatgttgtttttagagtctgtaataagtaataaactcaaaaagacacattctataggaataagggcttcacagatagagctcattttttaaaaatccaatttgtacattagactaaacgtgaaattatctcttattgtaatggtggaaaggtggttattcccaaaagctcaatctcaaagaaatgtgtttaaatgaaaaaaagtaaataattgcattttttaatgaccgtgggtctgtgaaaaaaataggaaatattttaaagagtatgttctttcattatcctctgttattacttgtctacatttttattctgccaagaaggccgtggcaccgcgagctgtagacagagccgcggtctttctcgattgagtggctttggtggccatgccaccgcgctcttggggcagccgccttgccgctagtggccgtggccaccctgtgtctgcccgattgatgctgccgtagccagctttcctgatgcacagtgatacaaataatgccactaagggaaagagaacagaaacgtaatgggcgctgagctgggaaaaccagggagaagactgatttattagagatttcagaaataaaattcacattcattatgatatctcattagtgaaaatttccattaggggattgtaaataatttaaagctttttttttttcagtgctatttaattatttcaatatcctctcatcaaatgtatttaaataacaaaagctcaaccaaaaagaaagaaatatgtaattctttcagagtaaaaatcacacccatgacctggccactgagggcttgatcaattcactttgaatttggcattaaataccattaaggtatattaactgattttaaaataagatatattcgtgaccatgtttttaactttcaaaaatgtagctgccagtgtgtgattttatttcagttgtacaaaatatctaaacctatagcaatgtgattaataaaaacttaaacatattttccagtaccttaattctgtgataggaaaattttaatctgagtattttaatttcataatctctaaaatagtttaatgatttgtcattgtgttgctgtcgtttaccccagctgatctcaaaagtgatatttaaggagattattttggtctgcaacaacttgataggactattttagggcctttttaaagctctattaaaactaacttacaacgattcaaaactgttttaaactatttcaaaatgattttagagccttttgaaaactcttttaaacactttttaaactctattaaaactaataagataacttgaaataattttcatgtcaaatacattaactgtttaatgtttaaatgccagatgaaaaatgtaaagctatcaagaattcacccagataggagtatcttcatagcatgtttttccctgcttattttccagtgatcacattattttgctaccatggttattttatacaattatctgaaaaaaattagttatgaagattaaaagagaagaaaatattaaacataagagattcagtctttcatgttgaactgcttggttaacagtgaagttagttttaaaaaaaaaaaaaactatttctgttatcagctgacttctccctatctgttgacttctcccagcaaaagattcttattttacattttaactactgctctcccacccaacgggtggaatcccccagagggggatttccaagaggccacctggcagttgctgagggtcagaagtgaagctagccacttcctcttaggcaggtggccaagattacagttgacctctcctggtatggctgaaaattgctgcatatggttacaggccttgaggcctttgggagggcttagagagttgctggaacagtcagaaggtggaggggctgacaccacccaggcgcagaggcagggctcagggcctgctctgcagggaggttttagcccagcccagccaaagtaacccccgggagcctgttatcccagcacagtcctggaagaggcacaggggaaataaaagcggacggaggctttccttgactcagccgctgcctggtcttcttcagacctgttctgaattctaaactctgagggggtcggatgacgtggccattctttgcctaaagcattgagtttactgcaaggtcagaaaagcatgcaaagccctcagaatggctgcaaagagctccaacaaaacaatttagaactttattaaggaatagggggaagctaggaagaaactcaaaacatcaagattttaaatacgcttcttggtctccttgctataattatctgggataagcatgctgttttctgtctgtccctaacatgccctgtgattatccgcaaacaacacacccaagggcagaactttgttacttaaacaccatcctgtttgcttctttcctcaggaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagagggagaagtgcccccacctgctcctcagttccagcctgaccccctcccatcctttggcctctgaccctttttccacaggggacctacccctattgcggtcctccagctcatctttcacctcacccccctcctcctccttggctttaattatgctaatgttggaggagaatgaataaataaagtgaatctttgcacctgtggtttctctctttcctcatttaataattattatctgttgttttaccaactactcaatttctcttataagggactaaatatgtagtcatcctaaggcgcataaccatttataaaaatcatccttcattctattttaccctatcatcctctgcaagacagtcctccctcaaacccacaagccttctgtcctcacagtcccctgggccatggtaggagagacttgcttccttgttttcccctcctcagcaagccctcatagtcctttttaagggtgacaggtcttacagtcatatatcctttgattcaattccctgagaatcaaccaaagcaaatttttcaaaagaagaaacctgctataaagagaatcattcattgcaacatgatataaaataacaacacaataaaagcaattaaataaacaaacaatagggaaatgtttaagttcatcatggtacttagacttaatggaatgtcatgccttatttacatttttaaacaggtactgagggactcctgtctgccaagggccgtattgagtactttccacaacctaatttaatccacactatactgtgagattaaaaacattcattaaaatgttgcaaaggttctataaagctgagagacaaatatattctataactcagcaatcccacttctagatgactgagtgtccccacccaccaaaaaactatgcaagaatgttcaaagcagctttatttacaaaagccaaaaattggaaatagcccgattgtccaacaatagaatgagttattaaactgtggtatgtttatacattagaatacccaatgaggagaattaacaagctacaactatacctactcacacagatgaatctcataaaaataatgttacataagagaaactcaatgcaaaagatatgttctgtatgttttcatccatataaagttcaaaaccaggtaaaaataaagttagaaatttggatggaaattactcttagctgggggtgggcgagttagtgcctgggagaagacaagaaggggcttctggggtcttggtaatgttctgttcctcgtgtggggttgtgcagttatgatctgtgcactgttctgtatacacattatgcttcaaaataacttcacataaagaacatcttatacccagttaatagatagaagaggaataagtaataggtcaagaccacgcagctggtaagtgggggggcctgggatcaaatagctacctgcctaatcctgccctcttgagccctgaatgagtctgccttccagggctcaaggtgctcaacaaaacaacaggcctgctattttcctggcatctgtgccctgtttggctagctaggagcacacatacatagaaattaaatgaaacagaccttcagcaaggggacagaggacagaattaaccttgcccagacactggaaacccatgtatgaacactcacatgtttgggaagggggaagggcacatgtaaatgaggactcttcctcattctatggggcactctggccctgcccctctcagctactcatccatccaacacacctttctaagtacctctctctgcctacactctgaaggggttcaggagtaactaacacagcatcccttccctcaaatgactgacaatccctttgtcctgctttgtttttctttccagtcagtactgggaaagtggggaaggacagtcatggagaaactacataaggaagcaccttgcccttctgcctcttgagaatgttgatgagtatcaaatctttcaaactttggaggtttgagtaggggtgagactcagtaatgtcccttccaatgacatgaacttgctcactcatccctgggggccaaattgaacaatcaaaggcaggcataatccagttatgaattcaaaccttcttctcagaagataacactctgaagtgaaacccacccataacctaagcaagtgaagacaggtgctgcaggtggaattgtgtccttcaaaaaggtatgctcaactccttgctcttggtactcataaatgggtcacataaatgtgactttatttggaaatagggtctttgcagaggtaatcaagtcaaaattaggtcatactgaaatgtttgtgaggatgcggtgaaaatggatcattcatatattgctggtgggaatataaaagggtatagctactctagaaaatagttgtcagtttcttgaaaaactaaacaaaagacacctaccatatgacccaggaattgtactccttgggaatttacccccaggaaataaaaacttatgtccacacagaacccatacatgattgttcacagcagctttatttgttgtagccaaagctagaaagagccaacccatccctcaataggcaactagcctaacaaattgtaatatatccatgccatagaatgctatgaggcaataaaaaggaacgaagtgttgatacagagaactggagtgattctgaaggactttctactgagtgaaaaaagccaatctgaaagggtcacataccatgtgattccttttatgtaacattgttgaagtgacaaaattatagggatagagaacagattctggttgccaggggttagggtggtggggaaagaagagtagacgaaactataaagggagatctttgtgatcatgggataaatctgtatcttgattgcagtggtagttgcaggcatctagacatgtgataaaatgacatagaactgtacacacttattttatcaatgtcaaattcttggttttaatatcgtactgtaattacgtaagaagtaaccaacaggagaaactgggtgcaggacacatcagacctctgtgctttatatcctgtctttgctactttctgtgaatctataattatttccaaataatttttttaaactttttttttatgctggatccgagtgggccctaaatccaatgactggtgtccttataagaagaaggagattggagatgcagtgacacataggaagaaagccacatgaccaaggaggcagagaccagagggatgcagctgagagccaaagagcaccaaggattgctgggagccaccagaagctggagaggtgtgggatggtttctccccgagaacctgcagaagacactaactctgcctgtgccttgaattcagatttctgtctccagacctatgacagaataaacttctgttgttttacggctcttagtttgtggtactttgttagggcagacccaagaaactactacaatggggatggccgagaagacagcgtacctctgaaggaactcccttctacactaatgagccataccccagcaagggttcacctccccaggtggctggcaaaatccactcacagaaatcgggctccacaggtctgagagttactcaaatccagaaagttcaggtcagcatgagttaaaagccaagcagacaagagatctagcctgcttctcctgagacgtggtatgcttttggctctgaaaatgaaccttggcatgagaatgcccttactctgacatgtacaggctgtgtggccctgagcacatttcttaatcggtgtgggcctccctttctcacctgtaaggtgcagatctgatggtaatgcctgataggtaaagaattgtgaagattaaaagaaatagcatgagtaaaaagcttagcacactgtgggttgcatggctccaaagctccctgggtcccatggtagatctagggcagaagtgaggcaagagaaagaaaaggaaaagagaagaaatcaaagagggagggaaaaagagaagggaggagagaaaaaaaaaagtgagaaaaatgtgtctgccaaggaaaaccaggaaggccatcccatgatatgccccacctgtggtaggatgggtatcctttctccaggtcagagacagcagcttggcatactgcgtggctcaccaagcatgaaacagcagtcattctgagagagaagaggcaggcccacacccatggcacagagccagacatcaactgtgggagaggaatgatgcctggacattgggggaaaacagtttatagatgccatggagactaagacacagtaagaaaaatgaaaacttcctggtagttggcagtggggttagtataacaataaatgtttagtgtcacaagattggggcactccaaatgctaaccaccacctccactgacactcttatcagccacctacaccatcccaagtacgcttgggcacacaattccccttgtccctccctcacactgtctgtgggacaaggagcttcactggtcttttcaaagtctttttctgactctaatgtctatacatcagagtgaggtcttctgtggcttcaaaactggactgtagctttctatttttaactcttttttctatgagaacaagtttttagaattcgccatgtttcctaggtttggtgctaatacattcgcccccacaagtccctgagcaagtcagtaagttgaacatattattttggagaaaagagaaagggagaagagaggatgagtatacgaattttggaagaacaataaatggaagatagaaagaaattgggaagggcagggaggaggaggtgaaggaggagaaagaggaagcaaagtctgactgatggaggataagaaatgaaacagaaagagaaaagaggaggacagattgatgtttgtgtgtttctttgtcttttcacaccgtgccttgttccaggtattaacaattccaagacttaactcttcaactgcgtctcttcaacctaacagctctctttgttctttcttgaaacctgcacccccagtgagctcaagtccatgtcagttcttttcatctttccatagaaagtgccccttgggctgggtacctgtgctggggaaggggaaggaggattttttataacagttatcagggtaggatctaacattttactaaactaaattgtcaaccatagcagctgctggagatcccaagcctgagtcactaggacacgggccaggggctctgcagcccttccctcactgagggagcacaagtgggtgaccaccagggatcaagtcagtccttaccatgagcatggagaaatatagtgaataaattattgggctgctttacctacatcatactgtgcatataattgcctgggaaaatatgctcacaagtcataatagcaagttactgcacttttgtgcttcagttttctcatctgaaagggggtggaggtcttacttgtaagattgctgtgaggattaaatgaaacagttcatataaagttctaagcatcaggcctagtatatactaagggatctataaatatttgttatcattagtaatggaaggagtagctcagtgaaatttggctattgtttgatttcctccttgaacttgttcttcagtcataactctttcagccttaatgtgcttgaaccttgaattaattcacgtatgttctagacttgatatccaatatcctgccactagccacacagagttattgagctctggagataaggccagtccatactaagatgggctatacgtgtaaaaacacatccaatttttaacattttgtacaaaaaatacgtgtaaaatattaatattttatatgattacatgttgagattaccctgtatatcttgtgtgcaaacaaaaatattattaaaattgattgcacagatttctttttacttttataacatggctagtgaaaacttctaaattatatatgtggatcacattataattttctgtatttcctgcatatttctatcagtcagtgttatctagattattgtaaactactaaatgtatccttgaaaatggtcccaagctttacacaagagttttggatcttgacattaagctggcccatgaagaaataagatagagttccctggactaacactgagcacctagtcaaggattagaataaatattaatcaaaggatttttctacttcaacacccccactctcaccattatacagatgagaaaactgacagagaaattcttgcttcgggttatccagatcctagaaggctgggcttgtatatactgatagttagctcactattaattcctttttaccactctctcttcttccagtcaattattttcctggaaatgctctcaatatttttttcttataaatacgggcatagaagttatgacaacataagccataattacataattgcccaagaatatgaacatactagaactcagacattgatatgacatattttgcacagagaaggaggtagacctaatatatttataaatactaatatatttgtatgatatgacatatgatgtagggaactggatggagggaagccactcccttgttccccctcacaatggcagcaatagtggaggatatagaacagtacaagataagatacacagtccttgccattaacgctctgccaatctaattggacagtcaagcaatggataaggaaattgaacttgccccatgaaataatagcatcaagcaggaaaacagtttggggatatgggaaacactgaccagtcatctgtaaacctcaatcacaatttagtcttttttttttttttttttgagatggagttttgctcttgttgtccacgctggagtgcaatggtgcaatctcagctcactgcaacctctgcctcccaggttcaagtgattctcctgcctcagcctcctgagtagctgggattacaagcatgtgccactatgcccggttaattttgtatttttagtggagacagggtttcaccatgttcgtcaggctggcctcaaactcctgaccacagatgatccacccacctcagtctcccaaagtgctgggattacaggtgtgagccaccgcgcctggccacactttattctttcattcagtaagtatgtattgaatgcctgaaatgtgccaggtactgtctttgatcctgaggctatcacacaggtaaaactccctgcctttgtgaagcttatagtctagctggggagataaatgataaagattgataaattttaaaatatagtattttagataacgacggggtaaacagagcattaaagcaagggcaggaattgttggaggagggttataagttttgacagggtcatcaggaaaggtgtcactaagaaggtagcattcaggtaaagatttaaatgaagtgggaagtaaaccatgtggataaataggtaagagcacagcaggaactgcaaataaaaagccctgaggtgggcatgtgcccggagtgctcatgacacagggttatagggagggcaggtcatgtcgggttttgtgggtcacaggaagcatttcttttaagtgagatgaggctggtaggctttgagcaaaataataatattgaggccggagacggtggctcacgccagtaatcccagcacttagggaggctgaggtgggtggagtttgagaccagactaggcaacatggggaaaccctgtctctacaaaaaatattatacaaacaattagccaggcgtggtggtgtgtgcctgtagtcctagctacttgggaggctgaggtagggagcccagggaggtggaggctgcagtaagctgtgatcgtgctactgtactgcagcctgagagacagagtgagaccctgtctcaaaaataataaaaataataataatatcatctgacatacataaacaggatttctctgggtgatctgatgagaataacccatccagggtgggataggaagatgtgtggaaaccccagttgggagcctgttacataatccaagcaggagatgaagctactttgaaagtagccctgccaggaagcactgctagtgttgatgtggggaagagagaaaactgaagggggaatccagggttttcagcctgatgaattggaaggatagagttgccttaactgaaatgaagaagtctatagaacataggcataggtttgggagctcaactttaattcacctggaattaatttttgtgtatagcatgaggtaagggtcaaggttcattttttccatgtggatgtgcagctgttccagcaccattttttacttttatttttactttttttcataaaatatatatacatttcatgagctgctgaaaattccagcactattcgtgtaaagacttttctttcccattagattgctttggtgcttttgttggaaatcaaatgacaatgtaagtttggtctatttctattttatttaattcccctaatcaattttattatccttatgtcaatagacacagtctcgattcctgaagctttaggagctctgttttgggtacgttgagtctgagatgtctattagacaacaaagtggagatgtcagatggacaactggctataagagtctagaattcagaagcaagaggtcagtgctggagacacaaacgtgatgtcatcaccacacacatggtgtaaaaagccatcagactgggagagagtacctagcaacgacataccaaaaaagaaatccaagcactgagccaggaggcactccaacgtaaagaagtcagcaagatgaggaggaaccagaaaagaagattgaaatagactggctagagaaggagatgaaaaaaacaggacagtgttgttatcctaggatccaagaggaaaaatgttacaaagaggaaaaaatggatcaactgtgtcaattgctgatgacaagtcaaccaagattaggaatggaaatgggccattggatttagccatattgggaatcactggtgaactagacaagtgcagtttctatagaatgccaggggcaaaagtctgatccaaatgggttcaaaagagaatgagagcgaagaaattggagagagcatgcatggacaatgctttcaaggagagaattagaagagggaaggagagaaatgaggtggtcactggaaggacaaaggggctctacagaggatatattttatcttttttctttattttcttattttttaatatttttcttattgatagttctacatgatacacaggtgagggtttattttaaatggagagaaacgacagcatttttaagtgctgataagaatgatttggtagaaagggaaaagctggtgctgaagaggagagaagagaaattgctggagcaatgttcctgagtaggtgagaagggtgggtgaagacaggtagaggtatcatcctcagctaggaacacagatgtttcatccacagaaacaaaggagaaagaggtatccagggcacagatgcagagaggtccacaggagggctgggatctgtttgtgatttctccagtaaatgtgtgtcgcttagattttgtaggtttagaagcttgggaaaatcttgaaaattgaaatgagcaaggaaaagttctagcgagggtgaagctaagaggagagaggatggggagaagagtgactctcacaggaggacatcctgaccacctgccagttcctttcttgttggctccatttgcagaccctttccctgaaaaaaccctccataaacaccccaacagacatgccctcacctgctgccttccctctccttcttccattccacttgctcctttcctgttctcagatacacaatgtcctcttttctcccttccttttccttccctcttctctgtctctctccccagttcctctcatcctttccaccctccattgacctgccaaactcttctcaggatctgaatggcccttactacccatatcatgtggttattgatctctgtatgagaacagtctgtctcccaactctggaaccttttgtatccctaaagctagcaagattctctgcacgcagccagaaaagggatgacagaggagagggtcaagggagttgggaggtagagaagaggaggggactgacatttgctagcactgtcacctgtatgaccccctttgctgtcataccatacactgagatgtttctcattagccctgtctcatagatgaagaaacagactaagaaagattgcattacgtgtttgggattacggagctagtaagacaaagaatcactatttaaactcaggttgtcaaacccagacttccaagcctttcccacagttttgcacatggtaggttctgtgttggtttccaataatatcagtttgtaataataacagttaggtctcagtcagctcctttaaaactaataaggtcagactgaatgttcagtaagggcctttcatctctatgaatccttctaaaaaaatatacaagcttttatttcaccatgggtccaagaacaaataagaaagagcccccaatttatgacacaccattaaaatattgatgatcaaaatgaaaaacaaaataggcataaaagagatgtatgaaattgctggcagctcggcccatgccaacttgtaacaggtttttattctatgatagttgtaatggatacaatgtctcaacactgacaagcaacatgtcactgaatcttccagcagcctctggggtagcttgttttaccctcttttgcagataaaaaaaaaaaaaaaaactaagacttagagaaagtcaataccatgtccaagatcacatcatcagaaattcccaaatcaggattcaaaatgaggcagcctgatcaagagccctaactctaaaacacagtgctggtttctcagtaactactcttcatggttgccattttcagaggcaaaacatcagtgactctcagagtgaaaaggagcttggaaatcaaagctctcatttaacacatgagaagacccaagcagagactgaatgacatgacctggtagagacagatttgagattcaaggtcagtgttctttctacctgttatgtttttataatttgcaacaatgaactaattgcagacatctcaagggaagaattctgaacttctgcagaaatggagagtcatcaagcctaagacaactaggaggagtgttggtctaatttggaaaaataactcattaatcaaaggtacctcttggtaccccagcatattccaccatcacatcccagtactcaggcccaaacatgcccccaaccagccccacctcagactggttattacagagtttcatggttacttgcctgagaagattaaaaaaagtaatgctaccttatgagggagagtcccagggaccaagatagcaactgtcatagcaaccgtcacactgctttggtcaaggagaagaccctttggggaactgaaaacagaaccttgagcacatctgttgctttcgctcccatcctcctccaacagggctgggtggagcactccacaccctttcagaagttcccaaggccccgtgcacctggggtcacaacaggacctggccaaggctgtgtccagcactgggatgggaagtaacaccaaccccaaccttgtttgatatcacttcacctaaatgcactgctccatctccagtcctggagttctcaccttggaaaacctcagcccagaataagtgtcctctaagagttctgatatggtaacaggacctatgcagacttcacgtgagaatgaagctgtgagcaagcaggtgcttcaggagacccagaagtgtcctggaaatatttaagagcagcaggaaaccatttatgttgaatagtttggtcatctcagaaaagagaggctgggaagaataaggatgaactatacatatcaacctttcagaatatatttcagtaaacttcctagagcccatgacagaagcattctcttctaccatattccctttccatccatgcatataaccatctgtacttctatccacccatctgttgatccttcctcaagtcataaggctcattgacagcccttctacaccaaacaacaccaactccagagaaaaacctgttcatatgcctggacgtatgaatgtccaccttcactaattccatagaaatgtattagcatttccatgtacctggctctctatgaagatttgcagataacatagtcaacaagacagaactctctacctcaaggagctcctagagtagtgtataaacaaataaccagaaattgcaacatggagaaatggagctgagaggagtgcctacagagctctacgtaagcacacagaaggggtgcctaacacatattggaggccagagaagttatacccctcctgcccaaacattaaccaacctgggaattacctaacatcaacagtgtcttcacacgtcattccaatgctctagccctctgattgggataccatgggttagtgagctctcacatgggaatctatcacttttttatcccctctttgtttggggttacttgtttataataaagcaataacaataaacctctatgtcaacatcactgtgaacagcaaatgaaatattgtgtataatccactttgtacggggcatggtgcagagaaggtgctcaattcacaatcttttcatattcttaattactaacaggttcttgagttcaatggctgagctcagtggatattctccctgcagtaattccacaaataaacccttcttaattttgacctgatacctttgtttcttccaatatgcaatacatcacaatccttccgttcatccttacctacttaacatgtaaaagtgaaaaaagtctctcaattttgaaacctgaagaaactgagccacaaggtgaaggcactatctgccaatactgtgtctcacccacaggcctaaggatccagttcagttcagtgtatttcccttcagcccatcctgcctcctgctcagtgccatgatggaaattacaaaatgctgcaagattagggtgaacattggatttcccaaaaaactaatatttcatactgaaaagaaatgtgcatcatcagcagcagtcatcactatatgatttaaagtggtgctatcattcagctatcttcccagccaaaataccagtgagttaactgtgtgttttgtatctctgtgggaaaggaggttctagactctaagatgtgacaaactcttctcgggctacatgccaactgagacctgccttcccaacctcttggttcataagcaggtaagtgatagcatgtttactgaagtcctctagtgactagaactattttttttttgtctttcattgtgcaaagatacaaataacaagaaaaaaagaaccatcacagagaagaaaaagaaaataagtagacaaaaacaacttggggaatcagaatatattcaacccaatctcttacaacttctgaccccacatgtattcctagatttttccatcctacagacatttatgagcccctggtccatgtgctagagatagggaggcagatgagggaaggtacataaggaagaggaggacatggcaacccctgtcctcgtgttgctgagcaggatttacagacactcactttgagtccgttcagagctgcagccaccaaattcaagcccaattctgttcctggacatgaataagaaggttttctcaccttttccctttcaattttcactgttctttctactgtattctcaaggatccacaactgggtttccaatatatattttcctttgtcatccaccagacaataatctagatgtgaggaaattctgggttaaggatcactaatctaaacaaataatctgccctggccttcaatattcctccagattttttaattcttactatgcattttgttgtttttcttgttgttgttaagaaatagaaaatactctgtgggtgtgagtgtgggtgtacacagcattttatttagaaaattgatgtttatcatttaattctattgtgtgtgcaactgaagtaaatttttcaaagaactaggggaaaggataatatacagaccttagagaaagagaaacaataatagtgatgggaataatgagaaaggaaagaaaagacagagaaacagagacagactgggcaggctctgaagagcattgtaaccagaggccctccctaggagtgccctggctgagggctgctgagaattgctgtgcattgagatgttcatcagttagtctgccactcactgcaccagagctctattgctggatgacataatttttgttagagtctccactatattaaccagagcagcccacccagaatttgaaagatttcctcaggttgcagcaatagcagacagaaccactccagccaaagggctagaagattctgaggcttaatgcctaccactcccacccatccttttaagattgacaatgcttgaggatggaggcacaatatcctaaattgactattaataaaacccaaagtccctgaaacaggagaagctaaataaacatatgtggaaaatgacacaatctacccctccttgcccccaccctggcacacacgcaggcctgcagatacatgctgctgtccagataccttctgcagctggctctctccaccctcaacctcaatttggttttctaattgaaattacatttccattggaaactcttgagccttgttgctcagaaatgtagtaacccctaatgattatgtaagaaaaaggaatgtgcttctttcaagtctacattctgcagtaagagttggtagatacaattaaacaagttcttaaaagttgcattttcactaggactacctgatattacagtggcaaatagcattatcacccatgttatcagattcttgacacatcccaaaataatgaggcacaaataaattgtcaaatgtaaactaacgaagctgttagtcttataattcttatgagttgtttatctgcaagtatatctgaacatgaaagcctggttccatttccagctgacctaaaaattcccacctcctgtaagagatcatctgtgaataatgagaaaccctcctgatttcacccagaattcaccctctctttgattccccacagtactgtattccctacatactatccatcatttatgtatttaatttgtctaagttccaagtatttctatctttatttcctatcaaaatatatactcctgaaaagcaaagtcttttgtccattatagaaactggcagtttcccggggaaactctgcacccaaaagaacatttgaagatcacaatagtcgtggaagacctccttactttacttccacgtttcagtctatgattcacctatcatttattgaggacctgaactaggatttttactccttgatctttatacaattctatatttattgtagagcttagcacaaagcacagtgctttggtcatacgagtatttgttgaataaataagtgagtgaacaaataaatgaattgttgatgattaatataagtttatagggcatttatggggattgtttttctgtgtgtgggtttgtttgtttgttatctggatgcaccaactcacagagtgtgacattactaacccagtttacagatgaagaaacaggaccagaaatatcaagagactagcccaagtggaaaagtcatctctcaggtacgtgctcgctgatttcaaatatttttgctccacatgaccacccacctggaacaacaccattagacctgatggtccaggcctccgtgaagagttctactgcactggtaatccactttccaactgcgatttcagggaccagtcagctcactcttctgctgtccttgtgcagcacacccacccttcgttgccctgagttccaaagcacgcttcatataaaaataggagatggcaccttctgaagccagccagctagaaatgaatttccatttcgcatgatcccagataatctagtccaactccaccaacaccacccccacctagcaccatggccgttctcaccagctctgtgcacacacaatgggcacttacacatagagtcaagaggatcagtccactttatttgtggagtggtttgaccagaggcaagaggtaattgagttgcccaggaaaggagtgcctatttgccctgagtgtgtgtgtctctccagacaaatttgccaaacaacctcatttggttataagcataaatcttttttccaaaaaaaaaagtaaagaaaatgttccttgtgaagttacttccaatatgtactctaaaaagaaataatagatctataaaaattctagggtttatgtaaaatattggtatgattttactcttgagttatgacttctatagataagagaaagagtctcagaatcactgagaaatgtgttgttttgacaagggccctaacagtgcagggcacagttgaggacatacaagcacacagatatcacaacatctatcctcaaggagccagttaaaaagaaaaaaatacaatccttgcccaaaaaaagaaaaattttgaagggtacaaacaagggaaaattctaacagtgcaaattgggcactaatgctctaagaagagccaactaaaagtggcagagtgaagaagctagattctaatgaatcaaaaatttgcattaaaaagctaaaaatgaattcatagtctaggaggacaggagagaaggggccagaaaaaccagactaccctctttattttaacaaatatggagactgagacttcgagaagctgactgacgtcctcaacactattagtagttagagctgaacccagactgtaagtcacttctctaggctgtctgtccatttctccttcctctactctacattctcaagcaaaattagacaaggaggccctgagaagttggcacatggggtaagaaagagccccaggcttcttaatggtggcaggaatgactagagggcagtatgagctatcctgtcttgttaacttctaattcaagggggaatgatttgatcgttagatttattggcacaaacacccaagtattttttggactggttagattggactcatttgcgtcaaattggcttgcatagggttgaaatgagtggcctgaatcagattaaaagctggaagaccaccaagggtcacagttgtgttgcatctcttcagattgtttcatttaaagggaacccacctactcaagctgtggaaggccagccctaagtatgcattactgcctaccgggcacgtcactgcatggagtccatgtgttccagaaaagtcaaaacacttttaaaggaagttcacagggagttctattgaaaatgaaggctccatctgccaaagtaaaacgtaaatcacctctggaattacctgtttgctaagttgactgcttttccttgaaggaataggtacctccattagagctgacccattcttgggaaaatcaggcattttctaaagaaatggcagcacaaatccctgagcccttatatcagggctcctagaaactctccctttcttcagattcaatatgaagttataggcaatttgagaaggaagatccacagaaatataaatggaagagagaggattccatcacctactggatttgtcatacttttttctcttaaaagaaaaagcaagccattcaaaggcagagatcacgatgaaaaccagagaggaaatcctgccccagagaaagatggaaccttagcccaggaactggtatattatgcaatccaagtcatacaatgtgaaatttttcaaaatgtttgacttaagaagtgaaagcctaataaaaggaatgtttttgaaattcatccaaaaacccataaccctaacacatctattattttcatttcccacattatattcttttctaacatttatctgagtatcttcatacatagccattgacactattactagaattttgtgttcaaattctttcacttgctgttgtttcacagcacttctttttttctacttatgcatcatattgaccattttgaatggtgcacatcattctatcttactaacagtgcataatttccttagccttttctccactgttggaacccataacttgcggtcttgactttttcttaggatgatcagctatgctggcacttcactctccaaaatttgactcagagaccatccttttaagaatttacctgctctgcatggggtaccttgtcctaggtgtagcactggaaggattttccagacttaatccattctctgtttcatatgtatttattttgtcttatccaaaatattgctagctttccttcctataggagatagcgttaaaaagaagataaaatattgctagcctcttgaggtcagagggcccatcttaaacttatttttcagcctcaaagctaatcaatagctagaagtcatgaagagaaaatggaccttattatttgaccccaagtgaacaagcattgtctgaatgcctaatgtgtatcacttgctaagcaatgttaaatcctctctctcatatgattcacaccatgaataaggtattattattcctaaattacaaagaaggagactggggttcagggtcagagatggttgatggtatagagcaaatgggatgtcaagatggtgagatgatgtgctttaaccaagaataagttttagtcccagctattcctgctggaataatattgctgggagaaataaacaagatagaaatggtaaattccaaaatctgacccctaatcggaagcatggagacagattatcaaagataggagggacccttgaggttatgaagaacaagtcctgtattttacaaatgaagaaactagaaaggtcaactgacaatgacaggaagtcaagaaaacaccacgatgaggggagagaccttcatcatttcattaatctgatcaacaggcaaggaagcaagggagtttccaccgtgccacgtcacatgaaacaagggcttctattttaagagcctagccctgcacctgctctatccagatgggcttggtgaaagaagaaatgaaaacaggcttttctcactatgggcctggggtgagggtctggtcacaggtttcttaagcaaaatggaggagccaaatgtcactgacgtgcccccatgggggtggggagcctttgctcctaagattctcaatgtagttactacagagcttgtcctcataacacaagggggaaagtaagacaaggtccagggagggcctgtctaacaccctggctaatgtatagtcccactgtgtgctgatgaagcaggaggaacaggcagcaggagaaggtgcagcccagccagagggtagaggcagggaagttgagagctagtgctccctgctcagaatgtccaggaaaaagaaatggttagatcttgaaataaatcgtcaaggaaagcagaaaatattttaatcataagttctttggtttaataataaaagtgcaatgaaaagaatctaagctttagagccagacagcactgacttggaatccagctctgccacacattgagtgactggccctgagcaagttactaacactgtctaaaccttagtttcctcgtctgtaatttttaaagataataacagagcacctctttgaagcttattatgaaggtagtgacaacatgacagcacctagggtcggacctaggttaacataacttcttctgttatttttatcaacctacatgtgaacattgctttacaattctcaaagttttgacaacatacttcactagtctgtttcttcatgtcggaacataggcagtaagtcctgtcttcagagtcctaccagtgacacagaggccattctgttgtatcctccttcttccaagaacctgcctctcaaatttgaaagattttataaatgttagtttcaatcattcattagacccccttgctctatcaaaaccagatgatataaaatctgttgtgggcagttatcaagacccacaaacactatttctttagaaaaaaaagaagaagaagagataaaaatacttcatgcagagctaaggaaatttccaaaattttttaagtaacctcagaaaattccatgttagctgacttactttaagaatgaattagtctagttaaaataaattgaatagattttaaaagaccatgaccgaagtaagatagagccagtagctctggtttccttttttaaatgattttcttcctctgataattcagaaacgatttcagagtctcacaacaaattattgcagtactataaaggggtaaaaatgttggtgaattagggttccatttcataaaatatcaaataaaccttattttccatatttatatttctctatttctctgtgtctaagagtctaaaaactataaaggactccacaactgtaaggtgctgttgtgattatgattaatttttttgcctctgatgtctgaactagggtattttcactttagtcaactctgttccctttctgtagaagaccaaacatcagatgctcactatacagtcattaaaaacagcgaactgaagtcccttctcagtcactaccttgttaataactgggaaagtcaccaggcctcagtttccctgtctgtaacatgaatgggttaaactgagtgattgtgaagctccccaacacatctaaaatactgtgatttctgcaaggcaatatgaagaatttttaaggtcttttctttgaacatgatttactatctacaatgtggagatgaccactttaatatgaaaagaggcctggcagcatgccttttagagacaaatttttagatttcaccaaatgaaaaagcatttaaagaggcactactctaagggagataactggccaaagagaataacagctaaaataacagctctgccagaaatagactgggcccatcatgccacttgatccacaactccctcagtgtgcatggccttgggcctccacaggcctttaggaatttactgcttaaaacacatgccctccctcacagacactgagaatacacctagagagtccaagagcaagattaggagatgatccagatcatttcaacaatgtagtcagaaggaaacacaaattcaatctagaaatccctgaatgtcctggtctgagtggacaaaattgccaaggcaactgatctagttttctcttcatctttgctgtggattcctattgagagatccctattccaaaagatacgttttaaaatagttaagtggctgacaatggaaataaaacttcggaaagaagcactggagttgaaaacaaacttggttctggttctgctttgatgcgattctgactgagtcatataatccacctaaaataagtctcggtataaaattggggataatatcacctgactacattctacacaacgttgagtaatggtgacacaaacaacaatcaagaaaacactttgcgagtttgttgaacatgaccttctaacaatagctcccagggatggtagcagaattttttttttttttttttttttttgtgaaaggcaacatggcctgcctccctgtccctgccaacaatgggaaccaaaagtgttttctccatatgtgatgggctcacaagtctactttcccttctgactccatatccagtgttcacttagtactgtgtaattaggacaacaggaagcatttccctcaactccctctttggatagaaatctgcaatcagaagcaaaaagtcaaagtttccactttactcttcagagtttgtgacaaaaaacttacagcatcagactatcaaatagaacaagcaccagacttgcagcctggataagtcagttattcttgtctctcagtgagagaatatctgtagaattcaatatttgaagcttagacattcgtagtaaatgtaaacacataagcatatatgtatgtctatatcctaactcacccttgagtacttttatttttatttttatttttattttttggctggttggagaggagagatagagatatatggaaataaacaaaaataatcctcacatagttggaaaataatacttgtaaaacatttaattggcattgtaaatcagtacaatcttttgaaaagggatttagtgacacataacaaaagttgttaaaattctgctccctttaactcaataatttcaagaaatttaaaagtcaatcattagaaaagttgtaaatgctcaacgataggggaaatgaccgaggacataatggggcaccaactcagtgagtaatttgcagtcagttgagaggagacccctgaagtctatgtgacaacatggaaaacaataaattaacaaggcatttataaagtgtggaattctatacctcttacaatcagctctatgtagaaacatatatgtttataaacaaagattgaaaagagaacacagacaaaaatgctaagactatggttgcattaaactgcaagattgcaaatttttttctttaaaatttttagttagaatatcatttttattatacaacaagtaatattcaggaactggaaaagagtcagaacaacctgccaacattgcataacagaagtaagaaataaacctttgtctgattttcagattgagatggaaccagtccctcccatgccagggcctgtgtggatcattccatggccccagagaccctactcctgcacccaaagtaaaatactttcacgaaccagaagaacataagagctaattgcttcctaacagttggaactaaatgatctgaaaggtaaaaattccccaatactggtgaaattttaatggtcacacaaacaacaatcaggaaaacattgtaagcttattgaacatgaccttctaacaacagcttccagggatggtagcagaattatttttgtgaaaggcaacatggcatgccttctaatgtttgacttttaaatttactgaaatcattcacttacagggagtggaattttcatggcctttgaaatgtgttactaaattccttttcaaaagattgtactgatttacaatgccacttgagagacaaatgcttcttagaatcataaatgatcttttattgtcaagtggcatgtagaaccataaaaataagcttagccattctagattgagaactggaaatactttagattctgacaattgtctaaaatattaataaattaacaagggtatgtctgggcacagatgcatgtttaagttaaagtcacttctctctaatttatcacttacatttgtctagttccattcttgagaatattcaaaaaggcaaaagtaggtataaaaaactgaaaagcatcagaaattttactgatttgattattgaaaatatttccatttcttttggaaaggcaatgcatgcatttggtaaaatattcaaacagtgcaagggagcagccatgggaagtaattctctctaccactccatatcccccaggctgataaatttttaataaaatatttatctctaaagtaggttttttaaatttttaataaaatattttagctctaaagtaggtttttaaccccaaaactggtatgttaataaaggcatagcaagaagctagggcttagagatacaacttgtgtaagctctccgtgcagagccaaatagttcttgaacttcttctaaaaccaaaactttcaaaatttgtttagaattatccttactatgaaattcagattgcaaaagtgtttgtcattttaattatagaaaattattcaaaaaataagttctagaatgcaatctcttacttatataaatatatttgggatcatttacttattgtcattattactcagatacagactcagaattagaaataatccagcaagtttcctatagaaaggggcacacagaaaatatattttgcccacgaactgaatttataattaatgagaacttgttgtatgcgtgcaattaaaaacaaaatctataaagttacttagagaaaggattcttcttttctcctcaaaacttttcaacataaatataaaatttcatatgcacacatgtcctatgatacagcaatctcttttaggagtaagagtgtattatgatgaattttcattgtatatttcaataaaaaataagaatgtactaaaaacccaagaagattatgcttaaaaaaggacccaatttcctttgagtgtcaccccagagagcacaactctcagctctgaaaggtacctgaagaattttcaggatcaacatttgtaagcattatcagcccaggataatgcttatttacagcagttcaacttttctcacctgcagtagtttactttgatgaaatcctgcttatttttcacaattaaaattgcgtccatggcccttgttacccttaagaattatattttgctgacacaatctctttatctacatttcacctaagtaagctttttctttacatgattttaagtcattttccaaaacagaaaagcataattatacaaccttctatgtgtattggaggaaaaaaagggtcacacaaataatagtacactctctcagttaaggagtaggcaggaggagggggttgagaaagacaaaccagaaagaattacatgaaattttccttcctcctcactgagcctcccttgaattgtccaataatatccccccaacacacacacatagacacagagcagactgtgagggacacgcagcctgggtgggactccaggagccagctcttaccctagagtttctgcacgggcagcaggttggcagcgcacactgtgggagccctagtggcagcccagggcgactcctcatgagtctgcagctgcatttttgccatatccactatttggagtctgacctccctaggaagcctccctgctccctaggacaacctgctctgacctctgaggacctgtctgtaaacgtccagagaaaagcatgtgcctgaagggtctatgaaggggcttgaggcaagtagggagcccagcccagctaacatttgcagccatgggatggctttgtgtacctagaaaagcaaagatgaggactaggcgagcacaggccccaaacgttcacgatacacatctcactgcaaagaaatgtcctctggccactttataatgcagctctaactataactggtgctttgctggtttgtggcctgggctggtctcccagagtcagtggctttgggtgagatggctccaggagacagcagaaactctcatatatgaagccttgcttgcagcgatttgaggcttactagggaaaagccatgatgggttttatagagcattaactgtgatacgccatctagggctgagagctctaagcagtgaccactggcacctccatgcaagtgcccttaggctacacctaatgagcacagtgaggctctgggctcagtggacaaccgtgccaatcacccaaagggacaaggaaggaccctcgagtgccagtggtgcttggcttggctttctcatgagtcctggtaagagcctgcctgaaatgggaggaagggtcagctctgagttagaggctgacagagacaaacctcttgggggcaggagctagctgacaggatgacacctgccctagggtcctgctctgaaatgcaaggaaatcccagccacagtccgccggtcaaggaaggccttgtgctagactggatcgccccctgctggccccatgcagccaggacactagcccttttagggccactgactaaagctggagggagcacggggagacacagcatataaaagtctgttgtttaacaacatcccatctttccctacgtacacattatctttttaaaaacgttattgtatctgccacaaacacactttccacttatttaattttaataatattgttcagtttctttagaaaatacagaaaaacataggaaactaaaagccatatatcgccctgtcagcagaagtaataccatttaacatgcatcatgtttatctagtcgagatcatgctgtgtggtggtcattgtccatctactcagatccatttcctgtccatggttccattggcaattggcttccagctggatatggccggtgggagacaccagcaagagacagggtagtgaaaagaagggataaggcagggtacttgaccatctctctccttcaggaagcagttttgcatcagtagctgcatctcctccatgattctagctgccaccaagtgcccatcctctgccctctcccaatgccactttctgcagccctgatggtggagtggcttcctgctgtgactcatctctgggctgcttccatgatgattgggtctctgctgttcatcacctgtgaagcatttcccacaataaattccctttgtttaaaatgtccagggtagtttattttccccactggatcatgaacgacaaatgtcacatgtataatttttggttaatttattatttaacaatgtaccactcaatattattccattaaggttttcctataattgtcagctctttcttttttttttttcttctgagatggagtcttgctctgtcacccaggctggagtgcagtggcatgatctcggctcactgcaacctccacctcccgggttcaagtaattctcctgcctcagcctcccggtagctgggattacaggcacctgccaccgcacctggctactttttgtatttttagtagagacagggtttcaccatgttggtcaagctggtcttgaactcctgaccttgtgatctgcctgccttggcctcccaaagtgctgggattacaggtgcgagccaccatgcctggccaatcctcagttctttacaaacctttctaagaaagggttgcttctgcttattatcttattatatcacatcttaattgcctcatttcattcaagtttccaatttttactaaaatatgaacaccttcgtgcataaatttctttccatacttctaagtatttgcttagactaaattcctggaagtgacaaaggataactcattttaagatcttagtacatatagccaagaaatctacaggaaaaaaggttaggtcagtttactctcccactagcagtagaagaaagcttgtctcaccataccctctgcagctgtgattagatgaatttgcaaattgtaaaggcaaaaacaaaaaagcatctggttgttactgttttaattcagatgtgttttgtttttatcgtaagtgaggtgagacatttctcaggagttattacccacctgcatttcctctttagtaaattatcttgtttattttactgtacagtccttggtgattatcttattgaccaaagaatcagtcagcacccttagaggcaaacaacagaagcagcctctggctaaattaagcagaaagggcatttattaaaaggatatcatgcaactccaaagtgaatgggaagtctgaaaaatcaggctcagaaaataggtgaaaacaagggaaactggtaagctggaaatatggccaaggttctaccctaaaacattctgaaaaacaaaaaatgtcactattaatgctgctgcctgaatgctattcctggcactgctgccacccaccactggattggatactgccagctgaatgaactttagtttaactcttcttgcatctttgtcattccctttaacagacgagttgcaaactctgcattcattcttctctcatcaggaagtggaatctatttctccacctccttgaatctagactgacattttgccttgccgtgagcaatagaagtggtagcagaagcatctctcacaaccgacagttgctgtgccttgaaactgggaagaaaacattccatcaactttaaagaaagccttacaataagctgagacccctccctgaaccatttctatagactcataacggatgccccagcccaaactctgcctcattcatcccagcctcctccctgcatccagcaatggctttgatcatgccactccactgcctaaaacccccactgtcaggttaagtccagagtccttagtgatggtgagcacagcttttcattacacggctcctcccttcccttctcttctcccaacacctccccagagccagcattacctgtcagccctcaaagctcctcgaatttacctgtacaaaccacgtcctcactgaccctcatctttgcacatgctgttccctctgcatggatgctccttctcccctcactccttccatcacacggcctgcctggtggcctcttagttttccttccagattcggtaactacagaaattactaagaaagttatacatacatatatatttttttaaaaagaggaattataatggtgtgaaaaattatatatacatatatatatatatataccaaaagaaaataaaagaggaatgggcagacgtggtcctcggggaggaggaagcaggaatggggatgcctggccctaactcagggtccctcccggactgcgcttcctaccattctggacccatcccagggaggccgggcgcactgccagccccattctgtgagtgcttatgagtgccaaggacccccttaaatgacttgctcagtcaggagcagctgcgacgggagtgtccgccagtgctggatggaagttcccgacaacactgttatccagtgggagatgagacccggccctcactggaggccttaggggcctgggctggcaatttcctgctagccttaaagccacagaaaaaggaaattctccctccatgagccaggatgcagtgactcagggtttgtaagtgtgctaggttgaactgcagagtgtggaactttcatgcaatgctacttgttttcagggtcctcttggggtactggagacaggcctgccatgcccctgctgggtaactgaggatgcccctctgccttttagagccagcatcctcctgtattcaaagcacaaaggagataaggatggctgctcacaaggcttcatgaggctgcagggccagtgacacgcgggtgggagctgccttatgggctgtaagcagcacccaggtgggctctgggtctctgagccacccacagggagacttgcagtcaggtgagccctgcccaggagcacccagcacagcctggctgggtccctgacctccagctgtggcacttggggtagtagcatgcgtgtggaagaccctagctcggatacagggagttccagccccacagaggtagggcactccagggctcctcccactctccctgacagcgggcctgtcatctcaccatatttcccttcaccttcctcagcggttcccactcccacccagacccccgcatggcccctcaggccctgggatggggctcctgctgcagccgccaggctggggcctgtgctgggctgtggcctacccatgggacagtgctgtgaagggaaggaatggtccaggggtgggcaggaaggagggcatgctggagcaagggcttccacaaactcatccacagaaagagagagatttccatcgcaacctggtacactactggcgggtgtgggtgtgtgcgtaagtgaaacaaaagatccaggaaacagtatttcccgttcctgtacacaatacgctcctatactttatatcctagtctgcttaagttctttttgttttgttttgtttttagagacaaagagtcttgccctgtcacccaggctgacaagtatagttcactgctgcctcgaactcctgggctcaaaggatcctcccactcagcctcccaagtagctagggctacaagtgtgcgtcaccatgctgttaattttttgaaatgttttctagggacaggatctcattttgttgcctaggctggcctcaaatgcctagcctcaagcaatcctcctacctcagcttcccaaagtgctgggattacaagtgtgagccattatgcccagttggcttcagttcttaatgctggttgataatccactaaatgaagtcacaatctgtgaatgagtctcactcatagtttgccagtcccaggactgggggaagtggtggaggcttggggagcccggcataatggcagagggtgggtgtcctgagtttggcctgggagtcgtggggggcagtggagtgtctgaagagagggtgaggggtatgggtgaccaggggctcctcagcagtgctgtggaggggctgtcgctggctgggactgaccttaacagaagggaaatgcactatctcgtgtcctgcgatctgggtcagcagctcggtcgtgtcatctgggatgcaggctcctttcctctttctcctcctccatttcacagctccaggttcaccactgcacagtaatggccagagcaagaaagggaccattgtgccctgtacccccttcttaggcaccaggtagactttccctctgtctcgttgaccaggacaaagccaaatatgtgtccctagtagggaatgtggtgagcctaatggcatgggcagcgacatccccttactggtgagagcccagttggggaactcacgccacagaaacagtttataatgagagaactctctttgcagcaaggtattcactgcagcatcatttgtaataggaaaaagctagaacacttcacataccctgactagggcctaattgagtaaatgaggttttatcaacttgatggaagataatttcgacactgaaaatacagtggaccctcataactcctggattctgtatttgcaagttcacctacttgctaagatgtatttgtaacccccaaattaatacacttggcactttcacagccattgacatgctcagagcagcgaaaaacttgagttgccagacatgaacacacattcccagctgaggtcaagcaaggtgacactctgccttcctttttgagttctcgtactataaggtgtcctttttgaggtccccttagtgctgcgtgttcagaaccaaactcccactcattttgggtgaacagaaccaaacccccaagggatgctacagtggtaggaacatgtgcacatctgtttgacagagctgtgactcatgaggcattttgcagagcaactgcctaatggggtctgaagcacagccccaggagaaaccttgtcttgttttttcccttttttttgagacagggtctctctctgtcacccatgctgaagtgcagtggcaaaatcaaggctgtctgcctcccgggctcaagtggtcctcccatctcagcctcccgagtagtggggactacaggcatgtgccaccatgtctgggtaatgtttgtatttttttagagacagggttttgccatgttgcccaggctgcttttgaacccttgggctcaagtgatc

(The sequence listing continues in the following parts.)

What is claimed is:

1. An isolated host cell that is capable of in vitro immunoglobulin gene rearrangement and which comprises a first nucleic acid composition for generating immunoglobulin structural diversity comprising a tripartite recombination substrate, wherein the tripartite recombination substrate comprises:
    (a) a first nucleic acid that comprises one or a plurality of mammalian immunoglobulin heavy chain variable ($V_H$) region genes each operably linked to an expression control sequence, each $V_H$ region gene consisting essentially of (i) an isolated immunoglobulin $V_H$ region encoding polynucleotide sequence, and (ii) a non-endogenous $V_H$ region recombination signal sequence that is located 3' to the isolated immunoglobulin $V_H$ region encoding polynucleotide sequence;
    (b) a second nucleic acid that comprises one or a plurality of mammalian immunoglobulin heavy chain diversity (D) segment genes, each of said immunoglobulin D segment genes consisting essentially of (i) an isolated D segment encoding polynucleotide sequence, (ii) a D segment upstream recombination signal sequence that is located 5' to each of said D segment encoding polynucleotide sequences and that is capable of functional recombination with the non-endogenous $V_H$ region recombination signal sequence, and (iii) a D segment downstream recombination signal sequence that is located 3' to each of said isolated D segment encoding polynucleotide sequences; and
    (c) a third nucleic acid that comprises one or a plurality of mammalian immunoglobulin heavy chain joining ($J_H$) segment genes, each of said immunoglobulin $J_H$ segment genes consisting essentially of (i) an isolated $J_H$ segment encoding polynucleotide sequence in operable linkage to an immunoglobulin heavy chain constant ($C_H$) region gene, and (ii) a non-endogenous $J_H$ segment recombination signal sequence that is located 5' to the $J_H$ segment encoding polynucleotide sequence and that is capable of functional recombination with the D segment downstream recombination signal sequence of (b)
    wherein the first nucleic acid composition is integrated in the isolated host cell and wherein the tripartite recombination substrate can undergo at least two or more recombination events in any order in the isolated host cell to form a recombined polynucleotide that encodes an immunoglobulin heavy chain polypeptide, and wherein the isolated host cell expresses said immunoglobulin heavy chain polypeptide.

2. The isolated host cell of claim 1 wherein the first nucleic acid composition further comprises a fourth nucleic acid that comprises a polynucleotide sequence encoding a membrane anchor domain polypeptide operably linked to said tripartite recombination substrate, and wherein said immunoglobulin heavy chain polypeptide comprises a membrane anchor domain.

3. The isolated host cell of either claim 1 or claim 2 wherein in the tripartite recombination substrate:
    (a) (i) the mammalian immunoglobulin $V_H$ region genes and the mammalian immunoglobulin heavy chain D segment genes are present at a ratio of about 1:1 to 1:2, and (ii) the mammalian immunoglobulin $J_H$ segment genes and the mammalian immunoglobulin heavy chain D segment genes are present at a ratio of about 1:1 to 1:2;
    (b) the mammalian immunoglobulin $V_H$ region genes and the mammalian immunoglobulin $J_H$ segment genes are present at a ratio of about 1:2 (V to J) to 2:1 (V to J);
    (c) the one or a plurality of mammalian immunoglobulin $V_H$ region genes, together with the one or a plurality of mammalian immunoglobulin $J_H$ segment genes, are not greater in number than the mammalian immunoglobulin heavy chain D segment genes; or
    (d) there are 6, 7, 8, 9, 10, 11 or 12 mammalian immunoglobulin heavy chain D segment genes.

4. The isolated host cell of either claim 1 or claim 2 wherein:
    (a) the first nucleic acid comprises 12-50 contiguous $V_H$ region genes of which about 10% to about 30% of said $V_H$ region genes that are contiguous with a 5'-most located $V_H$ region gene each comprise a $V_H$ region RSS of low or medium RSS efficiency, and about 70% to about 90% of said $V_H$ region genes that are contiguous with a 3'-most located $V_H$ region gene each comprise a $V_H$ region RSS of high RSS efficiency; and
    (b) the second nucleic acid comprises a plurality of contiguous D segment genes of which about 80% to about 90% of said D segment genes that are contiguous with a 5'-most located D segment gene each comprises a D segment upstream RSS of high RSS efficiency and a D segment downstream RSS of high RSS efficiency, and about 10% to about 20% of said D segment genes that are contiguous with a 3'-most located D segment gene each comprises a D segment upstream RSS of low or medium RSS efficiency and a D segment downstream RSS of low or medium RSS efficiency, wherein (i) the plurality of $V_H$ region genes, together with (ii) the one or a plurality of $J_H$ segment genes, are not greater in number than said plurality of D segment genes.

5. The isolated host cell of either claim 1 or claim 2 that is characterized by one or more of:
    (a) the first nucleic acid comprises 12-50 contiguous $V_H$ region genes of which about 10% to about 30% of said $V_H$ region genes that are contiguous with a 5'-most located $V_H$ region gene each comprise a $V_H$ region RSS of low or medium RSS efficiency;

(b) the first nucleic acid comprises 12-50 contiguous $V_H$ region genes of which about 70% to about 90% of said $V_H$ region genes that are contiguous with a 3'-most located $V_H$ region gene each comprise a $V_H$ region RSS of high RSS efficiency;

(c) the second nucleic acid comprises a plurality of contiguous D segment genes of which about 80% to about 90% of said D segment genes that are contiguous with a 5'-most located D segment gene each comprise a D segment upstream RSS of high RSS efficiency and a D segment downstream RSS of high RSS efficiency; and (d) the second nucleic acid comprises a plurality of contiguous D segment genes of which about 10% to about 20% of said D segment genes that are contiguous with a 3'-most located D segment gene each comprise a D segment upstream RSS of low or medium RSS efficiency and a D segment downstream RSS of low or medium RSS efficiency.

6. The isolated host cell of claim 2 wherein the membrane anchor domain polypeptide comprises a polypeptide that is selected from the group consisting of a transmembrane domain polypeptide, a glycosyl-phosphatidylinositol-linkage polypeptide, a lipid raft-associating polypeptide and a specific protein-protein association domain polypeptide.

7. The isolated host cell of claim 1 wherein the first nucleic acid composition comprises the first, second, and third nucleic acids joined in operable linkage as a single nucleic acid molecule.

8. The isolated host cell of claim 1 wherein the first, second, and third nucleic acids are joined in operable linkage in a vector.

9. The isolated host cell of claim 8 wherein the vector is selected from the group consisting of a viral vector, a plasmid, a cosmid, a transposon and an artificial chromosome.

10. The isolated host cell of either claim 1 or claim 2 wherein the mammalian immunoglobulin $V_H$ gene is selected from the group consisting of a human $V_H$ gene, a mouse $V_H$ gene, a rat $V_H$ gene, a rabbit $V_H$ gene, a canine $V_H$ gene, a feline $V_H$ gene, an equine $V_H$ gene, a bovine $V_H$ gene, a monkey $V_H$ gene, a baboon $V_H$ gene, a macaque $V_H$ gene, a chimpanzee $V_H$ gene, a gorilla $V_H$ gene, an orangutan $V_H$ gene, a camel $V_H$ gene, a llama $V_H$ gene, an alpaca $V_H$ gene and an ovine $V_H$ gene.

11. The isolated host cell of either claim 1 or claim 2 wherein the tripartite recombination substrate is under control of at least one operably linked recombination control element.

12. The isolated host cell of claim 11 wherein the recombination control element is an inducible recombination control element.

13. The isolated host cell of claim 12 wherein the inducible recombination control element is tightly regulated.

14. The isolated host cell of either claim 1 or 2 wherein the cell is selected from the group consisting of a human cell, a non-human primate cell, a camelid cell, a hamster cell, a mouse cell, a rat cell, a rabbit cell, a canine cell, a feline cell, an equine cell, a bovine cell and an ovine cell.

15. The isolated host cell of claim 1 or claim 2 wherein the expression control sequence is selected from the group consisting of a constitutive promoter, a regulated promoter, a repressor binding site and an activator binding site.

16. The isolated host cell of claim 15 wherein the regulated promoter is selected from the group consisting of a tightly regulated promoter and an inducible promoter.

17. A method for generating structural diversity in one or a plurality of immunoglobulin heavy chain variable (VH) region genes, comprising, maintaining the isolated host cell of either claim 1 or claim 2 under conditions and for a time sufficient for the tripartite recombination substrate to undergo two or more recombination events to form a recombined polynucleotide that encodes an immunoglobulin heavy chain polypeptide, and thereby generating structural diversity in one or a plurality of immunoglobulin $V_H$ region genes.

18. The method of claim 17 wherein the recombination events result in formation of a recombined polynucleotide that encodes an immunoglobulin heavy chain polypeptide having a membrane anchor domain.

19. The method of claim 17, wherein the step of maintaining the isolated host cell comprises maintaining under conditions and for a time sufficient for expression of the immunoglobulin heavy chain polypeptide.

20. The method of claim 17 wherein less than one of said recombination events occurs per cell cycle of the isolated host cell.

21. The method of claim 19 comprising, prior to the step of maintaining, expanding the isolated host cell to obtain a plurality of host cells that are capable of immunoglobulin gene rearrangement and that comprise at least one chromosomally integrated tripartite recombination substrate.

22. The method of claim 21 wherein the at least one chromosomally integrated tripartite recombination substrate is under control of at least one operably linked recombination control element.

23. The method of claim 22 wherein the recombination control element is an inducible recombination control element.

24. The method of claim 23 wherein the inducible recombination control element is tightly regulated.

25. The method of claim 19 further comprising, prior to the step of maintaining, expanding the isolated host cell to obtain a plurality of isolated host cells that are capable of immunoglobulin gene rearrangement and that comprise at least one chromosomally integrated tripartite recombination substrate, wherein the at least one chromosomally integrated tripartite recombination substrate is under control of at least one operably linked recombination control element that is an inducible recombination control element, and wherein the step of maintaining comprises contacting the plurality of isolated host cells with a recombination inducer.

26. The method of claim 17 wherein the isolated host cell that is capable of immunoglobulin gene rearrangement is selected from the group consisting of:

(a) an isolated host cell that is capable of dividing without immunoglobulin gene rearrangement occurring;

(b) an isolated host cell that can be induced to express one or more recombination control elements selected from a RAG-1 gene and a RAG-2 gene; and (c) an isolated host cell that expresses first and second recombination control elements that comprise, respectively, a RAG-1 gene, and a RAG-2 gene, wherein expression of at least one of said recombination control elements by the host cell can be substantially impaired.

27. The isolated host cell of claim 2, wherein the isolated host cell further comprises a second nucleic acid composition for generating immunoglobulin light chain structural diversity which comprises:

(a) a fifth nucleic acid that comprises one or a plurality of mammalian immunoglobulin light chain variable ($V_L$) region genes each operably linked to an expression control sequence, each $V_L$ region gene consisting essentially of (i) an isolated immunoglobulin $V_L$ region encoding polynucleotide sequence, and (ii) a non-endogenous $V_L$ region recombination signal sequence that is located 3' to the isolated immunoglobulin $V_L$ region encoding polynucleotide sequence;
- (b) a sixth nucleic acid that comprises one or a plurality of mammalian immunoglobulin heavy chain diversity (D) segment genes, each of said immunoglobulin D segment genes consisting essentially of (i) an isolated D segment encoding polynucleotide sequence, (ii) a D segment upstream recombination signal sequence that is located 5' to each of said isolated D segment encoding polynucleotide sequences and that is capable of functional recombination with the non-endogenous $V_L$, region recombination signal sequence, and (iii) a D segment downstream recombination signal sequence that is located 3' to each of said isolated D segment encoding polynucleotide sequences; and
- (c) a seventh nucleic acid that comprises one or a plurality of mammalian immunoglobulin light chain joining ($J_L$) segment genes, each of said immunoglobulin $J_L$ segment genes consisting essentially of (i) an isolated $J_L$ segment encoding polynucleotide sequence in operable linkage to an immunoglobulin light chain constant ($C_L$) region gene, and (ii) a non-endogenous $J_L$ segment recombination signal sequence that is located 5' to the isolated $J_L$ segment encoding polynucleotide sequence and that is capable of functional recombination with the D segment downstream recombination signal sequence of (b);

wherein the second nucleic acid composition is integrated in the isolated host cell and wherein the second nucleic acid composition for generating immunoglobulin light chain diversity can undergo at least two or more recombination events in any order in the isolated host cell to form a recombined polynucleotide that encodes an immunoglobulin light chain polypeptide having an immunoglobulin $V_L$ region, an immunoglobulin $J_L$ segment, and an immunoglobulin $C_L$ region, and wherein the isolated host cell expresses said immunoglobulin light chain polypeptide.

28. The isolated host cell of claim 2, wherein the isolated host cell further comprises a second nucleic acid composition for generating immunoglobulin light chain structural diversity which comprises:
- (a) a fifth nucleic acid that comprises one or a plurality of mammalian immunoglobulin light chain variable ($V_L$) region genes each operably linked to an expression control sequence, each $V_L$ region gene consisting essentially of (i) an isolated immunoglobulin $V_L$ region encoding polynucleotide sequence, and (ii) a non-endogenous $V_L$ region recombination signal sequence that is located 3' to the isolated immunoglobulin $V_L$ region encoding polynucleotide sequence;
- (b) a sixth nucleic acid that comprises one or a plurality of mammalian immunoglobulin heavy chain diversity (D) segment genes, each of said immunoglobulin D segment genes consisting essentially of (i) an isolated D segment encoding polynucleotide sequence, (ii) a D segment upstream recombination signal sequence that is located 5' to each of said isolated D segment encoding polynucleotide sequences and that is capable of functional recombination with the non-endogenous $V_L$ region recombination signal sequence, and (iii) a D segment downstream recombination signal sequence that is located 3' to each of said isolated D segment encoding polynucleotide sequences; and
- (c) a seventh nucleic acid that comprises one or a plurality of mammalian immunoglobulin light chain joining ($J_L$) segment genes, each of said immunoglobulin $J_L$ segment genes consisting essentially of (i) an isolated $J_L$ segment encoding polynucleotide sequence in operable linkage to either a specific protein-protein association domain encoding polynucleotide or a membrane anchor domain encoding polynucleotide, and (ii) a non-endogenous $J_L$ segment recombination signal sequence that is located 5' to the $J_L$ segment encoding polynucleotide sequence and that is capable of functional recombination with the D segment downstream recombination signal sequence of (b), wherein the second nucleic acid composition is integrated in the isolated host cell and wherein the second nucleic acid composition for generating immunoglobulin light chain diversity can undergo at least two or more recombination events in any order in the isolated host cell to form a recombined polynucleotide that encodes an immunoglobulin light chain polypeptide having (i) an immunoglobulin $V_L$ region, (ii) an immunoglobulin $J_L$ segment and (iii) either a specific protein-protein association domain or a membrane anchor domain, and wherein the isolated host cell expresses said immunoglobulin light chain polypeptide.

29. The isolated host cell of claim 2, wherein the isolated host cell further comprises a second nucleic acid composition for generating immunoglobulin light chain structural diversity which comprises:
- (a) a fifth nucleic acid that comprises one or a plurality of mammalian immunoglobulin light chain variable ($V_L$) region genes each operably linked to an expression control sequence, each $V_L$ region gene consisting essentially of (i), an isolated immunoglobulin $V_L$ region encoding polynucleotide sequence, and (ii) a non-endogenous $V_L$ region recombination signal sequence that is located 3' to the isolated immunoglobulin $V_L$ region encoding polynucleotide sequence; and
- (b) a sixth nucleic acid that comprises one or a plurality of mammalian immunoglobulin light chain joining ($J_L$) segment genes, each of said immunoglobulin $J_L$ segment genes consisting essentially of (i) an isolated $J_L$ segment encoding polynucleotide sequence in operable linkage to an immunoglobulin light chain constant ($C_L$) region gene, and (ii) a non-endogenous $J_L$ segment recombination signal sequence that is located 5' to the isolated $J_L$ segment encoding polynucleotide sequence and that is capable of functional recombination with the non-endogenous $V_L$ region recombination signal sequence of (b);

wherein the second nucleic acid composition is integrated in the isolated host cell and wherein the second nucleic acid composition for generating immunoglobulin light chain diversity can undergo at least two or more recombination events in any order in the isolated host cell to form a recombined polynucleotide that encodes an immunoglobulin light chain polypeptide having an immunoglobulin $V_L$ region, an immunoglobulin $J_L$ segment, and an immunoglobulin $C_L$ region, and wherein the isolated host cell expresses said immunoglobulin light chain polypeptide.

30. The isolated host cell of claim 2, wherein the isolated host cell further comprises a second nucleic acid composition for generating immunoglobulin light chain structural diversity which comprises:
- (a) a fifth nucleic acid that comprises one or a plurality of mammalian immunoglobulin light chain variable ($V_L$) region genes each operably linked to an expression control sequence, each $V_L$ region gene consisting essentially of (i) an isolated immunoglobulin $V_L$ region encoding polynucleotide sequence, and (ii) a non-endogenous $V_L$ region recombination signal sequence that is located 3' to the isolated immunoglobulin $V_L$ region encoding polynucleotide sequence; and (b) a sixth nucleic acid that comprises one or a plurality of mammalian immunoglobulin light chain joining ($J_L$) segment genes, each of said immunoglobulin $J_L$ segment genes consisting essentially of (i) an isolated $J_L$ segment encoding polynucleotide sequence in operable linkage to either a specific protein-protein association domain encoding polynucleotide or a membrane anchor domain encoding polynucleotide, and (ii) a non-endogenous $J_L$ segment recombination signal sequence that is located 5' to the isolated $J_L$ segment encoding polynucleotide sequence and that is capable of functional recombination with the non-endogenous $V_L$ region recombination signal sequence of (b), wherein the second nucleic acid composition is integrated in the isolated host cell and wherein the second nucleic acid composition for generating immunoglobulin light chain diversity can undergo at least two or more recombination events in any order in the isolated host cell to form a recombined polynucleotide that encodes an immunoglobulin light chain polypeptide having (i) an immunoglobulin $V_L$ region, (ii) an immunoglobulin $J_L$ segment and (iii) either a specific protein-protein association domain or a membrane anchor domain, and wherein the isolated host cell expresses said immunoglobulin light chain polypeptide.

31. The isolated host cell of claim 1, wherein the isolated host cell further comprises a second nucleic acid composition for generating immunoglobulin light chain structural diversity which comprises:

(a) a fifth nucleic acid that comprises one or a plurality of mammalian immunoglobulin light chain variable ($V_L$) region genes each operably linked to an expression control sequence, each $V_L$ region gene consisting essentially of (i) an isolated immunoglobulin $V_L$ region encoding polynucleotide sequence, and (ii) a non-endogenous $V_L$ region recombination signal sequence that is located 3' to the isolated immunoglobulin $V_L$ region encoding polynucleotide sequence; and (b) a sixth nucleic acid that comprises one or a plurality of mammalian immunoglobulin heavy chain diversity (D) segment genes, each of said immunoglobulin D segment genes consisting essentially of (i) an isolated D segment encoding polynucleotide sequence, (ii) a D segment upstream recombination signal sequence that is located 5' to each of said isolated D segment encoding polynucleotide sequences and that is capable of functional recombination with the non-endogenous $V_L$ region recombination signal sequence, and (iii) a D segment downstream recombination signal sequence that is located 3' to each of said isolated D segment encoding polynucleotide sequences; and (c) a seventh nucleic acid that comprises one or a plurality of mammalian immunoglobulin light chain joining ($J_L$) segment genes, each of said immunoglobulin $J_L$ segment genes consisting essentially of (i) an isolated $J_L$ segment encoding polynucleotide sequence in operable linkage to either a specific protein-protein association domain encoding polynucleotide or a membrane anchor domain encoding polynucleotide, and (ii) a non-endogenous $J_L$ segment recombination signal sequence that is located 5' to the isolated $J_L$ segment encoding polynucleotide sequence and that is capable of functional recombination with the D segment downstream recombination signal sequence of (b), wherein the second nucleic acid composition is integrated in the isolated host cell and wherein the second nucleic acid composition for generating immunoglobulin light chain diversity can undergo at least two or more recombination events in any order in the isolated host cell to form a recombined polynucleotide that encodes an immunoglobulin light chain polypeptide having (i) an immunoglobulin $V_L$ region, (ii) an immunoglobulin $J_L$ segment and (iii) either a specific protein-protein association domain or a membrane anchor domain, and wherein the isolated host cell expresses said immunoglobulin light chain polypeptide.

32. The isolated host cell of claim 1, wherein the isolated host cell further comprises a second nucleic acid composition for generating immunoglobulin light chain structural diversity which comprises:

(a) a fifth nucleic acid that comprises one or a plurality of mammalian immunoglobulin light chain variable ($V_L$) region genes each operably linked to an expression control sequence, each $V_L$ region gene consisting essentially of (i) an isolated immunoglobulin $V_L$ region encoding polynucleotide sequence, and (ii) a non-endogenous $V_L$ region recombination signal sequence that is located 3' to the isolated immunoglobulin $V_L$ region encoding polynucleotide sequence; and (b) a sixth nucleic acid that comprises one or a plurality of mammalian immunoglobulin light chain joining ($J_L$) segment genes, each of said immunoglobulin $J_L$ segment genes consisting essentially of (i) an isolated $J_L$ segment encoding polynucleotide sequence in operable linkage to either a specific protein-protein association domain encoding polynucleotide or a membrane anchor domain encoding polynucleotide, and (ii) a non-endogenous $J_L$ segment recombination signal sequence that is located 5' to the isolated $J_L$ segment encoding polynucleotide sequence and that is capable of functional recombination with the non-endogenous $V_L$ region recombination signal sequence of (b), wherein the second nucleic acid composition is integrated in the isolated host cell and wherein the second nucleic acid composition for generating immunoglobulin light chain diversity can undergo at least two or more recombination events in any order in the isolated host cell to form a recombined polynucleotide that encodes an immunoglobulin light chain polypeptide having (i) an immunoglobulin $V_L$ region, (ii) an immunoglobulin $J_L$ segment and (iii) either a specific protein-protein association domain or a membrane anchor domain, and wherein the isolated host cell expresses said immunoglobulin light chain polypeptide.

33. The isolated host cell of any one of claims 28, 31 and 32 wherein the protein-protein association domain is selected from the group consisting of a mammalian immunoglobulin light chain ($C_L$) constant region, an RGD-containing polypeptide that is capable of integrin binding, a lipid raft-associating polypeptide domain, and a heterodimer-promoting polypeptide domain.

34. The isolated host cell of claim 33 wherein the mammalian immunoglobulin light chain ($C_L$) constant region is selected from a kappa constant region and a lambda constant region.

35. The isolated host cell of claim 28 wherein at least one mammalian immunoglobulin heavy chain diversity (D) segment gene comprises one or a plurality of artificial D gene segments.

36. The isolated host cell of claim 27 wherein the fifth, sixth and seventh isolated nucleic acids are joined in operable linkage as a single nucleic acid molecule.

37. The isolated host cell of claim 27 wherein the second nucleic acid composition comprises a vector which comprises the fifth, sixth and seventh isolated nucleic acids joined in operable linkage.

38. The isolated host cell of any one of claims 27-30 wherein the second nucleic acid composition is selected from the group consisting of a viral vector, a plasmid, a cosmid, a transposon and an artificial chromosome.

39. The isolated host cell of claim 27 wherein the mammalian immunoglobulin $V_L$ gene is selected from the group consisting of a human $V_L$ gene, a mouse $V_L$ gene, a rat $V_L$ gene, a rabbit $V_L$ gene, a canine $V_L$ gene, a feline $V_L$ gene, an equine $V_L$ gene, a bovine $V_L$ gene, a monkey $V_L$ gene, a baboon $V_L$ gene, a macaque $V_L$ gene, a chimpanzee $V_L$, gene, a gorilla $V_L$ gene, an orangutan $V_L$ gene, and an ovine $V_L$ gene.

40. The isolated host cell of claim 27 wherein the second isolated nucleic acid composition for generating immunoglobulin light chain structural diversity is under control of at least one operably linked recombination control element.

41. The isolated host cell of claim 40 wherein the recombination control element is an inducible recombination control element.

42. The isolated host cell of claim 41 wherein the inducible recombination control element is tightly regulated.

43. The isolated host cell according to any one of claims 1, 2, 27 and 31 that is genetically engineered to express a mammalian RAG-1 gene, a mammalian RAG-2 gene and a mammalian TdT gene, or a fragment thereof that encodes a protein that is capable of mediating immunoglobulin gene rearrangement and junctional diversity.

44. The isolated host cell of claim 43 in which expression of one or more of the mammalian RAG-1 gene, mammalian RAG-2 gene and mammalian TdT gene, or a fragment thereof that encodes a protein that is capable of mediating immunoglobulin gene rearrangement and junctional diversity, is inducible expression.

* * * * *